United States Patent 10,221,454 (METHODS AND COMPOSITIONS FOR SCREENING AND TREATING DEVELOPMENTAL DISORDERS) - sequence listing, part 6

SEQ ID NO: 85 - DNA, 890001 bp, Homo sapiens
tgattccagctctcgcgcccgacgaggtggatttggctgtccaccgagctccggcgcctgtcgttctaattgggtttggatttgcaccgttaaggaggggggaagagaaggaagaggcgggcgaggaaggcgagtccagctagcggctgttgcggggaccgtagccccagctgcagctccgaagaatcccccgccacggtttcggtggagcgtctgggcacgggatggagtgaaagagcgagtgcctctccaagcgggggtgggagggggtcaggctgtgcagaggagagagacagcgagaagaagccgcggctggctactgcgaatttgggattcgattgggagggaccgctcactcgggggaaatggattctttaccacggctgaccagcgttttgactttgctgttctctggcttgtggcatttaggattaacagcgacaaactgtgagtacgaggagctgggggcgggaaggtgaggtggaaaacgatcgcattcagaaagacaatcaactatctaagcgtactcgattgtgtctgctttgggcaaaggaaacggaaaaaaaatgctgatcagtgtggttccatcactccaaccatcccaaaagttagtagagctcaaatgagccaaccgtgctggatttcctcccttcttccgttatcgcaaagttcaagggataaggaaaggtttctcttcccttaacctcctgctagctccgcgttccatgcctgcctgatctcagccagtgctttttccggagaagggcccctggttcagacagaatgcactgggagctgagcttcctgggatggagatgctcccagccaccgtgctcggtgacagtggctcatctctgaatgcagtgcctcggatttgcagtataccaagcaccccacgatacgtggctctgcgttctgccctaggcagaaggctccagttggggtatcttgcaaccaatgggcaccggtttaacaggattgggagttttggcctaagagtcatggaccaatgttgttaaccacaagatcaatggctgcccctattacaggaggaagagctttgatgcataccccaccccaaaaatctttgtgcctgtgaacactaatgagtatgcactaagtgtacactctgtcgtccaagctctaacctcggcaagtgtaggacatttaatttaataggcaagaagcctgggctcccggggatccaccaactgcactatatatttaaagaatccagtccgtcaaacttgaataaatctctggagctatgagaggttcaggctcaattcctcagctgcctctctaggcagagaaagggaagtttttccagctctgggacttcctaaatgagaaagaatgcaattaagccatctgtgttgtttccaaagatggtttatcaaggtccctcaagtttctgggcttgctcccatatcccttatccctgtcatgaagctcagaaatattacccatattggaacagttttactttttagtttttgtaatttgcactatcatggttggttagagaacagtaggaagattacttaccacatagggacctttctacctcactctccacccagttaggtcctagaggaccctgtgcatttatccccggagttatgtctcaagggaagacaattggacaaatgtggtgtatagaaaaatgttcacaactgagccagtgtttctgtctgtggtcggaagttttggagggccagcatctatagttagtcataatgccttataccgattgtattaaagtttgtgttctacaggaaggctaaagggatcatcctctctaagggagtatccaaagggccctggtttagaaattatttcagagaatatgtaggagccgttggaatctgagtttttttcttttacttcttcatctcattctcttccacctccttctttttcttcttctgtggaattgttcccgtggtgctttagaaaaagatctaagtggttagtaagaggaggtaaggcacagcgctgggctatttttctccaccttctagaacactagaggtcagtattgtcctaatgatacaaaggcgtggcagcaagctagctgtgttttcccttcagcacagctgcctatctgagaagagtgaatactttgaaaagccacaaaggtgggggtgagagataaggataaaaaagacagaacatactccacacgcatatggctgtggactttctaatgcaacaccttttcttaagagccaataaaacaaatattttagaatagcattttttgtaaattaattgaattatggttaatgtgttttaaaaatgctcataaaacctaaatgacatggatttaagactcatgcttatcattaccgatgtagtaataaagctaattctgaacatttaaaatgaaactttgtgataatgagctttagtattttatcagtgacagtttaatttccctatttccaatcaacattttaattgaatgctcactgcttgctaaatattttgaagtcagcgttcttaaggaataattattaatgatcattatgctgtacaaaatctattaattgaataatagaacagcagaaaaaaattagctctgaacttgatatattttggtgtcttcataacctatgatgcagaagctctaagaaatatgcattaaaattccacaattcctttagatttctactgaccacactctttattcattaaatataggacttgggtttatttttatctataatcaattaatatttgtatacatatactgaacattagcaatttattttcaaatagtcactttataaaagtttatttggaaatttttttacaagattattcttcctatattttgaagtaatatgtcgtgacatttgtgacagtagccttgaaaatggatttactaacccaatattttccatagtatatagttgcactgtggactttgttcaggtatacataacttctaattgtttttattattcttataataatatgttgttggtggttgttactatggtgtggtgtgtatgtgtgtgttttgtgtgtgtgtgtgcacatgcatttacatttctcataatctgaccgaaacctgggcttttaacttcaaaggaaagatgaatgcttgcccaattatagattttataagtttctaattaaacaaaattaaaataaagtcaggttagaagggccagcttcagtacagatattatgaatctgtgcagagaacataattacttaccagtaataaaaactgcagaaattccctcatttcagattttcaggatattaaatagctacaattcctcctctgggtttatcctgagggaattagttaacatcaaatgtagatatagtaggccaatgtttaatgaaaaatcattttacatataatattaactcttttgacataagaagaagtgatatgacttgatagttggttaaagtgaaactgggagttagaagagctgaggagttctagccctagttatgccacagctaagcgttcaaatacctattatgttattcaaccttatagtgctcacaggcttgagtataaaacagcaattgaggtatgcgtctactccaaaacagaacagcaggtaaatatgttactgagaaaattatttaaatattaagtatggtaagagatgattgcactgataaaatgtgcattcagaagatagcaggaatacatggagcacatatggggtcactattaactatttttaacaataagtataagttgtgcgattataaagagctttaattttgagcaatacatcactttgaatgatttccatgtgcagtatctaagtttgttgctacatattagggtcacacaaatacagcattgagagagggatcaaaaactcttcattctagctcattcatcatatgtagaatttcaactaagatatatgaggacttcaatcagattcataaagctcttcaaataaggagatgaactatactttgagttatccgaagcttatgcacaaactcaatcaatagataatattaaaaataaacaatcacgctggttttttcagcagcaactttttgtggcatttacagtcaccacaagtaaaggaagcactccaatgctcatttggaagagtcctaaagattttccttttgttgaattggcttatctttgacagtacctatgagctctttttcctttctcttcccatagtcccccatctcaaaactaaattgatatttctgcaattgggaaatgtataccaaaccctggactagcgatttccacacaagttcaaaattatgaaaaaattagttttattacgaaaaccttactctctccttgctttatttttgttctaatgaatgactatcctctaaattgcagttttctttctttttcctttgttcctctgcccaatttcattgctttctttactggatctcggtttccctttactgaatcactttatttcttaatgcccatttgttaaaaaaacaaagtaatgcgatatcatttgaaatgcccctgaaaccttcagttggtgattcagagtcttcgagttgataagccagaacttcactcaaatatttcctgtgtatacaatgataattatcccccttagatgagaaggtggagaaaagatctagttacctaaaatcccagaggacaattggaattcactcaataggactttattgaaaggttgcagtgtacatatttggagccaataatgacatttttaattcataagggaaggtttcttcattcatcaaaactctgccactttctggatggtgaccttgtagaggttacttagttaccccaatgatcttgctgtatgcaacgaagaaaatggattagatcattattattaacatcctatttacttttaatgtaatttgtctttaaatgctgatattgcctactggtcattttatttggatatttctgggatgattatattctaacattgtaaagcaattataattagaataacaatatagtagggttttaattcttaccaacttctatacacttatctctcacctcatattgtgtccacataaattaccaaggcagtacagctaggtatacttacagatccagtttacagatgagcatattcaaggttagtagaagttaatgatttcctcaagatcacagatctaaacaataaaaaatcaacatctggacctatatttatctattatcaaacaccaaactctttgcaagatatgaaacttactccaaaacattcactttgacactgtgtatatacatatctgtggaaacttgacatgggttctttatggttaatttctgtagctctacccatggcaaagggcatgagagtagcagttagcaccacagccaactccagagtcacatctaaaagaaaaaaaaaatggagatctagatttgatgcaaaatgctaaacatcacaatgaccaaagataagagcctcatctggatgagcacttgatgctttattttttatgagctttgatttaaaaagttgatagggaaaggacatagccttgatgaggacttgtgaatccctttcctacacatacagaaacacacagtaccatgaaaggcacatgttgacatgacgggttgtaagtctacagatgtcagaccaacaagtattaattaactagtagttatgaattccttgtcctagcacaggactggccctgatctggctctgctaaacctcatcttcaccactcctccaacacaaagttatgaaactccttcacattccacaaacaagctatgttgtttcaaatcttgcatttattttcatagactgcctgcttggtctagaataccctttttctttgttatcttctctcactctctccccgctatacatacacacacacacacacacatgcccagaaatatttttctcaggcatatcaagtgtccctatatattacatttccatagtattaacaatccttgtctcctcaactaggatgcaaagttctctgatggtcatattttatttgaaagtctatattcaatgcgtaaaacattgggcaagtgaaaggatgagagaataaatgattggtttcctgctaagaatgcttatttctaaactaaaattctctcttggctctattgctagagtattacttttaaaatttgttttatgtttatttttgaaacaagtacaactcattactgttttggaaataccaagaagcggttagctattaaaggaaagaacagaagttcagatcacctgattggatgcgggagctgaaaaatgagcccctgcagctatagaagctttcatatttccatgacttcattgctatgatggtcttatttatgtatcacatggccatttgttcctaacagaggaagcctctccatccactgacttcagtatcaagttggagccaattttattaacttgctttatggaattttaatgagtgttgcttatagaatctaaaaaaaatacataatcacattgctataaaaactattttatagcccaaggatcagtataaaaaggagaagtttgggttatactcaatggggctttattaataaattattgaaaagatctctctttttttattgcaagcctacaccattaccctgataacatgattccatgaatcctatgtcatctttttaagctgtggtcaagagcagatttaaatgttaatagtttttttgtgtgttatgcatttgaaaacattattttagaactacagtttctctttgctaaactcaagtttgtctatgaatctggagaaataataatgaataagaaaatatagtccataacctcaagaaactttgaacacttggtagttagaaaaataaacctttagtcatgtcagagtgataaatgctatgataaaggtaaacacggcatgcactttaaggcacaaaatgagcatctcatactggctggggcatcaaagtatgctctttgaggaaaaacaaattcatctaagatttcaactgtcagattttgctagctggagaaatgggaggggggcagttattacttggtagaaggatagaagaaaaaattagagttgtaggtaagcatgagagtcttttatttttaaagctatggagattcattgaatgtttttatacaggtaatgattatagtcagatttttttgctttaaaaaaattactctgtgaaggatagactggaatagaccaagactggtggcaagaaaaccagttaagagatgattacaataactcaagtgacaattagtaagaccttaaataaagaaggatagatatatctgaatctacaaaagttacacagcattggaaaaaaaaataatggccaagtaaatttaagacctaggcatatatgagctagtaaactcacagaaggtacagatttgtattctgcataatgtatagaatacattttacatttgtaaaatgtattctatagctgtttcgattgtttttgacaaatgagagggatagatgctagaaaaggtactcagttctctgaaatgaagttcttctctgggaataccaaacgaccatattctcagtgcagtatatttcatatttgcatgacattgtatagcacatgctgtctctatccatcatcctgatgcatcttctagtctgtaaattatgctggtttttgtcagcagagtgagaactagtcattaaggaatgtgtaattaaacctcaacatcccagttctcattccccctctgacagggggataaaccagggatcattactgctatcaggggctgctcagtggaaagagaaacaaggggaagttgggtgtgctacgctgatgtgctatcattggtaattgatttgctggcgtaaattccatgtctctacatttctaattgcttttgtgcatattcttgggggttgattaatgccatctgttcacaggatcagctgaattgatagagttttaaaggatgacaacagtaatgttgaagatagaaagaaagtgaagggaaatgccaaaacactgcttgtgagttatattatttttaactatccacctttagaagcagaaatatccttctaaaggcaatccaaagcaaatagcagtctaaagaaatgtgccaaacagactgatgttatgtaggtattagtctaggccactatttactgaataggtgggttcagttgtatctctgttttcccctccctcccttcttctcacactttcttcttctcttccccattccttttcttctatcttgtgaccatgtggtttgtgtattaccattgacttttccctgaggagatgattctctttcagatgtacgataaaagggtaagaagtctttgagattccagtgctgccttgctaaacaacatgggcatagtcatcaaaagtgaaacttccagacaagacctgttactgatgcaggccagacatgggcctggtgccacagggaacctgggaaggccccttgattgcaatgctccatccaactctgtccccaaacaacccttctgctaactccattaatctcctgaatctgtaaatatgggtagagttgtgtggggaagggagccttccaattcatatagataagctttaagacacagaaccccactgagtataggaaagcaaatctatactgtacttgacagagaaacagaccttttccagaaaaaaaaaaaagtgtgtgaaagagatagtactgggtatctggaaaagggaggataatgttttgaatctggaaggagaaagaacagggatgttctaggtgtgcaaaacaagtgttgctgctttcctatttttgcccaggctgaaaccctccctcatattacatggccaaaagtacagtagatggccaatggggagatgaaaaaggacagtgagaagggcatatgtcacacagtttgggattgatttaattctcattctgtgaatatgttctgtgtatactaacatgcaccttgcaaagtctgtaagtatgagtggctctgcataaaatacatataatgtggacatccaatcattatacctgttataattattaatgaaactcagcatggattttctcataataactaataatacagtgtagggcaaggacagctacatttccattttcaaacaaagtctggcccacttccccttcatctgggtaatcggatgggtgagtcactgctaagacaaatacaaatttgttctcattttatctcccatgtaaacagacaatgagtagagtctaccttcacctggcagagaaatatcaccgttctggatccctcacttagttcctgggttgggtcatagcataatcactgcttctaggccttggccagtgaaactgctagctgagaaactcacaaaaggagccccataagagtgggggaaacaagcttcatctagagaagtgaggagcacagcccctccaaaaaactgaagagggcaatggagaagatgtcagcattatggcagaaagatccttaaacagaccttaggtaaacccatgatcctgggaaggagtgtgtgtgacaatgttctcagctccctaagaccaccatttgcaggagattcaggcagatggacctagaattggaaagttgagagagccacattaccctcctgtgtactactgaagtctgtttctggtgaataaatggcattaagtattcctattttcctgttgattttgggttaaaaatcaggtactgcatcatgatgagttattaagacatgttatccacaagtcctccctcccctcccctcccctcccctccctcccttccttccttccttcttcagatatttatgaaatgcctagtgcccatccatttatctgtacacttctgaaatatttttgttcatgacaaaacacttgataagaagaaagattagaattgccatccacatagctccagagaaaaccaaaacaaaaggtaactgtaccatctcaaaggaaggtcatagcactgtgactcacccttccatcattcctttactcttgctccatgtatgaagtatctcttattttttaagtcttttccccctgctcctttattttcaatattcttccccaagttgctgatctgctttctttctaatcctcttttcttccttctctttcctctcgtctctcttccccatgttcttctactcctttcctttctatcttcttcctctccatctcttccttctacctcccttccctcactcttcctgttgcaattaacttttactaaatgtcttgtttttatgttttatggcataagttaatgcttttcaaactttccactgaagtgctgctcaccgggaaatagagtgcacgggaacccaggggattctatgagctcagcttcaaatggccactgaagcatgtaatttcttaaattttatcttcaacactcaggcaaatttgcattcagctccatattatatccatgtttatactataataaaatattttccccaaatccccaattaaaattgatgacccaagtttattagcttaacccatagcagagggctgcataatcccaggggcaaaggcttcagttttttggctctttctccacatttatgttttccagtattcctgtgtcacagagtcctacttcgtggtctctctcctcatctcagaacaacaggttgctgcatttcccaggatgaactctttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcctcccaggatgaactcttaatctgtgaaccgcatattatcattaatcaataatggggagtaagaaggacttattaattcacaagggaaaaggaaacccacagactggcttagtgaacagaaactgttcactaagttttggatgagctgtgggttacaagaaaccccagtcccaccccaagtcttcagatactgctcgcccctgttacggtcacctgggactatgctgccacatccatgagttgtacctttgagtgaatgtgctctgtcagttgacagtaatggggtcaaccagggcagatgctttctgataggctgaaaccaccaggatattaaaagattaatgcctctgattctgcaacaatcaggaaccctttgacacaatccaaagaaatgaaaccaagcagattggaatgctggaacactggagattagagataaagttaagtaatgtgcttctttctcggcagggtttcaaacctacactctgtgccaaggttggtacttggtaagattttactctatttgttaccaacagtcctaagagacagttgttcttttccccattctaggctgaggatatactggcttggatggtgtggtaatttacccaagattatatagctataggtggtcacactgggattttaacccacttttccttggctccaaaactcatactttgaaaaattttatctgctgtttcagtgaactcaacacaaagacttagctattgttaaactccagcagataattcgtcctagcaaagacagtctttccctataatccagggtgagaaaaccctcatgtgtctagacccacagattctgccccaatcttcaggccatcttattccagtcttgcagaaggctccttccccatatctagaagtcactatgtcaaccagttcctgtaggttagctgtttataaaagttgcttgtattgctcactaaagcttttcaccaactttttgtggccaggcttcatgctttcactgatggccttgtggattccatgatcactgcccactattagtgtctgttcctgagactcctcctgtcactaagtgcagtatttttatcactacataatatttcacccctaaagaatactgcagccctagaatttgtttcatggattttatctttaaattctgctctcccatgttcattgcagcattatctacaatagtcaagtcatgaaactaacctaagtgttcattagcagattaatggataaaaagtgcacagtataaaaacacaacagaatctagtcaaccttgaaaaagaaggaaattctgtcatttgtgacaacatagattaacctggaggacattatgtcaagtgaaacaagccagtcacagaaagacaaatgctacacaaactcacttatatgtggaatctaaaaaattcaaattcctagaagcaggaggtaggatggttgttgccaggagctgtaggtgtggggagggatgggagatgttggtcaaagggtacaaagtttcacttagaaaggcggaataagttctagagatcttttgtacagcaaggtgactatacttaacaataatgtattatatacttgagaattgctgagagtaagatttaaatatttttaccatttcacactgtatacatatatcaaaacattatgttgtactccacaaatacatacaatttatatagaccaattaaataaacaataaaattttgtactaattagaaaaaccttattcctgacactaagataatagtttcaaacaaggtaattattggatgcattcagatctgttctttgtcttcacgctgcaagattcatccccaaatccagactgtaagctctttttacccaatagggatagacagaaggttaggtttgacaagtgtatacccaattccattatttttcaccactgattatcactgactagtgctcagtgatgggaccctgtccgactggcttcggaggatcccgttggtaggcaaggaccagtgcttgtacatacctgctttcattgtcagctgtatagaaaaccacagtagtaaatgctttgttttattctcaagttctcatgagtttgagaacttaggcctgctgcttggcttggttgtgaggcctgtctttgggtctcctgtatcttctatttcagctattgtcttgactcagaggacctgcttgcttgggtttagagaggcaaaataatttgttcaatgtccagtgccttacagtcttgcctctcttctgcatcaacaacgggagctatcaaaaaaggacacagagtattctgaggcttttcacactgaggcaattaatcaatgtagtgttctagctctcaaaaataattagcctttcaaggaatgaagccttaaatatttaaattttgttttaaaagcagaacttttggtttactaaatgaaatcttacatatgattttaatatgtaaaataaattacaagagcggctttgaagaaaatagaatgaagggcctagaatcctaccatccagcctgcccttcttctgattcttcatgtaggtaccgtgtgaagacttctgccttattcttaattgcaggaatctctaagcctacaatttcacgcaaaagcaactaggtacaagaacatttgaggaagagtggggatggaatcccacctcagtcatggtccatgcctggctggtgcacagcagcagagccacactgggtgtgccccacctgcctctgcttgtattggtccgggagctgatgtccaggctgggaaatacttcaaatatgatctctgccctaagttacactaaataagcagacgctttattctaaaccattgtaaatctgatatatcttgctaccattcatatgagtgtcagggcaagacaatcttattggaatttactgatttgaaaagatggtagcttgtcaaatacttgtgtccttatcttgatatccttagtttgtggttaatagctgtttgtattttaaataactgttttgtgaaagcgcttgcattatctacctgcattccaggcattcccttgggacctcctccaaaaaaggaatctcatgttagctgtgattaaattgcccatatatagcacagtaaatggcaaaataactacttaataaattgaattgaagcacaacaggttaggtgaaacccaagcatagacagaaagcctggatgagggataatacggggcaaacccctgagtgttggcttatagtgcagtgctccctccaccgcttcaagcctctgtctcccaacatctgtgaaataaatggacctttgggctccatcagcgaggctatctcagtgctccctgatgttaagtaatgtgagtagaagtgatgaaagtatacaaattaaataaaattgtcacacacctggattcagtcttcatttctgattctggtcagaatattaattttaaacacatccttgagtgtttacttcgggtgccattcatcacaaaatccttttatttaggtctacactgcgctctctcctccccccagtgaatcccaaatgtccctgctttgtatgggtaataaaatttaatatgagcaataattaaatataggatggtatatttaatggattactcaaaataatttactaatattaaatagtatgcacacatatatatgcatgctcagatttttaatgatttatttttagttttttttcatggttagtgcacctggtggaattgtacatgtgcatatccgctatgtaaaccacttgttctggtaactgtcaagatttattatcccccaaggtcaatattgacttaggtgtcacctttgtgaatatttacctctctagatgatgaattgaaatggtcatttggatggaaattaatatctacttattttctgaaatcaaatgctgttgggaggtgtgcagacatgctccaccgtgtctgcttgtttcagggtggcgttcaataatcattctttgcattctgatttactgtggttatttttatacctctttcacatggttcttttgcctaacagatagactgtgaacttcaaatgtattcggcttgacatttcaataccacaatcaggagatcgtgatatttgatcatatggatagtaagtacacattggattagtgagcaccttggccttggagtttatttagggcaagatactgttacctgaaaaacacaaagctccttcaacaattatctaattatataaagaatacaggaagagacataaaattacacagtagttcctttggttttgaggtattgattcgtcgttttcagataaccttacagtatgccatgtgttttgtaaatataatgtgtttgtacatatatatatgtatgttcatacaaatataatatgttcaattctgtgtgcctgtgtgtgcctgtgtgcctctgtatgcctctgtgtgtgtgtgtgtgtgtgtgtgtgtgtgtgtgtaacagtgcttacttctttactggcagaagacagagacatctttggtagagagcttttaatatatcaaaccacaaattctaaaattgtgagactacaatagaaatatttcctgttgttcttattataactgttgcattaattttgcgtactgggtcacaatatatatactgagaaatgttcaaccttaaaataaggcatttaaatacaagtataatggtgacagttgctgtattttgttgtatatgagtggaattcatctatgcttttctatacaaatattcataggcagtgcattcttggttttgtcctttacaaacaaggagtattagtttgtcatccccacaaatctttcctagccatgaatggtctgagaaaagacctggacttaggcaaacatatcataattaagcacagactgtggcttagtagtcaagggaatcaaccactgtaaaaattcattagtaaagttaatccaaaaaacatctgagcaactgaaacaaaatcaatcctaggggagaatgcataactctattgatgttctcacccttgttgatacattgtttagagtaaagatttctatgtcttctgcataaatatcaatttttgttggcaaattcaatttgacttattgggttcctatagctaagtgttttgtggttcatcaggaaatgatgtcattttgtgtatgaggaaataaaaatacctcacttgatggccaatgaaagtctcattttacacaccatccactgcttttatgtgctgggaaggtttgagtcctagaagaagccaaagacattgggtggtttcttcatgcattatttgcatgtgtataggcacacatcctacacatagcaaacatatacacttactgtcaattagtttagtttgtgcttctttttttaaaaaggaattaacgtggagtcagattagtggttttcaatcagatgtaactttgccccaggggacatatggtagggtctggagacatttttggttgtcacagcttgggggtttctattggcatatagtgaatagagatcagagatattggaaaggaacattctacaacacacattgtattatatgttgtcttttgtctcccacaacagataattatgtagctcaaaatgtgaagataatcaagggttgagagactagtttagatctattagtgatttatgcatcatgatgtgtcaaattacatatatatatatatataatttgagacagagtctcactctgttgcccaggctggagtgcagtggggccatctcacctcactgcaaccaccatctcctgggttcaagtgattcttctgcctcagcctccgaatagctgggattacaggtgtgagacaccatgcccaactaatttctgtattttcagtagagaagggttttcaccatgttggccaggctggtcttacactcctgacattaggtgacccacctgcctcggccccgcaaagtgctgggattaccggcatgagccaccatgcccagccaattaaaaatttttaaaagaggttttcttccagcatttagacttatagagagatatataaaatagaagagaaatatgatgacatatactttcatcctggttctgcttactggctatataaattccttttcattatttcacaccttttcccaaaaaaggtgatgataccctccccaactattttctattgtgaataacatgagataaagaatatttttaagaaggtgtaaccatgattttgctgaaatcatatttattatacttttcattatttggaggagtaatggcctggctgtactgtcctcataggctttagacagacaaggataacatggaggacatgggcacagtgcaaagagggactgagggtacatatcctggacttggggtacgtatcctggactaggaactgcaaaggtaaattttataccagttttaggttttcaaagcatttttaaggttggtttaaatttctacctctgtttaaaaattatctggtcaggacatcttttggcagggtgcatgtgctataatgcaatcactgaagtctgtttatagtaaagcacattctgtcaaattttttctttttgtagaccccctcttgcataagcgtaactctctatcatctatctatctatctatctatctatctatctatctatctatctatcatctatgtttgaaaaatgggataaaaactaaaggtgccgaagttgcctatgctttggaggtgacgtaactacgtgactcaggaaaggccatgaaccaatctatttagatgacactctctaccttatttagagctcaaagatcagttagataataatcctggctttgattgcttatcttctccagtccaatattcaatttttaacatcaattacattagaaatagtctttaatttgtcttttcaatggaaagaagatggatggccttggtctctactggatgtctgccttttgaaaaaggaaagtgataaaatcagaagtaagagactgctgggttgggaaaaggaccttggaagtgatgtagtccagcctaccctgcataatgtatatagatcaccacattccctaaaacattccagatagttgactattctattttacttaacctcctaagtgaagaggtgggacctcacaagacagctcagttcctcaacaaaaattatagttggtaggacattctttcttccactgtacataagtctgcttcaagtaccaccaaaccactctccttagctctactcactggacatctcaaaccaagccttctttgtcttcatcataattattccacaaatacctaacgatagccaccacacttctctcaatcttttcaatctttttatatcttcttttacttaattttttctatgacatgattcctttcccttggacttcccatcatcatgttctcctatttgtagtgtattccattttgccaatgttttctttaaaatatgatgtctggaatagaatgcaatcctgatttgtgcttaccaacctgtgtgggctacaatgtgatggtcataaggaatcctgggtgggagagaagattcagtgaagtttacaacaacataaacctcaaagtctaaaatgaaagtaccaaaaaattgtgttgtggaaaggacattgtctctactttctctcactcactctttcacttacttggccctcaactaatgtaaatcagtctctttacttttttcagggataactggtacaattttgggtttctcccaaattaagtgaactttgaactcacatcttacctttatctgcccagatcttccccatgggccagttcttgtcctctcttctctagtcttaattagtatgactgtcctctaaatccttaatgcttgtacagtatacattacatctttaagccctgtattatatgctgtcttttattggcttccacttctattttcattcagagtacattgaactgcaatcaatgagaagaattacatttaatatagcctctgtctatagcaataggagtactgcttacggtgtgccagatcttatcattgacatacattactactaatctggctcatgaccctatatggttaataccattattcttactttttagatgaataaatttatgtttagagtgtccaagtaactttcttaactttatacaattattaaatagtttgcctgaaatccagccctggtctctgaacccaaagtactgtgtcctttacgctggagaaaagatttcacaacccaggtaggatgtgagctcctagcagtttgtcaatatatcattctaattaattgggggaaattgtattcattttacaaatatttttagaacaccaattctaaaccaggaactggtcttagatattggtaaagaaagacattcaatttctgaatataaaccatggctattttttttcaaactgtggactacagagagtcccacaggtcttgggttccaccttcccacggccacccttatggaggtgatgatttatattggctcttttctgatagttccccagtgtgctttttctcttgcttaaatatttcataaagccatatggttgcttatatctcctcaactgtcatgatggtggatgctgtgaaatgatcttggcatgtttgaggacacatatccttcaggttgaccttatctcagaaactaaacttcttaattgtagctgtaatcccaaccccgccacagacggaagcaatggtagtgaggaaacacacacacacacacacacacacacacacacacacacacacatgaataagtgaggcccatcttcctggaatgtcaatttcatccaaagagtaagaaatacacattatgtgtatatcttaaaaaatacaaatatgttctggagtagaatacaaaatttcaggaaactttcaaataaaacatgagatttcaaatatgtctctggctccaaaatgtgttcacagaaacttgatatcaatgaattcactgttttcccacttcaagatgcctcagggaaaaagcaaacaagcaagcttaataacaaatacccctgattcaatttctgtgggtctaggtaagtcttccacattggccttcatttgaaaataaatgtctttcgccaaactttgattttcttttcttttccttttttttttttttttaaattttgagatggaatctagctctgtcacacaggctggagagcaatggtgcaatctcgttcactgtaaactccacctcccaggttcaagtgattctcctgcctcagcctcccaagtagctgggattacaggtgcccaccaccaggcctggcaaatttttatatttttagtagagatggggactcaccatgttggtcaggctggtcttgaactcctgacctcaaagatccacccgacttggcctcccaaagtgccaccgcaccaggcctggttttctttaagccagagttactagatagtgttacaacacagaatgatgttatagttgtatgtaatgtcttatctcttaacaccctccgattttaaaaatgcactgtgtagacaataataatattaataaccttctttttattctaatgacagtttttagacaatctctattactggctttatgtgttggggaagaaggtagaatgaagtaatattgacagaaaggccattcctccacttcccccttggcaggcctctcacagagagtcttgctatgggtgccacattaggacccttaaaaattcacattctttgtttaagaggtgttgtgaatcccctgaaattgtgcactcatcactgtgtgtatatctgcatatttgcatttttcttggataaaggtatttatatttcacccaatttccaaaacgcatccatgacccagaaaagatgaagaaagaaaggctctgagatcctcattaccctgaacatcctcagggaggggaggaggggacagctttattctagatgctggaaatttaacctaaatgtgcctgagtggtgtgcccttttctagcacctgacggagtgagtgtgagctctggggtgctgaagagagtgggaaagagccccccaaaagggaaaaagtcttctagaagataaaagacaatgacagaaaaggaaaacttcagagatgtcacaatttgccagtggcaaagtaggcacattgcaaacaatctggaattaataggaatgaacatttttaatacaaagaatacagattttgaagaaattactcagagcctttccctttgtcctttcctccacctcccctgagatctgctcacaaaagagagaaaaaaaaaaaaaaaacagagaataacaggttaatatctagaatttgcaaggctctgaatagccacctgacaacagccgcctcctgctgagaaaccactgaagcttaatcattttcctttgcatcagaaagaaggtggctgaagtattcattttttccttgaaatgtcaggtgcccacagcaattaactaatcatgttcctaccaggtcaagttgcaagaaaagaagacgattgggtttttaatgctaaggggacattttagacattttcgtacaagaaaagaagacaattgggtttttaatgccaaggggacattttagacatagggattaaaaaatggtttcataatgacaaaagctccactgacatgcctcaacatcccctgagtgataccatgccttgtacagaggaagtgaagaaaggctgaggctggactgggaaaggagatgtagccttgggcacacatttttttcttgagtgaaaacatggccttgaatggccattaaggtctccaattgtaagaaatttctttgatacagaaatctgagaaattcctagaacagctttgagagagcggcttgttcaaatgatccatcttaagtatcaatcacagcctaagaatcgagtgtttactagataacagcaaaaataagaccaagacaagtgatgaggatggcctaacatttatccaacacttactacagactagaaacaataccgagctatttacatctattagtgccttaatcttcataataaccccacatggtaaaatatgctgaatgtttacaggtaaggaaatagaggcaccgaagggtagtcacatagctggaaagtgaaatgtccactcagggagactgcctctaggacttacagtcttcaagtcagaaggtcagtgtttagatccttattttacagaggagaaagtgaaactgggacaggtgaagtatcttacccaaggcttatcactggtacacagagagcttggacggatctggccaaagccaagttctgtccgacttcacatacattttcccattcaacatcacttcacatgacctgcatattgtgtataatcatattggaattcatccctaggagagatactggattctaacactggtgcctaaacccaatcaagtagtaaggctgcagcccaactgaacctcattaattctgttgctctggaagcactccacgcctcctgcgatgacctccatgttatctaggttttctctgtgtccctggtgcatgaaaaagtgcagtcagtgactcagctgtaaatggttcaaggtacagactccttactcagccctcctctcttttttcagctctatcgttccttgcactccatggtatttattgagtgtctgttgtgtgtagacagtgttcaatagtggtaaagagctagtacctgccttcatgccacttagacccaggatcagggaagcccagagcattgtttctggtgctctcagtgtctttatactgctcctctagcacaagcatgcacatgtgcatacacacactcaggcacatgcacacgcacacacacaggacttctttgcttagctccgtcataaacatttccaagctacactgaaacattcatttctttattttatttagcacgatttctctgtgtctctaacacattctgcctgttttactagtattcttgtcatatgcatatctttaatcttccccaaataaattgctccttgaagctagagacacttgctacccatctatgttgttctgtttaaactggcagcatggtgtcatgggggaatgctttccagaatcaaacagaactggagttaaccagctctactctaggaatgtcagcttgagtaacctcttaactatcctatttcctgtcagtaaaatgtgagttcttttcttcctcgtatattttgagcacattcttgacagttaatactgatatgccatttaatggttgctctttcctttgcgtctccatttagtaagtgtccatgaaagagttttattggtttctcccaagatattacctgataacattttgtttgtttctaatttctgtttagagatttgttaacttggttggagtggtccattggacatttgagggctctctatacactttcttaaattgtttgccaaattgtttttgtgccctgttgcattcatcatactttcaaaggaatacaaattcaaaaatgaaaagattaatgagtatcttttttgttggtaaatatgctttctttttaggcagtcttttattccccctttaacctgattcacctagatggaagtattgacagtgtgcatgctcagacagggagctagtgataaacggggtcatccaaggttatttgagtccccaagaatgctaaccattttggatgtcctcataagtatacagcagaaattggacacagtgtccttgaagaatatcactaaggcaaatatttacacacatttatttttatgagtgttatgcaatacgttaggttacatcaaatgcaagtttgtttttctttctttaatggcaattttctccaatgcttttgatatatcaatgtgcaagggaggatgtctaaaactgggatagtatagtgcttcccccatttgcttagccaaatatctcatctcacgacccaggcttgctgctctgcagaggtcactttgagaaacgctgatttcagggctttttgctttatcactgttaacgtccctatgatctccttcatttggtaccacaacaagactctgagtttttgtccttttattccctttgaatgtctgcggcaacaaggaaatgaggtgggaaactattcattgccatcaggaaggcttcatgttgctctgtgtctctggaggctgcaatacgaatgcctcagaaaggcacaccgcttactcacatcccaagagacatgcagaggtggcagtagttcctgtctaagtcttaaagatgatgttcttgctaggaatgattctggtgttgattttcaacctgaacagtcaaaacttttatgtataacttagacttttcagtatacagaactatattttttaaaccataataaaattatcaggcctactttacttcctattagaggaaaacaaaataataaaaattaccagtttaagggtcaatgcatctgaatttaaacacaggctctatcactcattagccttgttaccttctgagcttcagtttctttactgtaacatgaaggtaatgatacctaccccgatgattaaggagagggctaaagaagctaacaattgcattatacctaaattaatatgttttggcttctataataaaataccatagcctaggtgatttatatacaacagaaatgtattttttacagttgtaaagcctggagaatcctaatcaaactctgagtcaggcagattcaatgtctaatgagggcctgcttgcttcttggtttatagatagaaacttcttactgtaatctcacatggtggagggagcgagaaagctctctggggtttctttcttaagaacactaatcccattcatgagggctctgccctcatgatctaatcacctctcatagtttctacttcctaatagtgtcaccatggggatgaggattttaatatgaattttggggtacacaaatattcaaaccatagcaataccttaagcatactacttaatatctagtagctgttcactcattgatagatattcttaatacaattgttattattaagaataaagaaatgggctgggcatggtggcttatgcctgtaatcccagtaatttgggaggccaaggcaggtggcctcacttgagcccaggagtttgaggtcagccccggcaacgtggcaaaaccccatctctacgaaaatacaaaacattagctgggtgtggtggtacgtgcctgtagtctcagctactcagaaggctaaggtgggaggattgcttgagtccgggaggtggaggttgcagtgagccaagatctcaacagtgcactacagcctgggagacagagcgaggccctgtctcaaaaaataataaaaaaagaataaagaaataactagattttgttagcaagatcttagaaagagaaaggaaggtcgggataaggggcatatctactccacttctgcactttccggggtgctccagatttcaaaattccctcatgcctgccatcctgttgactctgcccctgcctctgtgtgctgcagtccctccttacatggtacctttgacacactggcaggtgagctgagcagtttgggcacctggttcctctaggatcccagaatatagctttgtactttgatgaagaatacttctgactgtatttcaattgatctgaaatatcagtctcacacactgtttgcagctgggattgcactttgcatactctgctcagggcactggcaagtcctgaaacaaaatttatagtagggaccagcccagagacatcctttcttcaaagtgtgttagtcctgaatgaaataggcaccaggataacatctagagtgcttaatctcggatgtgtagagaattttcctggactgtagcatgttaaatgtccacagttaaaacctgaaacagaagtatattcaatcattcggttaatctaatattacagatggctgaggtgggataggatcagagataatgacatgtgacaaagtgtttcttggtgatcttccagcctatttgaacatctgcaatagtttgaggccttaaaaataaataaacttagttttctttccatctctttcctcaaaaaaaaaatacacacaaacagttctcagagataaaaagaaaatgtctcatcagttcaacaggtggtctaaggtttgcttgtttttagataatgatctgatgcaggctccactctaattgacagcatggcctgcttatgagaaggtctgcacttgtttttcccagagtatttgatgctgctgtttacctctaaggaagcatgttaataacaagggcactctagggtgttgccaatcatgcaccacatactggaaatcaatgttgtgtctagtgctgtgctaggaattatagacattaaaaatggcatatgacaggaatcctgatgttaatacaatgtccatctcttcgtgatgccaagcctaatttcagcactaaattatacgctttgtagcagagaagcaggaagtattaagaagagcattgatggtggtggtggtgggggcttacatagatttgaagttgattccaacccagataacctgcacacattctcctagccccagtttgttcacttgcaaaatggctatagtggtgtccatctcacagagctttggtgaatgtcaagtgagacatacagtttacctgcttgacacagcgtagtcactcaaaactgctagggtgattttgcttgatttccttctgctacagcattccttttgccacatgaagtagaacaaggtgtctcaaactatctgtgataaaggaccaacccctcccaaatctctctttctggctccatccagcacagactaatatttttgtaaaacacaaaaagatgaactactagaaaagtagaataaagaaaataacaaagtcaaagaaaatacaagccaactttttactactagattccacatagatgaaatgatgcatctggattgtgacaggtttctaagtgcttatcctcacattctgtacctattttatcctggagtggtgacaaaagtccctgggcccacactggtctgcagataacatctggagtagcatgaactggaagacagtgatatgatccttaaatttcatcagattaagattagaaatcacctagttactttattgaaagtctttacttcaagctagtattgactgaaagaccaaccttcatctgcaaatgatagtaaaaactctgacccaggggagtagtcatacaaacagacatcaaggacaggagcgaggaaatgctcagatgtgagttaacaggacacagcaccagagttgaaggaatgagaggcagcctggatgtttacgttattccctctcaaccaagggtcccaggatttaaagcagagaggaagggtaaattaatgcaagcatttgcagtgcagaactttcagtgtttgatagatttccattccaaagttcccattcaacaattattactaacccttttgctttcttgagggggtggagataattggacttgtgttctgagctttcagctcctacctcttactgcatcttccccctgagttcagaatgatctatataaaatggatacctgtgcgcgtctctcctctcatgcagcaaataagaacctaagtagcctggttttggctgacctctctgaactcagccctcctttgcagctctgaaattaggtctgcattttgtattccaattattctgaactcttggcagttccctgcccacatgtcatttttccatatctttgtgccctcctttgctaatgccattttctctgcttagcccagtatcaacccctccttgcctggctgacttctatttatccttcaagacatggttcagaaagtcgtccagaaagtcttccctggccctccctcccccgtccctgctctgtgggcccataccttcctctgcgtaccttgatcactgaaccagccacattattcggaaaccatctgtttgtcctcatttattattcatcagcaaatgcccaataaatgtttgagaactgtctataactgaggtagatgtcctggctgcgttgagaggcactcaagaacaaactgttaaggacaagcagaaaactaaatttattgtgcaaatttggctgaggtgaagcagaaccaaaaatcatcagattcagccactagaaaagtgagaaattcataaacaaggtaatctctgtattcacctctttctatttatttgttctgcttcctttttctgatagaaactaaatacttgtacatacattttaagtgcagccatttgagcaccagcccagagagcatcaaccacgaggacaaaggtttctgtcttgagacaggtaaagaacatgagagacatgaggccccatctgggggcagaatacctggcttaaattggagttttggccttgctatggataaactcaatgaacatttgacctttctgagtctctgagtctctatttcttcagctgagaaaaccatggcaataacgtatgtcacaggattactttgagagttaaatggcatggtttacataaacacctagtacagtgtcaggtacaatacatggtagctattatgatcagaggtagctatttatgttctgtttgaaagcttgctcagtgttactctgctatgcaatttctcacatcctaatgttgcattactaggagatttggggcaatataatccagaaggcccatgaaagcatatctctactcaatgtaaaaccagccctagaaattataacaagcatctgatcttaggaaatgtttcttagcctgccgcttttaaagatgctggaaaattctagtttctccaagttgtggcaggccttggaacccatgctgaggaattggaatgaaacaaagtgaagagaaagaaagatgtcaacatgatttactggaacaaagtggcatcgtattggcactcaatcaagagcatgtagattagacaaggatcgacttatcacagttacagatcctgaaacaatttgacttgaagaacaccaagaagcaaacagaggccaaaaaatccctcaattcaagcataaaagagacatgtgttctttgccctcttctgagaaactatgtgcacttggctttttgtctggatgtttgggttggttgtctttttaaactgtatatttgggtgaggggagatatgggcatttgggcagtgggaaaatgcttatggcttttaaaggaatatgatggaaaaaatagcagtgttaaaaatgtattttttaaaaattagagctgatgcactcggatccctaggctcctagggtcctataccctcactctcgacaagggtggacctaagtcatacttcaaaagaagcaggagcctcagggacttgtctactgagagcagctgtcaatgtcaccactccacttccagcagcctggttgaaagttgcccgaggcaagacctgcagaaaaaggagtcaaaaagcatgaggagagagggaagtaaaaaagaaattaagttctgtgggatgttattgctgttcaaatcccaagtttactatagcagatctcagccccgtggatcttggtaacccatgattactcttttcataattccaaaagatatggaaactatataactcacagcactcaagccccttcctgctgttcgttagtaaaattgcctaccctcacctgctctgggtgaaagaaatacttgccttttctatttcccttcctgcaacagccctagaacttttttgattttcaaaaattattccagctagcagggcaaaaagagaagctctctctactgtacacagaggagctctggttgggaagttcatattgatgtacttccatgaattgtgtccctaacagagttttgaactggagccaaatgggtgggagtctgggctctcacccctctgcttcctatctgagtttccttagccaaaatgggcataatacccatcttgcagagtgtgttgaagattacacatactgtatgtaaatatatctgcaacacagacaagaagccaaccaaatgtttcctttttcctgacatcatgagatacagctggatgtgaacatctgtaagcctaagaaaggatgcttgtgaagccaatggtgacattttacttttaaaactgttatcaagagataaagtccaacttcttcatctggtgtggagttctttccagaaactaagactcatttaactctactttccaacattccctggaaggatccctgtcctcctcctcatctcctccaaccccttccgctgctaagttacagcatgtggggaatgcttttttatgttctctggttactccttcttcttggatagctttcttccccttctctgccagcctatatcctgttcaactttcacagttcaccccaagcctcacatctttcatgaatactccccagaatgttctcgtccagtgactccttaccagtgggatatgatcacaggggctgtcaacagtggctgtcagttgctgagagttacctgaccatggaaactgagagaatcccaagtctttgtccccatcctgacctggacctcataagttgcccagccaggtttctatgaccttgaccacctacaatccaatatcctctgagggattactccaactttcatttcctcgtgtttaagcccttctttttagcaccagactccattattttcagactccatatttttcctaagtcatcaagaagacagaagccatttgcctggcaggaccttcgtcatcttccccccatttaacaacatacttatttctatcctcaattccctctcccgcaccatccatgtccactgccatggctctgattttgactccctctgtgactgtaaaagtaaaacacctatgcctctttcccttgcaccttcatctccctctctgctggctctttcccatttgaattaaagcatacttctttcccttctcaatttcacatcccttcatctcatgttacatttcttttgctttcagagacaaggttttagaaaaaatcatttacatgcagtgctgttattctacctctcttatatactcttccacttattggatacaagttcgctgattatttcatccactcaagtttctagaaaggcttccaaattagagagaagctggtcggaaattgaccatctcctctcactagccatgtgaacttgggcaattacaaaaatctcttttctgtctcagcatcttctatacaactggagtgatggccaggcacggtggctcacgcctgtaatcccagcactttgggaggccgaggcgagcagatcacgaggtcaggagatccagaacatcctgcctaacacggtgaaaccccgtctatactaaaaatacaaaaaaaaagaaaaaaagaaaggaaaaattagccggctgtggtggtgggctcctgtaatcccagctactcaggcggctgaggcaggagaatggtgtgaacatgggaggcggagcttgcaatgagccgagatcatgccactgcactccagcctgggtgacagagcgagactccatctcaaaaacaacaagaacaacaacaacaacaacaaaaactggagtgactactcctgccatgtggtcatgatgagaatgcaaagtgataacatacatggagcagaatgtggaggtcactggacacatcgagtcattgtgaatcagtcatctcagcagtattttatcctatgggccagtccacttttcttggaattcacttttgcttttgccttcagtgattcatctctatcgtagttttcttcctctgcttttctggttacccattctcagcattttctccaagttactgttttctatcaaaagctatgttctccaaaattcagttgttgtttgtttcctttattttttaatgttttttacttacctaggctgtgaaattagctagcattaattgattgataattactcaatggccatgtccaatactaatctcatgagccccattaaaccaaccgacatcacaattgggaaggacccaggtatggaatgcccgttttgggctcagttctttacccaattaagcccattcattttcctgtgcaccctcactgtgtaacaccaccattttctggtagttatacctttatacctgactctttctttctccttgtcccctacatcgaataaattaacaagtccatttttttttttttttttgaggtggagtcttactctgtcacccaggctggagtgcagtggcgtgatctcggctcactgcaaactctgcctccccggttcacaccattctcctgcctcaccctcccgagtagctgggactgcaggcacccaccagcacggccagctaatttttttttttttttttttttttagtagagatggggtttcaccgtgttagccaggatggtctggatctcctgacctcgtgatccgcccgccttggactcccaaagtgctgggattacaggcatgagccaccgctcctggccaacaagtccattcttaattcatagatatattacttcttacccaggttgtggaaatagcctagtgaggagccactgtgcctccttttttgagctgcaatccaatctacaaattactttaccagaatgaatcttttaatggataaacaagaaggatggtaacagaggctgggaaggtaatgagagggcagtgtgtggagaggtagaaaatggggatgattaatgggtacaaaaagtagttaattgtttgtaatacaaaggagaaatgcttgagggggcggataccccattaccccattcaccctgctgggatcattatgcactatatgcttgtatcaaagtatctcatataacccgtaaatatatacacctactatgtaaccacaaaaattagatttaaattatttttttaaaaattaaaaaataagttaataagcatagctaactctccaagttgaaattattttagtagttcctggtcagcagtgtcttttgggattgtgatcctgaaactacatggaagtgaatgacctacagggattgttaaatatgcaaattcctagacatcaacacagatcccctaagtaagaatttcctggttggatcatgcttaagcacactaaaatttgggaacgtgtaacaatagaataaagacaaaattttatggaatgttatataaggttttgcataatccagcttttgactgtctctccagcccccttgaaaaccatcctgtcatatgattctcatgcctgttgcagggtctggtccatcatgccatcatgcctttgcctagtatcaaagtccttccactcccgattcacctatcacacttgtttatccttctaagaatagcccacatcaatcatctctcccttagtaagagtttgctgagattcctaatttgcacccctctgatcttagataagtccattttccatgctttcaaaaattcaagtgtatcaatccctctcctccctgtactatccccaagtctagtataccattgtatatatctcactgcatttaaatgtttggtaatttgcctgtcgttgtcatcagcctaaaagcttcctaacacttgaaaaaaatgcatggcacatattaggtgctcaaattttatttgttaattgaagaactctctctttaaatcatgatgtctaccagttgtcttctaccactcttatgagccaaattttgtccatcaatgaccttctgaaaatccagtccttgcatgggaggtttttatccccatgttgagtcctgctacatctgagcaagtgctttttcaagttgcttcctgctgatccaatctgccagggatatttaattggccatgtgcctattcccctggtactctttaaagtaagctattgtatcaccaactctggtgatggaattattttttatctcacagggtattttttttaagttacagaagtaaacttattatcaacaatataattaacagcaatgttattggaatttcttccactaatattttattgttacttcttcatattttaagtcctagacgtaaaatgtgttttcaacagcactaacgcattttaaagtttattgtatttattattttctcttacttaggtagtaaaagttatccttaacagtattattaaaatttccaaaaactaatggcctcactagatttgtttgtattttaaagtcgtaactataaaatgaattcaccatttattgaattggcaaagatatcacatttctgtgaacatcgaataaagtaaataaggtctccctctaatcacataaatgtctacaaaaaagctgtgtttttgctttttctgcccaaaggaaaactaaatgctgaatgggctcagcatttcaagtcaaactgagccagccagtttgtgtcctcttctgtaatctactacctgtgtggttgtgatgcacaggatgtcattcctgaccctcagattttcctgtcaaaataacctgtagcagcctttgtcatacacggcacatattaggcactcaataactgcattttcttttttttttaaattgattttctagcatggtagctagtatacttgtttttcatagggctgttaagaaggagttggggacactcctgccatttccctggcatgttgctgtcagccttgattgtcttctgtttggcatcagcgtagagtttttcaatatctgtgtggctctggtcttctgaacaagatggcgagttcctcaagggcaagagcctgtgaattccaagcacagagtgtatgctcagtatataaaaatgtctcatggattctagttttagaattgccaacatgatattatgaaaggaaagcaatgttatgctggaaagaataatttttcttctcacaaacatggttttcttaaaatgatgaggtgaaaaatgaaaatacttcaaatattttccaactgtaatagtcgatgatttgtaagatgttttctctagttggctggtgtccataacctctaaggcttgacacttatgagaagtttaagaaattctattttagtgtgttcagggtggcccctttacctttccaagacttgctactttggaatcgatgactccacagagcgtaaagtggaattaaagctgagagatgcctatacccacttgtatcagaaatccgtccactatgaagatatctgtcatgattaataaggctaggcagttctcaataaagaaagcatgagtgagtttgttttactgcacaggcttgccctgatcatattaatttgaaaaacagctggaggtggcaacttaccaggtaaaaacagattgggggaccgataaaattattcagatgctcatgggcagctcctctgtaattcacaggaaagcctacacttacgtctgagaagcagcattacggaaaagtcccagcagaatttgcaaactcaggtagtcaacagtttgaactacaagtattctatttgtgggtatacccgtatgggcctttatggacctccttaggtggagaagggcctgccagtgggtatacaaagagcaagaaatctgacattgggcaggctttagtttggaccacatgggaatacttctaagcgtctttgcattattagcagaacaagcatttcttacagaagacaaaatccatacctggagattcagaaatacacttaagataaaatggggctttctagtcaagctctcttaagtctcccaggatgtctgtcagtctctcagagctgtgatttctgaagactttgacctcattcaaattaggtgaacaaccaagttaaacttgtcatggtgtttttttgactggaaattttatgacagaaaaaacatgcagatacagttgacccaacagtggatggactcagccaatgtcatttaagtctgtctttctgagtagaccctgtgaaaggtctggggctgccagtgccatttactgcatcaaccaagatctgagcacattccccttccgttttttttctggaaatcaagtgccgtctccattagaaatgcatgttcctgaaggccagggaagcctagagcgaagccatgtcagccataacacatcatgagatcctccctgtgccccattaaacaaagcctcggtatttgccttgttactgcatttcacctttcagtgtggaagagggttctctaaagcagcgaagcttaactattgtctttaatctatcacttgatctaccttttctttttttcttttttgcctacataaatcattcaaaatttgtttttgtgtttaaccaaagtttcagtaatcctctaaatttatattagatgtctgactagtggtattcatcatttcactttttctaatagaagctactctgaccttaaatctatgagaaaaggaaaatgtgaaggacatggactttggaaaagcttgttagtctctgtaccgacaggtcatgtcactggccactttcctaaaagaaagaagaccatggggaggacattctagtaggtgcttttcttttccagctgataatacaaaaaaaagtggaatacatttcatgactgtaagagtttgtaattaggttgtatatctaagacacacacacacatcattgacaaataagaaaaaaatagcacagttaaaaaattagttcaaggctacctaactaaataataacagaattgggtttaatacttaatctctgaattcagccttcccagttggcccaaatttaagtcaatatctcctcttctcaacctgctatttcttttcctgagttttatcttaaggattagcactattgtcctggatggagggaatgcaataattcaaagccatcctttgccctccctcttcatgatcctactatccaatgagcaggaatctggctgattttacctccgcaatgccatccacatccatgccttcttctacacgctgctggatattccagggatttttcatctcttacttgggctgtttccacagcctccgagaggtcttgttatcttcagggctacctatcaactaaatccagccaccacatggccaatacttgcttttattacagaattaattctgtttttgtttgtttagcacctctaattttgtccattatttgctatagtttatatcacaaaacctttgtcctacatgcaaaactcttcatgatttggcttatatgaactgctcctattattataaccatcctttccatatattccttgctacctctctcctccctcacaatctactcctctgcatctttattgtaccattttctttggctcagaatgctcttctttaattctgcttaactcaatcctgttattatacttcctacaattgtactcagttgttttctccttgaggaagttgcctctgaccccagcatgggctataccactgtgattccttagatttgcatatgcaatgtgtggaactgttttgccttctatgttactctctgttaaaccattacctcactgaaagctgagaccccattttaatctccctcccctactctagtacctattacgggctccagagcatagtagatgctcaataaatgctttatatacacagtgaaagaactcttatgacaggtgtcataagaagtttaaggatagagtggtgcctgtggatttagaaccagtggtaagaaagctctaagttgtctgtgtggggaaatcctatcagtcgaggccgtgaagcaggacacacaaagttagggtccctttctccttgggagtttttttggtgtggtttgtttgtttgtttaacaggaaagaaagacacaaagggtccttttggcattttttcatggaggacacagcagtcatatttatctctgcatcggtagtagagtctgggagagtatatcacattcattcattagagaatgtatctaactgaagactagaaaatcttctaatattagtgataaaagatgtgagttattattggatttgttgttttgttatgtttttgtttcttttcctgtccttactgattctctcaaattggttatgttgttccagcaaaaagatcaagggaatattgggggcagtaaaatctgttttgttttttaattccccaccgaaacggaaaaactaatacagccaaataatgagctcataaatactaatttatgagcaggtaacaatcatgacacctaacaaaaagtcattcaacactgaacttgaagttagaaaatcatgttttaatttccatctctgtccatctagttatgtcatcttaagctaatttgtacatagttctacgtgccactttcctctttcatgaaataggaacgttgatgtagatatcttttaattctatgacttcaaatcctacaactctgatttaaatgatttcaaaaacatttattgaaaccttctcatgcttaggaatgccagccataaaataagaaggtctggttcttgttcttactgagttataatttagaaggagaagtttaaggtataaggagcattaaatgacaattatggaagtacttaaactctgtttaacatccaggacgcaacacgtatttcttacattcagcaaatataatacttctcaagtccttctatatgtctggcactaaaataagtgcccagaatgaaaagaaaaagagaccaaagcctctgcccaaatcctgtaaggcaaaccatttccaggcctgataatgaacgtggagatggagtaagattcacaagacagaaatgatgtcatcaaagtagtggaataaaggtgggcacaggacattccacattagatgattactttaaggcagcatagtatgtccattcttggtgctagatatttgtcagcttatgcccatttaaccaatgagatgaaaagcaaaatctgctatactttctgagaaagagaagtcaggcactttctattgctgaaaatcctaagaaaacatattgctcccgttgctgcagacaactatgttatgaacacacagacagccagacttaggatgaagccgttgtttgtaaaaagaggagaagtatggagagaaactcaatctctgatgacacaatgcagtagctaaattagcgacttcgaaggcctattcttcctttagattcctgatatctgagatcaaatccccctgtattaagtgcatctgaatcaggatttctaccacttagagtagaaagaatataactgatactggaaattggcctgttacatgctttaaaggcttagaataaagagcactatctgatggaggtcactcgctatagggttcccatagtttgtttttcaggcatggtgagaaaggttcagacaaggatccattgccttttttcccctcattagccatgtctaatcaatccccaatcctgtcaattccatgacctttatacatcttacctgcttctctccatttctattaacaccaacacagtccaaaccagggtctttgcatacctggatcactattgtggatttctaactggtctcctgcatccatcaattttcactcctctattttattctctatcatgcgaatcttataatttcttgacttacagagcatctttaatggtagctcattgctttttgataaagtcaaaacttcataaaatgtcttatgactgtatcaataatgtctacctctcccatgtcattattcagtgttccaccaccctcccgtgactaccactgggcttcagctattctgaatctccttcaaatcttgctaatgcatgtgtgttctcccatggggtaaagcatgtggttttcccaccaccgggaatgccattttctcatgtcagtctgattcctatcatctttcaggtttcatatacaatgttacttcatgtggaaagtgggttttgaccctagtgtagattgctcctttctgctaaaggctcccgtgacccctctgtacttacattatctcactctagtataattatttgttggattaattctttttatttttgtaggtcctcgtttgtgttgttcactgttgtaatcccccagtacctctctatagtggatacgccacatatattgaagagctgaatggtttgagtacatggagaattatgcagactaccttttaaaaagcagccagggaaggggaaagtacagacactgaggataaataaaagcagttagaattcaggcagaaaaacagcagttactgaatgttctgttttagagttgaacaaataaatggccagagattgaagtagacagttaagaagctgataaacaagataaacattaaaaaatatatacacataacactggtatcatacctgattcagaccttgagccattcagctaattctgactgattccaattggtctggccagttttctgtgtgatgcaaaggtaatttatttaatgtattctgtgggtataaaaaaccccccagcagctctgcccaccactaaagatgagctacagtatcagtagagacatgaatgagtcacacagggtcagatgccagctctaccaagttcaagcatcttaacttgaaactgataataattcgttaaacagttgtacaaatccagactctgtatgcagagcagcagctataatgtccccaaaactgaaacttatcattataataacacaaaggatccaaatttagaaccctggaagaatggctgtaccaaccaacagaaataggaattcaagtgctgagcaatgtagccacctcctctcatggttggtgttctcagtttaacacggttgagctacaatccacaaactggatgactcaaaatcaaaagtaaaaaatccaatttagttcacagtattgatactaatgttagtctccgtctggaggtttatcagcttaaagtccatctgctttataaagctaaaaaaggacgatgtattcacagtctggttttggtttcaaatggagaaatatattctgaagctattaacagtgagtggatatgctctcgaggtagagtatcagagcagccagcacaacaatccaaggaacttcccactgcagtctgcctgagtgcttaggttcaggaaatctccacttagctgacactgggtattggttcagcaacatctctaactgggtgtggggtaagaaagtagggttaatgggtagggtgccacctgagagagacagtttttttctttccccacatcttgaaaagcattatggatactcacactaaaactctggactgtttctgtttaatccaaatgatttcagtttagtcttgatcagaacaaaagccagattactttttgaaaaagatcatattttcttaaatctaatgtagacttcatttcacattgtacatttggagattaggatatacgtagttaatctagtgatgagttttttcccctctgaaactgtttttaaattagtaatatcccattagatcaatggcatctgagcattggataaatatggcatacattcttctatgtggcaaagtttcctgtcctgcaggagaagatatctattattgtgcttgggaccttcgatgtgaagaccccacctggtcagacacttgatttctccttggtgttacttttacatcctgaaagtgcttctaactggcactgaatccagacaatttttaacaaaaaaaaaatagtttatcttattatttaaaaaaatcaggacactggaaaacacttaagaaaacagagattaaatagacatcataaacccactacctatggaaaactatgaagaatgccccaatcatatgcttcctgatcatttttgtgcactgtaaaaattatttaatggtactgtccttttaatatatctatacatgtcaacatagctccatgtcagtatgtttgtttacaaccttgttttaaatggccaaatggtatcctactacacaaatatgctgctgtttgtaatcaagtgcaggaatttgaagaattcaagactacattgtactcttcaagaccacattgcaactctatttacctctttgtttagactacaagtacctagaagacaggagccttgttccattcaaactgtcttctagatgctttgcacttgatatatattcaataaatgtggatttggattaatcccacaaacaaaaagatacttgggtgaacacacaaaatctggaagtatagtctattggtttcctgtggcttcagcataacaaactgccaccaacttcatggctcaaagcagcagaaatttattctctcatagttctggagagtcagaagtctggaatcagtaccatgggtcagaatcagggtgttggcaagaacatgcttcttctggaggctctagaggacaatctgtttcttgccccttctggctctggaagctgccagcattccttgatctgtggctgcatcaccccaatccctgcctctatggctacattgccacctcctcttctgtttaaaatctccctctgcctctatcctataagataagtgtaattgcctttagatccccacagataaccctggataatcttcccatctcaatatcttgcaatcgcatctgcaaaggtccattttgccataggggataaatttacaggttcaagaaattagagcatgagtaactttttttttgaaggttgggggacatggcattttctgccaataagtaagatacataatttcaactatactttttaatcgttgtgttttcagaaaaagtgttaaggcttgagaaaagtgggaatggagaacacactgttcaattatctttttcttgagaaagctttggtgtttgccgaagttagaacttgtattttccatagttagactatactttcctatcatttaaaagcctaagtgacttgatattactcaattctattaattgaaataacagtattacatttacttttaactataaataaaattagtgcatatagcctggatatatacagtcatattggagaaggaggaataaacaataaaaccaaagaaaaagggagtacacaagtggagcaaggaggcagaatagaaagctctaccaattgtcctcccaccctccccaccctcttcaagaacgcttttaactatctgcatacacaaacgcacatttacaagaaccaaacatcaggcgagaatcacactacctatatctttcttcatatggttggaagaggcattgaagagactaggagagtcagtcttgaatcattggcactacccctttctaccccctggcagtggctgtgtggcaccaagagagaatctgtatacctcagggagacagagcgcagcaactggtggactttgcattgaactcagtgctgccttgtcatagcaaagagcaaagccatcttcgactcagccagcactcatccagggcccacagaaggagcatttggaccaggcctagccagaggagaattactcagccctgaggctgcaacttgagtttcttagaagcctcacctttgtggactgaaatgctctatggtcctaggtgaatctgaaaggcaaactaggacacaggaatggcatttcttaggcacgtcctgatgctgtgctggtcttagagccaatggactggggtggtgcatgacctagtgaaacaccagacatgactgctaagagagtgcttgcaccacccctccttcaacaccaggtagcacaactcacggcagtgaaagtgactccttccttctgcttgaggagaagagagagaaaagtaaggagtactttgtcttacattttgaataacagcccagccacagtaggatacaacaccaggcagagttctgaggcccctatcccaggccctagctcccagacaacatttctagatataccgtaggccagaaaggaacgatctggtcctggagggattcatcacctgctgattaaagaactcttgggccctgaattatcaacagtgatacccaggtagtataccatgggccttgggagaaattctgagacatactcacttcaagtaccagcttggctacagtgtagtagagcaccaagtgggatcttggggtacccaagtccaggcctaggctcttggataacattactggacctgtcttgagccagaggggagcccattgccatgaagggtgagtcccaggcctgtcagcattcacaagggccttaagtgaagagcccttgaaccctgagtgaacattagcagtggcctagcagaactccctgtgggccagtggttatggtggccacgatgagactcctctgactgtggaagggggaaggaagagcaggaaggactttgtcctgtggtttgagtgtcagcttagctgcagtagaatagaataccaggtatatttcaaaggattttaacttgaatacgtggctccaagtcagcatctctggccctgcttagggtctgggggaacttgccaccctgaatggaaaggcacaaacctggctgacttcactatctgctgattgtagatccctagggacttgaataaacataggtggtagccaggtagtgattacagcaggactcaagtgagacccagtgctgtgctggcttcaggtctgaaccaggataatttcagtggtggtggccataggagtgcatgcatcaccctacccctagctccaggcagctcatcacagagggacatgctatttgtttaggagaaagtaaggaagagaacaagatcctgtgcctgataatccagagaattctttcagatcttatccaagatcaccaagctgtgggatttcttcaacaccagaactgttctacaagaaatgctaaagggagttcctcaatctgaaagaaaaggatgttaatgagtgataagaaattatttgaggtacaaaactaactgggaatagtaagcgcacagagaaacacagaatattataacagtgtaattgtcgtatataaactattcttaagtagaacgactaaagtatgaaccaatcaaaaatactaatggcaacaacattttaaaacatatatagtgccataagatataaagagaaacaataaaaagttaaaaagtgggtgggtaaagttaaaatgctcagtttttattagttttctttttgtttacgcaattagtgttaagttgtcatctctttaaaatcatggattacaagatagtatttgtaagtctcatgataatcttaaatcaaaaacatacaacaaatacataaaatataaaaagcaagaaattataccatcagaaaaatatcactttcatttaaaggaagataagaaggaaagaaagaagcaaaaccacaaaaccaccagaaaacagataacaaaatggtaggagtaagtcctcacttatcaataataacattgaatgtgaatggactaaactctccaataaagagaaacagagtggctgaatggggaaaaaaaaaaaaaaaaaaaaaaagcaagacccaagtgatctgttgcctttaagaaacacacctcacatataaagatacagactgaaaatgaaggaatgaaaaatagatattctatgctaatggaaaccaataaaaagagcaggagtagctatactggcatcagacagaagagatttcaataaaaaactgaaaatagagacaaagaagggcattatataatgataacaaagtaaatacaggaaaagaatgatgattgtaaatatatattcacccacccaacactagagcattcagatatataaagcaaatattattaacactaaagagaaagatagacttcaatacaataagagatggggaattcagtactccattttcaggattagacagaacttccagatagaaaatcaagaaagaaacatcagatttaatctgcactgtacagcaaatggatctaagaaatattacagagcatttcatccaatacctccagaaaatacattcttctcctcagcacacagattattctcaaggatagaccatatagtagacctcaatacaagtcttaagatattcaaaaaatggaaataatatcgagcatattttctgatggactaaaagcagaaagcaataacaagaggaattttgaaaactatacaaacacatggaagtaaaacaatatactcctgaattaccagagggtcaatgaagaaaataagaaggcaattgaaaatttttttgaagcaaatgataatgaatacacagcatatcaaaacctatggaatacagtgaaaccatattatttcttcatactgaagagggaagtttatagctataagtgcataaataaaaaaaataagggaagcttcaaataaacaacctaacaatgcatgttagagaactagaaaagcagaaacaaaccaaacccaaaattagtaaaataaataataaagattggggcacaaataaataaaattaaaatgaaaacaatgcaaaaaattaacaaaatgaaaagtttgttttttgaaaagataaacaacattggcaaacatttagccagactgactaagaaaaaaagagagaagacccagataaataaaattggagatgaaaaataagaaattccaactgatactgcagaaactcaaaaaatcattagtggctactatgagcattatgagtgactatacatcaataaattgtaaaatctagaagaaatggataaattcctagacatacacagcctgccaagattgaaccatgaaggaatccaaaatctgaaaatctgaacagaccaataacaagtaatgagatagaagccataataaaaagtctcccagtaaagaaaatcctgagacccaatagcctcactgctgaattctaccaaacatttgaagaagaactgataccaaatcctactcaaactatttcaaaaaaatagaggaaaagagaatactttcaaattaattctaagaggccaatttatgaggcttctcttaccctgataccaaacccagacaaagacacatcaaaaaagaaaactacaggccaatattcaagatgaatattgatgcaaaaactctcaacaaaatactagcaaaccgaattccacaacagattaaaaagattatttgttatgaataagtgggatttatccccatgatgcaagcatggttcaacatatgaaaatcaatcagtgtgatacatcttatcagcagaatgaaagacatattatcatttcaactgatgctgaaaaagcattagataaaattcaacactgattcatgataaaattcctcaggaactgggaatagaaagaacatacctcaacataataaatgccatgtatgacagacccacagctggtattatactgaataatggaaaaaaaaatggaagcctttcctctaagatgtgggaaaaaaatacaaggatacccacttttaccactgttattgaatatggtactggtagtcctagctagaacaatcaaacaagggaaagaaatagaacattcaaattataaagaaagaaatcaaagtactttgtttgcagacaatatgatcttatatccagaaaaacaaggatttcaccaagaaaattattagaactgataaacaaattcagtaaaattgcagcgtgcaaaatcaacatacaaaaatcagtagcatttctatatgccagcacggaacaatctgaaaaagaaataaaataatctcatttataatagcaacaaataaaattgaatatctaggaatcaaccagaaaatgaaaaatctctacaatgaatattacaaaatattgatgaaaaaaagaggacaccaaaaagtggatagtccatattcatgcatcaggtgaatcaatattattaaaatgtccacattacccaaaacaatctacagattcaatgcaatccttatcaaaataccaatgacatccttcacagaaatagaaaaaagaattctaaaacttacatataattacaaaagacccagaatagccaaagctatctcagcaaaaagaacaaaactggaggaatcacattacaggacttcaaataatactacagaactatagtaaccaaaaccagcatggtactggaataaaagcagacacatagaccaatggaacagaatagagaacccagaaatgaattcatacatctatagtgaactcattttttacaaagttgccaaggacatacattggagaaaagccagtctcttcaataaatggtgctgggaaaactggacatccacatgcagaaaagtgaaactagatctctatccctcaccatacgcaaaaaatccaatcaaaatgaattaaagccttaacttaaagacctcatactatgaaactcctacaagaaaacattggagaaactccccaggatattggtctgggcaaagatttctatagtaatacttcacaaacacagggaaccaaagcaaaaatgaacaaatggtatcatatcatgtttaaaagcttctacacagcaaatgaaacaattaacaaagtgaagagacaaccctcaaagtgtgacaacatatttgcaaactacccatctgacaagggattaataaccagtacatataaggagctcaaacaatcccataggaaagattgactgagatctgaatagacttttctcagataagacataaaaatagcaaacaggcatatgaaaaggtgctcagcataactgatcatcagataaatgcaaaggaaaactacaaggaagtatcatctcaccccagttaaaattgcttttatccaaatgtcaggcaataaccaatgctggcaaggatgtggagaaaagggaacgcttatatacgattcatggaaatgttaattagtacaaccactatggagaaggtttgaaggttcttaaaaaaactaaaaatagagcaactatatgattcagcaattccactgctgggtatatactcaaaagaaaggaaatcagtatattgaataggtatctgcatttccatgtttattacagcactattcacaagggccaagatttggaagcaacctaagtgtctatcaacagatgaatagatgaagaaaatgtggtacatatacacaatggagtactatttatacataaaaaagaatgagattctgtcatttgcaacaatatggatagaactgaaagtcattatgttaagtgaaataagccaggcacagaaagacagactttgcatattttcacttatctgtgggagctaaaaattaaaacaattgaacttatggatatagagagtagaaggatgattatcagaggctgggaagggtagtggggatagtggaaggcatgtgctggttaatgggtacaaaaagtagttggaaagaatgaatgagacctagtatttggcagtataacagggtgactgtggtcaatagtaatttgattgtatatttttaaataactaaaagaatataattggattatttgtaacacatagaatagatgcttgaagggatggctgcctcagttaccatgatgtgattattacacattccatgcctatatcaaagtatctcatgtaccccataaatatatacacgtactatgtatccacaaaaattaaaaaaccattattttaaagggagcaagtgagaacaaggagaggaataatgtcatggcgaggctgttgcatatggagaacagtgcagaaacaccaaatgggaccaggggaacccttgccctctccctttggcatttatcagtgtcatgggtattgactcctagacagcacttaccagcctgtgatctatatttctgagtggagaatgtggaatggagggaatgggtaaagcaggatctataaatttgatcatcttgtgtctaccatctccagcaaaaacattgacatcagatctattcatcatcatcatcattatcatcatcatctattgtcattattattatgattttatgcaactgccaatattactcctattgttatttgattcctaagcctcatttactgtgagcaaagcatggtgctattccattttacgtagtttgatttaatcttctggcaatgcaggcagtgttccttgtgtctgtgaaagctgaaattgcatcaaacacaataatcaacatgaaaaagtgcagttttctgtgacttttaaaaaattgatgtcaaacattaaaaatgtactttttttacaattggggataaatgaatagggatatgaaaaaatataacttatacgtatttagtacaccctaatttaaaaatattagaaacactgataactaaagtgtttcatttctttattaaaataatttacctaagacagctagattagcttgcctcctttttgtcatacaacttactacacaaagcaggcatcttttctaatccttggtgacctgtcatactcctttctaagttgagatccacttctaacattttatcctctgcactttcgatgccatgaaagatctctgataatccctttcatgtgaagttttttgccatcatcagtaagtctgggacattttcaacctttttgtcacaatcacttttctcatttatgttgataagttcatctttgctaagttcttagcctgcatgtctacagtcccttgaatggcaaaatgtcaaggtttctaaggtcagctgtttggtctccatttggcttccatttaaatcttaatcccagtgttatcatttttcatttctttgctgcactttcatctctgtttcccagttctgcatttcaattaccaatttttgtaaatgtcacatcgatttaccaccgggagagaaggaagcaacacaactacacattttgctgtctgtgtgtggactgattagcagatacccagtcagcaatcactgaaagactttggaagaagtgatgtgactggccactggtcatgctgtgcatctcttatgtatgtggtgatttgtgaactaaagagctagcagcaaagtttgtactttatgcctttactcaaaattcatataccatagtaattaaacattgagccatgtttttggagggctttgtcatttacctaaactgtgataagtaaaacttgtgcatctcagaaatgtgcacaaagtgaggactgcctatactctgaagtaggaattatgagtttgcccatgatatggaaaagaaaattgagtcagaccaagattatatgattaacccaatgattatatgtattaagtggtaaaggctgatttagattttaaaattcaggtagcctcattacagatattatagcttaacttcacattgtttggcatcagattgaatctcaaaccctgacttcacattctttgtctcgactcgaaccctgactgtgatctctgtcaattaagcttcctggaaatatagttgattttgcagcagctctggttaatcaagaactctacctcctgctaatgacagagtctccagcttctcaaatttcttgaaactgtttctcaagaatcaatttacttaagactgttttcaaagactatagtctattacgattataatattacagtgtactacaggtactatagtgttcacatttgaagctttttcttgtatccttcaactccctgattatggcaatttggttgacactttgaagctttccttctttctcaactgtcctcctgtcctgggcttttaccacaaacactctcttggtgtctttaaagtttttttctcagtaatatctgccagcaaaggaggactatatgacacccctattttcttcccaggttgtccctttgcatttgtatattttcaggagagtgcattaaccctgttttggaaaggcaagaattcctttctaatctgtagtcatttcagtttgttattcactctgaaaaatggtaatgaaagtggagaagacagtggtcaaattggcactatgcaaagctgagatgctagctagtgacagctccagaatgatggtcctggagctgcagccagcataatataaaagcaatcagcccaagtataagacctataatctccctataaaaaacagctccatcatctgccatctctgtgacttagggcaaggagcatttcagaacctcagtgtcctcctttataacataaagaaaagcttgaactctcattaccaacatcagtgaagattaaaatattgttactattaagtggctgatacatgtaaaagtcacgcaaaagttagattttattattagggcttgaaagagtgaggcacagtggcatatacaattatacacaaagatgattgattgattgaatgatagcatccagaagtcttttgcagtgtctcccaaaatctgttctctaatcattgttgtgaaggccactttataactacaccgtggataacatacctctaaatacgtctcggtgtatcctccttaattttacaggtataaccagataattgcaatcagtattgtaagccttatttgagaaaagatacttgctaataggtcattctcctaaactaagctgtgtgataaactagagataactcccaaattcaaagtccagctctacttttctgacatttgtgttgtcacaaattattgggagtcctcacttaaaaacaatctgtctacctgtggccccatagcagtgtctgatgaaccaagcacatagaaaagtatatgttgacataggccatctcttgctccagaagtgttcactacaggaagcctaaccatttgtcacacagggtcagatctcaaagtcctttcccttattcttcgagttttaatttttatttagttttctctcaatgccatcatgcctgtgtttaggctggtcctcctgattctttgtcctcaattaaaatatggataaataagatggtctctaataccagctttatagaaagtaggtagaatcaggcaagattctctctagtttgtcatacaacttgacttgaatcagctttgtgagttaggagtttgactgtactccaaagagattcaaactgagaactattcctttgggctcctttgttgtaaggtccattaaacacaatgagggcatatggacatggtttaccatttcttcacaaaatccactgcagagtttctagtgaagttgcaagaaaaatgacaatgaagtcaaatgtgttatttgttgagttaacttaagcaatatatgttgactcaggaaataaaatattacaaaagatagagacaaaacccagaagaaaatgccaagcaaaacctcagattcaatccttgaaaggacaacaattctacaaattgtagcatataatcatcaaattctgttttcttatgaatatatgtacattttcccatgaagataatatgtttacaactagaattgtggtctacatattgaatagaagactgttatttttatttaacaatatgttctgaacatctttctacatctgtaaatgtattttgttatgcacttgtaatagcttattgtatataggcacaatgatttcttttgtacacatcctgaattatacccttcaaataaagcctcagaaaaaataattctgggttgaagtctataaacatattcctagttgctggtacctatggactgacctgagtttgaattccagttcttgcatatactagtggtatgatattagctcttaatttcaaattatgacttggcctaaatacattggttttattcctcaaaagatcaccttcaaactgtgatggaatcttcagttttgaacaatttacaatttttgccagctctgatgcaatatgcatccactagagatagaatatactttctgtcacctaatcctcaaaaccactgttatgtcagttttgtttcttttaattcatgctattctgatagcaaacattgagacaaggaattgggtgcaggtattttatttgtgagattgtcccaggaagtaggaggaagagtgtctggagagggatgcagggaaggaggaaacgtcaatatatggggcatggccgagcagattctgaaggcaacagggactcagttgtgtgggacctctgtgaaaggtagagaggaatctccaggtttgtcctgtttctgacataggaagcaggggtgattacatctaaacgaaaaccacctccctgtgtaataattcctcaaaatgcatggtgttggatctagcaattccaagtgcttcagaaaagacacagggctagatgcagaaacaggactgtcagggtgagtctgggcttaagtgaaactgttcactggaactgtggctgaagtcataagtaggacaaagatgcatgatttggggcagcaaaaacacctgttacgttagtccagtgtaataggcagaaaatttgatctcaaagagattaattaatttgcttgagagcactcagccagtaattggcagaaacagccttcaaactctggttttctggctccaacccccatgttcttcccatcacaccacgcctcctccaagaaagcccagcactttgtgcttgtatggaagctccaggcactctgctctgggccacagctgtttgggcatagcacagtggtgtgccctgctgtataccacccattcaacctctaaatcccctacagcctcagtgttcagacataagggctctatcctttttatctatctgaacccctgatttttcccttcacagaatcagtgaacttgtacaaatcgtttcaaacagtgcattgcaataaattgatgggttgtgaaatcagtttagtgagacttgactagcattttaaaaataaaatagatgaaaatatcagaagtgtgtggtttctgtcactttatcaaaggaaaaaatgtttattcatgtgtatgtgcgtgtgtatgagcatgcgtgtgtatgtatacgtgtgtgtgtgctgagtctctacaaggaatttatttcatatgatgggacatggataagaaacttggaaagccactgacaaataggttcaaaatgcaggctcaataatgctcaaaatgcatgggttcaagtcccaactccaccacatactagccagatatgtttcagtcttcctatccataaaacatggctaacctcaagggctgttgaagaataaatgaattgctactcatagaaagttgagaagagtgcctagcacattaggattactcagtcattgttacttttcattgtaaaagtataatcaatatatgaagtacaaagttggcatgtaatttttgtttaatatggaacaagggaaaagaaaatcatcaagtattttcaattatttggaaagacatactatggagattgagttaaaatagcattttccttacatttattttgtgctctctcccaactgcccctcactacccagtgttctagccctataaacacagtatctatcaacttaaacaatgcaggtcttaggaaaattaatgtaaaatatttagtaagctaaaatttcattcaaaaatatgcatttttctagttttcaggaggataaatgaactgtataagacggtcttgttccataaatagtcttgcagtctaaacaaatgactcttaaattgccataaactaagacaggattattataccttccggctcagaaagaacactgtaactcaggctttgtgaaagagccagtgactttgaaccgctgcatgaatgtgggtgtgttctgtttatgtaatctagagtagtcatttctgaattgattgcacacaaaattcatccgagggaacactgaaaatcatttccaattgcattgggccaattgcatagaaaacactgagagtgtccccaaatccattctataaaaaatgctcctagaaagtgacagtggattgaaagataagcagttttgaaaataccttgactgaaatttgctgactgctcattcttggcttgaaataatgccattataattatttttagtgtatctatctgaagcaattatacaatacattgattttcactgcctcttcaagaacaaccttaaaaaccatagacacggagattctgaaatatcaggagaagatcaagagaatgctttttccagggccccagtcacgataagaaccctttccctagcatccttgacatgtttgttagaggtgattgaaggattctagtgataagtagtcatttgtctccaataaaactttacagttgcaatcataaacaggcttcaaagttcttgtagtcataaatcatctggacttttatttgcttatatttttctttgaaaactgtcttataaaaattaggtgtatgttaatggagagtatatatgccttactataagtaaaaattttgtgttactagatgtactggttttttttttctaatacacacttaaatgagaaaataacaattaacatgaaatatgttagttcttacaccgtctaaaatcatctattagaaccaccctttgggaaacactctttatgactaagaggaaataagcctcctatttgtctcacctaacagcccttcaaatgcatagatctgtgaacatttttcttcctcaggggaaatatctataacttccttaactgtttcttatgtgaaacaatttcctaactgctcaccatcctagcaaccttcttttaggtgctctctgctttgtctaagtagcttttaaattgtggaagcttctctaaggtgataatttcttatctctggaaaatgtaggcattcctctatagcttccttttctgagtcataggcctgaggaactcacttctagaaaatgtgaatgaatcagcagaatttcttatggctcttgagcattatctttgtgtttctttgataggggatgtggtagcaagtgagtgcctttatatgaagatattgggcaaaatatcaaagttttttacaaggaggactagcataaggcaaaggatccactcattccttattttaattgacctgttcattttgagatagttgtagattcacacgcggttgtaagaaatagtgagagatcctgtgtttccattaccagtttctcccagtgtcaacatcttgcactgtcctgtagtacaatatcacaaccatgatgatgacattaatgttgtcaaagtatgagaattttatatcaatacaaaatcccctatattgcccttttatagtcagtttcttctcaacctcaacatctggcaatcactaaactgttctacatcctgtaatttttgtcctattatgaatgttatataaaaggactcacacagggccaggcgcagtggctcatgcctataatcccagcactttgggaggccgaggcgggtggatcacgaggtcaggagattgagaccatcctggctaacacggtgaaaccccgtctctactaaaaatacaaaaaattagccaggcgtggtggcaggcgcctgtagtcccagttactcgggaggctgaggcaggagaatggcatgaacccgggaggcggaggttgcagtgagccgagactgtgccactgcactctagcctgggcaacagagtgagactctctctcaaaaaaaaaaaaaaaaaaaaaaaaaggactcatacagaatccaacctttgagattggcttttatcatttaacttaattctctagagatccatggagttgcaagtatcaactatttatttttcttttctttcccatttacttatttcttttccttgctgagtagttttctgtggtgtggatgtaccacagtttgtttaaccattcacctatcaaaagataatacattgtttccagttttgagccattacaaacaagactgtgaaaattgtgtacaaagctttgtataatcataattttttatttctctgaatcagtgtcaagaagtacaattgttgggccatatggcagtggcatgtatactttttaaataatctgtcaaactgtattccaagtatctctaccattttatattcctaccagcaatgtatgaatgatccacattctggagagcatttggtgttgtcactattttttactttagacattctgatagctctatagttacatctcattgtggttttaatttgcatttatctactggctgatggtgttggacatctttaatgtgtttatttgccatctgaatatcctgtttggtgaaatttctctttatgtcatttgcccagttgtaactggatcatttacttactgttgttttaagagttatatatactggatactaccccttggttagatatgtggcttgaaaatactttctcaggctgggcgcagtggctcatgcctgcaatcccagcactttgggaggctaagagggcagatcatgaggccaagagttcaagaccagtctgaccaacatgacgaaaccccgtctctactaaaaatacaaaaattgactgggtgtggtgatgcgtgcctgtaatctcagctagtcaggaggctgaggcaggagaattgcttgaacccgagaggtgaggttgcagtgcagtgagctgagactgtgccactgcactccagccctgggcaacagagtaagagtgagagtccatctcaaaaaataaataaataaataaataaaatattttctctcattctgtaacttgtttttcattcccatgtttagggtcttttgtagaattaaagttttttatttggtaaagtcaaatctgactttatggattatgcactctttgtctagtattatagataccaaatagtttttactgtttttttctaaaagttttagagttttaaaaagttatcttttctctactgaattgcttttgagttgtcaaaaatcaattgtccatatttttgtgggtttatttccaagttctctttctttttcattgatttatgtgtccctctttctaccacgttcacagtcttgattgctgtagacataagttttaaaattgagtagactaatttatccttttattttttcttccttctttgttgttttccttctttccagctttccttctttctttctcattttttttcaaaaattgtttcagctattctttttttgcctttctatagaaattttaaaataatagtaatataacaattaattacagtttttgtaagtgaaataattgaatacaaaaatatcttgctgggaatttgatcggacttgtgttaaacctgtaaatcaggtttggggacaactgacatctgtactatattgaattttctaattcatggacactgtgtatctgtccatttatatagatgtttggctttttatcagtgttttgtagtttttagcataaaagccctggtcatgttttctttagatttaattactaactttctgagtgattgcaaatgatattttattttatttttatatgtgttcattgctagtatatagaaatacaatttatagttttatttttatcttgaattctgcaacctttttgatctcatttattaattccagaagtcattttgtagaggttttttttttttcctcacagcgtctcgctttgttacccaggctggagtgcagtggctcaatcttgcctcacttcagcctggacttcctgggttccagcgattctcctgcctcagtcccccaagtagctgggactacagatgcatgccatcatgccaggctaatttttgtattttcggtagacatggggtttgtttcatcatgttgcctggtctggtctcaaactcctggactcaagatccatccacctcagcctctcaaagtgctgggattacaagcctgagccaccgtgcctgccctgtagattcttgacttattgcattggctatacatacatgtatgtgtgtgtatagtatgtgtctatatatgtgtgtgtatatatacatatgtgcttgcatatatgtgtttacatatacttaatgaaggtatatgtatatatattcattaaatacaaaaaaatacattcatgtgtatatatcttcattaaataaacggtgacatattccacctttcctatttctctgttttccagaagagatagtttagaattgatgttaatttatcttgaattgttttgtataatactccagtgaaactatctgtgtctagagatttttttggggatgttttaaaaattatgaattcaagtttcctgtttttttttttttttgagacggagtctcgctttgttgcccaggctggagtgcagtggcgtgatctcggctcaccgcaaactctgcctcccgggttgaagcaattctcctgcctcagcctcctaagtagctgggattacaggcacccaccaccacgcccagctaatttttgtatttttagtagagacggggtttcaccatgttggtcaggctggtcttgaacccctgacctcgtgatccacctgcctcggcctctcaaagtgctgggattataggcatgagccaccacgtctggccgaattcaagtttcttaatcgttacaggactatccaaatgatatatttcatgtttggttgtgatattttgtatttctttaaagactcactcatttcgtcaaagtttcagatttatgagatacagctgtttgtggcagtcctttattatcattttgatgcccgtagtgacatacactgcttcattcctgatattggtttttctctctttcctttgtcagttttgccagagttttgtcaattttattgattttttttcaaagaagtagctctttacttcattaattttcctttgttattttttaatttcattgatttctgctctcttccctcttccttctgctacctttgctttcctttttctaagttcttgagcttgcagcttggatgattgacttgaactcttttctagtgcatgcagttagtcctgtaaatttcacttagcattattttagacatatgtaacaaattttaataggttgtatcttcactgtcaatcagtttgatgtattttttattacacctgagccttcatgtttgatccaatttattatttaaaagtgtgtcgttttcaagtgtttgaaaattttcctactactttctgttattgagaatctgtgatattctatttccgtcaaataatacacgctacttgatttcaattatttttaacttgttgaggtttgtttagtggcccacaatatggtctgtcttgacatacattcaatgaaaacttgaaaagaatgtacatttggctgcgattgaagactgttggttaatggtgttgagttcttctgtaaacttgctgatattctgtctccttgttgtatcaatcatgtagagaatgatgtggacgtctcaaactacacttgtgaatttgtctatttctcctttcagttctatcgatagaactgttttatcagttctatcagttatttcacatattttgcagctttgtttttggtgtacacacttttttttttttttttttttttttttgaaaccgagtcttgctctgtcgcccaggctggagtgcagtggcgccatctcggctcattgcaagctccgcctcccggctcccgggttcactccattctcctgcctcagcctcccgagtagctgggactgcaggtgcctgccaccacgcccggctaatttcttgtatttttagtagaaacggggtttcatcgtgttagccaggatggtctcgatctcctgacctcgtgatctgcctgccttggcctctctaactgctgggattacaagcgtgagccactgtacctggcctggtgtacacacttttataattgctacaacttcttggtgtattgacccttttatcagtatataatacatctctctggttctggtaattttttttgctctgaagataagatatattatctatatcttatcttctaagtttcctttgattaatacttccatgagatatctttttccatcctcttaatttcagcccattttgtcatatttatagtaagttttttgtaaacaacatagttgggtcatggcttataatcctatctgataatccctgtcttttaagtggtaaccttaggccatttatattttattttattttaatatattagaatttaacatttaatattttgttttctgtgtgctgtttgtctcttctctgctttctttttcttaacttattgtggattacttgaacatttatttaaaattccattttgctttattcatagtgcttttgaatacatctttttatatagctttattagtaactgctaggtattacaccctattttatataggtaacttgtcacagtttactggtgtcatcattttatcagtctgaataaaatacagaaaccttacttctttttgtgcccctttatccttcgcctttggtcatataattgttttaattatttcctctgcatacacttagacttagaagcacattatacgacattacaatgtttgcttcaagtgtcccaaacataatttagaaaactcaagacaaaaacgaaagcttactgaatctacccacattttttgtttactgtgttccttctaccttcttgatgttccaaagttccttcttttattttttctttctatttagataatagagtatagtcattattttaggataggcctgctggtgacaagttttcttagatttcttcatctgaggtttttaaaattccctctttacacttaaagaatatttttggctgggcgtagttgctcacgtctgtaatcccagcactttgggaggccaaggggggcagatcatgaggtcaagagattgaggccatcctaggcaatatggtgaaaccccatttctactaaaaatacaaaaattagctgggcgtggtggcgtgggcctgtagtcctagctactagggaggctgaggcaggagaattgcttgaatctgggaggcggaggttacagtgagctgagatggtgccactgtactccagcctgggcgacagagcgagattccatctccaaaaacaaaaaatatattttcttaaccacactaaaagtattgtgctcccttttttctgaactccatggtttctgatgggaaacctattgtcacttgatttgttttgttttgttttcattatgggtaagatgtcatttttctcaggtggctttcaagatgtttttctttgtttttaaaagtttaattatgatgggtcttgctatggattcattggggtcgatcctatctttggtttcctcagctccttgaatctgcaggtttatgtcttccattgaatgtgggaagttttcagccattattcaagttattttagccccaccctctttcttctggaactctgatgacacaaattttaaaacttgttactgacccccagtcactgaagttctattaattattcttcagtctactttctgtttttcagattggataagttttattgtttaatcttccagttttctgattctttcctctatctccttttctgctattaagactatcaagcctgtcctctgaggattttattacatttctatttttttagttttaatattatcatctcgttttttatcttctgtttatttgctgatacttttctttggtgaggctcttttccagtttttcatttgtttccagcgtgttcataattgattactgaaacattttatcatggttgtttttaaatttttgtcagcttattctatctttcattttgatgtatgcatttattgtttttgtcatactatttaagatcttaggttcttaatatgatgagtaattttgaattcaaacttggatattttcatattatgttatgagatcactaaatttatttaaaccttctgttttaactggctttttttttttacactgtgctagcagtcaaagtgggaagtaaaattcataattgccttgtgtatataaaaatccaagcattctattcagtctccattggtacctgactggtgggttcctcattactgccaagcatggatgaaaattctggctctccatggagtctgccctggaactgtctgtagggagcatattcctgccagtgagttcaaagtcctggctccctacttggctttatttgacaccactcaagtgcatcttgataatctcatggacgtggaagtgcaggttcaccactcggcctttgcatgagtaaagatagagccacaatattttctgggtgtttaaccagtcacagtagttatttttaagttttctgacttgttagattgctatttccctggccaacttcctagagagaacaggcttgttttggggcacttttcatctacctcatttgtaattccagattctagcttcgtcaactcagagataaatgagggaaaaacaaaactcaaggcatgcaccactgtgtcctttctgaaattccctagacaatcagctttgttctctacaattttcagtcttcatatgcttatttttattagaatgtccaggattctccattgtaattactaggcgaaagagggaaaagtctattttctccaccttctcaaaggctgaagaccccacctattttttttttttaagtacaaaagaagaaaaatatttcgttggactactctgtactgggcgtttgacttgtagcatctcatttcaaatttttactacactcttggtgtttttccagttgtacaaatgaggtacccaggtcacaggaaggttaggaaacttgccccagctcatacagatggaaaaggagagagctggaattttgagcccacatgtggctcacttaccagctccattatgttttgtactctccattcattaatttctctaatactttcaaggtagcaaaagttttgagaattattttctcaagtgttagaatacttgtgtgaggttacttaaaggagaaattatttatcaaaattacagaatttaagaattagaaaattatttgatttacagatcttgctcccagtccagatcttactctatgctgcattttctgctcccataaaaggactatgagttcacttatttatcattgagttgcacacatcttagttgatcatagctctgaagtgagaacagagtgtttacaagggcaatggatgcctggaatttcctggcctcactattatcctagctgttctagccctttcatgcacatgcttcaaatctcagcctttgggttgtgaagcacttcagagctaagagtgcacatatgtcattatgaccatcacctaatgctgagatggcttctctgttagtctgtctttcccccacggagtgggaaagcactgaatctttccatctttatattcctggcaccagaattgaccattatatcataggacctcaagagacaatattgagtaaatgtatggatggatgaggaaaataaagtaaaatcagcaaaaatatcctgcatgtgagaaggtaagttctgattgaataatcctttatttagcaaagtcatatggcctactttgaaaaataatttaggatgattataaaattacacaaattaatcagtttcggcatgttctattttttctgacctttctcaaaataaaaaaagaaccaattactctttgggggaggatattgcttttctttaataaaaataggaataaataaaacttgcaaagcacttcctgagggcaaatattttcatgggattatattgattactttagctgctgctgaagataagaccattgatttttctcattatctatgagactctaatcaataccaagtatttattgactagctcttttatgttttataagattctaaaggctaaggtaactaaagaagaaacaaacatatgcttccttcttttatgttacttaccttgtgtttgaacacacggttttcatggaagaagtaatgataaataatataagacaatgggattggagcactggcttgcattagacatattacataatcacaaatgatagctttaaaaaaagaagaaggaagtaggtattgattgtctaccattgtattagccatgatacgagaaacttttttgttatctttaaggaaaactttttcaaaccattattatcagccataatttttacctgttagaaatctgagactttgagaagctgaacaactagattaatgctgcacagtaactgaaataagtaggattcaaacagagttggaaagaaaacctgtgctctgttcaatacattaagcccattgagctaaataactagtaagtgtttaataagtgtgtttcaaaagtaaaagaaaaagagtaagaatgagacagaagtgaagaaatccacctgggggaagtgtggagattaaagatgtgtagggtttggatgcatgaggaagcgaaaatgcagggcctggaaagagtcacaaagagtcccccaaacagcggagtacagaccagtctgatcaggaaagagacacagtgggaaacaaataagacctcacctggtagggtgaaatagtgagcagggagtgtacatcgcacctgataggaagaagaacggatcagtataaaagtgtggtttcagtaaaagagagcaatttagggtgggggcaggttgtccaggcctgaatttagttaactacggtgagaaaggagtacttggttccctgagggattgcttctcagatttggatgatggacagatgtgagagaaggagagagaaatgacttgcaaaattcaaactggggtgattgctagaacctggtaagctacatggcaaagaagcttgcagtcgtgatctcatcacttattagtttttatcactttgaacctcagttttaatgtcatgaatatggggttgccaggcaaattcagtgaaataaaatatgtaaagaacctagtccacagtagctttccaataactgtgagtttatatccctgggtgaatggcagtgtttttcaaaaggaaaagaaagcacaggtgactggaatgattgagtttaccttgggagctctaacgttttcctggagagaccccacacacgtttatagaaataaatttgatctggaccctgaaataggtcagaggtcctcaatccatgaaatcagataacaagctctgtgccctgagattcttaggtaaaaacggctaggagctgtcggtgcctgtgatagtgcagatggcttctgctgagccagctggctgaattgaaaaccccaagtaggtcaaatacacattacctgaaatttctggggaatgtggagccttctgctttgcataaggcaggtcctcggcttctgtgccttctttgtgtcgatctgggctggtgcacttttgaactcagaggaatggtaattctccacaccacttctggtggcccctatctttttatcgtattatcctttctgagtacccttcctttttcctttaactctacaatctctttctgggctttagaactgtcctgttacaaggttatcttacattatacccattatacaaggggataaactaagagacagaaaggttaagggatttatttgcgatagcctattagagtaaagccagagttacatttctgtggggaagatgaggtcttaaaaagacgatagccatcaagtagtccaggggttggcaaactttgtaaaggattggatagtaaatattttaggctttgtaggctacatatcatccccattactgttgttgctgctgcttttcctcctccacctttaaaagagtaaacaaacattctcagcccgcaggctgtacacatatagtccatgggccaaatttggaccaaagtttgccaaccctgaagtactttaatcctttcaatgtatagatgaggtgacaaaaagacagatgagtttagtgaggcacccaggtgtcaccaagtctagagagtggtggagctgggctagacctcaagtttcctcaacatttttctctttgccgtagttcaatttctcagacacttgccaattgtaggaagtagttatttacctatttaaattccaaaatgggccatttgaaaggccatggagactgaggtaccaaagttggtctcctcacctctgtatctatgcttgtctcttgctttttaatgtaattttcactgcctaagtccaaagattgtttgaggtggtgtaaaaaagtacaaatagttcacaataataaatacatgataaaaatcacgtgatacaaacaatgaaacagggaaatagtaatgctaacagaaagattagcagtaagtattgaactttgcctctggcttcctgatgcctataacaaagagaagttcatggtcagtcacaaaagtcagcgttcacacatttaaaatgaatcagttgtttgttggagcacatattttgtgattttaagaacaagtagtcatttctccaggggctctgtgtgaacagtgcactatataaagccatgttcaggttttatgtctcacaattagtacatatcaggctgcactgtttattggttagaccatggcttgtggagctgacaacctgtgttggaatctcattctggtacattcttgcaatatgaaattggcaagtcctttggcttttcttatcctccatgtccttatctgtgaaatgggaactaagaatagctacctgagagcttgtggtgaggaatggtaaatatacataaagcctctagaagagactggcacatgatcaattcaatgagcagttactattatgattgctgcctgtagattcttgacttgcattttgaaggagtgatgattgttaaagcacagacaactcagaactgatttgctattagatgaatgcttaatgattcttggtaaatgcctgaatatgaatgatttgatgctagatgtttcaagtttatgtatgagacgatgggatcttatttttttaggaggaatgggcacccatagtcatattaaaaaataaagcacatttgatgttgttaaggtaaagcccaacaaagccacagctgatatttcatcttgcaaatctcgaccttgaacttatttgttcactctctctaatcttcatacttgggtataagatagagaaaatactcatggaataaggacaacaataataaaagcattgcatttgcatgtcagcttgatagaggtgaaaataaagaagcttatttcaactcagtattatcttgcatgatttgtattaatgatatcgcagcctcagtgtttaaagccaagtttggaaatttgcagatgctactaaattatgagaaaacaacaaataatgaggcacaacgtattctgatggaggagaaatttgctcatttgggcacctcaggctaatagagagctaatggatggcaaatacagtttgtttagataaatgtcgaataatgagttttgaaacacagactaaagggagggaatgcctaatgaactgaaagtgctttagcacaataaatcaaagaatgttggtgtgtgaataaaggggatggtctaaacgtgcaaactcaaattgttttttcttttcagcaaagggcagaaatggtcaccagaagtaaataacacttttaacatgcagtaatcagcatttcagagtgcagaaataggaggaactttgaaatctgtcctatgtgcatttaatttctgctccttttccaaaattatacgatttggagtaattctgttgatctacctgaactccattttcttcatctgaaaatgagaatagtagtatttgtcagggctattgatatggtgttgtcaggtgaactgcataagggtctctgggctgagaggccatcacccacattgcaaatgtcatagatttgtctaatacatttatagatttgtctaatacatatatatgtctaatacatttataaaatacatttgtctaatacatttaagcaccatgctctttatagatagactcaaagtttcatgtttgttcattttgtttgttttaatcaatatatacataataaaaacactgctgtatagaggcaaaatatgttgaggaaggggtactttttttcttttctaaattgctaaaggcacaacagcaactggtgtgggggctaaagatttcctggttggaggcatgcacagccccagggggatgagtttttgggtgagatgggcaccagctgtgaaggcacctctctccagattggtgctgctcactgataagagatgactgctttgccaggggtcagtgtgagactatggaacagtacagggaaaatcaaaacactgggagccacagaaagaatccaccatggtgggcactgctgccctcagtgctcctgtaggattttacctttaaaaagctgcactgcgtgtgtctttatagtagaatgatttacaatcccttgggtaagacacatgcacacttatgtttattgcagcactagtacaatagcaaagacttggaatcaacccaaatgtccatcaatgatagactggataaagaaaatgtggcacacatacaccatggaataccatgcagccatgaaaaaggatgagttcatgtcctttgcagggacatggatgaagctggaaaccatccttctcagcaaactaacacatgaacagaaagccaagcactgcatgttctcagtcataagcgggagttgaacaacgagaacacatggacatgaggagggaaacatcacacactggggcctgtcatggggtgacgggctaggggagggagagcattaggacaaatatctaatgcatgcgggtcttaaaagctagatgacaggttgataggtgcagcaaaccaccatggcagatgtatacctatgtaacaaagctgcacattctgcacatgtatcccagaacttaaagttaaaaaaaaagctgcactgcaattgccaatttccttatctggctctttccctttcctgtgagctccttggaaggctggaagctaaccctactatccctccttccacaggaaagttcctgaagcctgtgtgacacttggtacattgtttctgaaaaagtgaggaatgagtctctcttctgttgcctcccatggaggtcagtgtcatatttctaggcttagttattttaaattgccttgattttttgattttaatatgcatctttttttttcttctattctgaatttttggtttgtgtcagccaacatttattgaatgcacaatgtatgacaatcattttcatgctttattttaatctttagttaatctttaacactcttatgagataaacatcgttagccccattttctagatgaataagttgaggcttagatagaaaaatagtaaattgctcaacattgcatagtgagcagattgcagaggagagattcaaaactaagtccccctgtcttcaaactgctcttaaagatttttctcagtgggtccctgaacattctttcccgtgctagtctcaaaagttattctaatattttcttattttgctcgacatacacaaacatgaagtaattacaccccactattgcctcatgtagctccaaacattccagtatccttgccctgtaagtaaatcaacattcactatttgtctttagttcccatttgtgcttagatgaataacctactctattagcctgaatttttttcatattttatatctatttttcaaatctcatttatagaaacatatgggagccctgctgaaaggattatagaaaaatccctttgggcaagaggtgtgcatgaaaaaatacagttttatttcatcactctcatgcaaaaattttcaatagctccttcttgccaatttaatcaactcaattgctggcaacttagtatccattctttaggggactagacattcatttctaaatgcacttccttcatattctatgacacaaactccctcacatgaccttcacatgtctagctccccaagtagcctgtatgctcttcacagataggaggcatatcatatatattccaatgaactatttggggaactgtattccctagctctgggaaaattgttttcctctctgtggcccagagaagccaaatcttcttttattattattattatttatttatttattatagagacagagtctcgctctgtcacccaggctagagtgcagtggcatgatcttgactcactgcaacctccatctcccgggttctagcaattcccctgcctcaacctcccgagtagctgggactacaggagcacaccaccatgccgggctaatttttgatattttagtagagacggggtttcaccgtgttccccaggctagtctcaaactcctgaactcaggcaatccacctgcctcagcctcccaaagtgctaggattacaggtgtgagccagtgtgtccggccccaaatcttttaacgtactattttctttgttgaactggaccatctactcatctgccatccaaacatgacctattcctagtaataactcgaatttgggtattcttttagagcttggaaagcatgtttacatatattatctcctcagattctcaccgtatccctatgagaaaaatattttaagcatttttatttttcagatgagaaaggtagaggttacctgatgtgtccagggactgccaaactaatgaaggctttggatgggatcctgacacagacgttgtgattctaaagtccacattctaaagcactgtcacactatcctaccccaattccatccaccacagagatgttgctttctaatcgtcctctcaacctctatacactttgatagcatcaagaagtttttatcatattaacaaccaaataaatgcacaaagtgaaacagtatgcatattctgaaaatacagattaagacaaatcttttcctctcccattcccctcgccactctcaccttggaaccaagccccactgtaaggacatgctggcgccccagagcctgtgtggtccttagcatgcaccaccttgcaggaatgagctggccctttgtccattgtttccctatgctctacttgaagaacagtaaagacagcctctgaagcacattcagttgacccttggacatcgcagggtttgggggactgccccaacccggtcaaaaattcacacataaattttgacttccggccaggcgcagtggctcacgcctgtaatcccagcactttgggcggccgaggcgggaggatcacgaggtcaggagatcgagaccatcctggctaacacggtgaaaccccgtctctactaaaaatacaaaaaattagccaagcatggtgacgtgcacctgtagtcccagctacttgggaggctgaggcaggagaatggcatgaacccgggaggcggagcttgccgtgggccgagatggcgccactgcactccagcctgggcgacagagcgagactccgtctcaaaaaaaataaataaatagataaaaaaacaaaaaagcctttgactcccgaaaaacttaactactattaataatagcctattatcggccagaagcctcagtgatcacgtaaacagttgattaacacatatttgtgttatatgtattatttgctctattcttacaataaagaaggttacagtaaagaaaatgatactaaggaaatcaaaaggaagacaacatatatttattatttattacctggaagtaggacatcataaaggtcctcatcctcattgttttcatgctgagtaggcttagaaggaagaggggggaattggtcttgatatgcaggggtggcagaagtggaagaaaatctgggtataagtagatccatgcagttctgacctgtgttgttcaagggtgaactgtactcacagtgcgggtggaaggatcaacacaacttaggacataacagctaattgctttactgaacatatactatgggctagagatggttctgatgatattacgtgtagtaaatcataatcctgaagacaaccctaagaagtagtgtcccattatttcccccattttacagatgaggaaactgaggcacaggtaaaaaaaattccaggggcacaactagtgttagatttgggttatatcttcaggcaagcccaccagagcctgagccgtactctctgtgtctggcgttgagaaaaaacaaacaaacaaacaaacaactgataagatgccagcttgagaaatggcgtagagcttcagtctgactttatgcctctgggaaacatcagaaagggggataaagtgtcaggaactccactgcagtgatatcacctacatgaggaaattgatcctgtggacgcagcatcacttaccagcctgaagacactgcaccaactgcctgattaacagcaataatgataataatactaacatccaccatttattgacaaattcctattactgtcaatgtctccctattgttataaattaagcccaagctcctttgtgcagtgctcaaggaccttcgtaacacaagatctgcctatttcttcagactcatgccgcatatatccatcctcacactgtaagctccagtgatattgatgggttcattgctcctctgcacccttcaatttcagggcttcacttacactcttctcccatcttgaacgtcctttatgctctctacacctacgcaactctttcagccttgattcaactattcccatatccaggaagactccgcatagcacacagcttaggtgaaataccactcctctgggtctctagagcaggaagggtttacatctgtcttcatatttactgactataataactacctcagtttgtacatctaacattcaccaagtattgaaattctgagggcaaaatctgtcatattcacctgtaccctattgtccagcacagcacctgcacaggctgtgtcaaaaagtgacagttggcattgtgtatcagaccctgggtatggcaccttgaatccagttctaatctcagtataacctacgagtttgagattatcgagccgtatgtactagttcattctcgcattgccataaagaaatatctgaaactgggcaatttatgaagaaaagaggtttgattggctcacagttctgcaggctgtataggaagaatggcagcatctgcttccagtgagacctaagggagcttttactcatggagggaggcagaagaggggcaggcaccttacgtggcaggaacaggaccaagagaacaaggcggggggcagggggtgccacacacttttcaaaaaccagatctcatgaaaactctatcacaagaacaggaccaaatggttggtgctaagtcattaatgagacctccatccatctgatccaatcacttcccacaaagcccacttccaacactggagatgacagtttgacatgagattaggtggggacatagatccaaaccatatcactgtattaggtcatttttgcattgctataaagaaataactgagactgggtaatttataagaaaagaagtttaatttttctcaccgttatgcagcttctgcttttggggaggcctcaggaagcttccaatcatggtggaaggaaaagcaggagcaggcacttcacatggcaaaagcagggatacgaggggcggaggggcgacacatttttaaacaaccagagcacatgataagtcactatctcagggacagcaccaagaagatggtgctaaactgctcatgagagttcacccctgtgactcaaactcctcccacaaggctctacctccaacattgaggactacaattcaacatggcatttgggcgaggacaaatatacaaactatatcacaaacctactttgcttgtgaaaaaatatgagctcagaaaaataaagtaatatactcaaaactgcatataataactaatacgtataataagaagtgttcaattcaggattcaaatctagcattgttcagagtctggaattttttttctaggtctgtattctctatcacactaactgtctccttaagaataaagtaaagttggctgagcacagtggctcacgctcataattcccgaactttgggaggttgaggcaggtggatcatttgaggccagaagtttgagaccagcctagccaacatagcaaagcctcgtctctacaaaaatacaaaaattagccaggcatggtggcatgtgcctgtaatcccagctactggggaggctgaggcactagaatcatttgaacctgggaggcagagattgcagtgaactgagatcacaccactgtactacagcctgggcaaaaaagtgagactctgtctcaaaaaaaaaaaaaaaaaaaaagaataagataaagttgatgtttgggaaactgagcagaaaaagcaacaatcaagattctcaattcttaattcatgattcctgaatcgatgcacttgaaaaagagaaaaaaggatcagctttgggaatgtgttaaacactcacttctgaacacccatggtttatctagaaagtgaaaggacccatagaacttggtcaacccttgatcacgacagatattgaggagatatgcgaatgcttggaagattcacaataatcatgttgctcaggaacatgaaaataattataggtgacatttttaatcacttacataagatgtagatggctttatgtgatttactatataatatattccttataacaaaatatgccatcatcatttttagatgaaaaagctaagataaattaaataatttctgcaagtttgtcttctgctcactaagtagaagacctcagactcaagcccagtctgatttcagatcccacgctcattaataagaatccttccttgtctggctactgttgacctctaattaggtgctcacctacattaacctggaggaacaaagctggaaaggggcacaagaatcctaggcaagagtagggaagggacggtgcaaccagacaaggcaggcatatttgaaggtggtttaggaatttacatcacgaatcccaaacatccatggagacctccttttaacacatgacttggcccagaggtaggcagtaaagagcaagttcagataaggctttttccctgcttataaaaaacatctgcaagttaaaagttgaaaagttatttatttcagctattcactcacttcagccccaatcagcacatgcctcagaatatctggagactgtgctaatacactcttgacatttggactaagacagagactgcaattcaatgttaacaacctggggtacctaaatggccattccacattgatcacttatttcaggcatttctccaaatagaaaaggttgattttatcagacattcactcttcttaatgtggatcagtagttctgtctcataccagccgtagccgcctggtgcctgacttgcccctctcacaggctggtggggttgctgacagcgtatcactgattttccacaaccagctccagagacacttgcccacacatcttctaggaaccattgcagatgtggctctatgacctccccataaactgaactcctaaatgctgaggcttccagattccctccaccaccccctgaaccagaattaaatattaaagaagtaaaatacattgtattttttaaagcaacctttgcgttgtcctttgcaaatattaaaagcaatgccactggcacaggaactaatccaagtccctggggccacttttcaaagaaagaaaagagtaatagtaagtaaacctctaaatgaaataaaggaagaaactccagctaaaattgctgaataataaaataaagacatgtaaatcatcctcgggggataattttctcctcgatcctggctgattttgcagatgaaaggaacacagcgccagaagttcagcgaccaggctcttcatcccactctgcccattcattggctttgtagcctcacttcaggcaagtcactcaatctctttggagctcagtttatgcttctgctgtagagaaatgataacaccaacagaagtcacagaggcggacctggaagcaatgagaaagctaactattttctgcctttctctctgccctcatcacataaattcaaataagccccgtgctccagttccaataaaggagtctcctcctcccgggaaagctggtttctccatctgcgcttgtgaacccacctcccgttcctgtgggggcatctggcctgagcttcggtctatatctatgaagtgggattaaaaataatgcctgcctcacagcgatgttgtgaggataaatgagctgaatcaggtaaagcacttaagacagtggttggtacatgcaaagtacacaataaatattagctcttcttatgtgtggctcttatttatccacatataagaaattttcaagtgtctttcatctgaaatacctgaatatctaaacatagttcagtcatgcaccacatcacaacattacagcgaatggaccacatatacaacggtgtttctgcaagattataacagagctggaaaattcctcctgcctaatgacatcttgatgatcctaacccgtgtgtgtgtttgtatcttagtttgtaacaagaatgtttcaaaagttaaaaaaaattaacagttagttaaaaatagaaaaaagtcttacaaaataagaattataaaatattttgtatagtggggcaatgtgtctgtgttttaagctcagtgccgttacaaaagaatcaaaaagtgaaataaaattaaaaactgtgtaaagtaaacatgttatagtaagctgcagttaatttatgattgaagaataattttttaaaataagtgtagggtaggctaagtgtacagtgtttataaggcctacagcagtgtagagtgatgtcctaggccttcacattcactctcccatcactcactgagtcaccgagagcaacttctagccctataagctccattcatggtaaatgcccaatacaagtgtaccattttttattttatgctctattgttactataccttttccatgtttagctatgttaaaatacacaaatgccattgtgttacaattgactatagtattcagtccagcaacatggtgtataggtttgtagcctaggagcaataagctgtgccataaagcctaggtctgtagtaggctatactgtctagatgcgtgtaaggacacactgatgttcaattacaaaatcacctaatgtcacacttcttagaacagatctccgttgttaagtgaggcatgactgtatattaagttatattatatataacttaaccattatatatgttattaaaatatagttaataatagatatatataaataaatttatataatataaatataatttatatattacatatgaatctgtatttctatatagattatatattatataatttaagcattatatatgttattaaaatatagttaatcataataatatatgtactgcatatgaattatatatttatatattataaatatatgtatacattatacataaatctatattatatatagattatgtatatagttctctcttaacctcttctgacttgtatcctcctctagatactacctcatttctcaactttcctatacaaccaaacttcttgaccaagtgatcaacatttacaatctttatttttctttcatttttgaaggaaaaaataaaagtatcataaactccatgtatgtatcacacattccatcatcaactccatacctcaccaactttctgttctctacattattttgaggcaaattattgacatattatttttccataaatatcagtaagtgtcattgagaaatttttttctcctctattttttgaatttccactcactcttgaacatgtagacacacatctattctagacaccaattagatagatagagcagtgatcatctgggcaatactgaatgccctcccttaacactccatattctgcctcattttccccatttatgaaaaggtttttttgttttgctttgtttttgttttcaggtaagtttgctaatgatttcccgactgtcaaatccaatgaacattttttagtcctatatcgtatagtgttacttatatggcaaagtaaagcactttcctataattttattgtctcctcccaccccactctgaacacttgcagaacgcattaccatgagtggactctgatggttgatataaataacagaagctttagaacttacacacaattctcctggcccagcactagttccactccatgactttcccattcaaaacagcataggagcctatcatgctgacagctttggtagctggtactcgggttgctgttgtccttgtttttatttgtttttgagtaattaatacatttatattatacacagttagaaatgtgcataatcatatacagttaaagtttcctgacatcttgtcccttagaaaaccaagtcccctccctcggaccaaccacttttcaggctgctgtatgtccttcagagctgctctacacatatataagcatataaagacctcctccctcctttttaatacacacctattagcatacaaatgcactgttctgcaccttgcttttccacttagcaataaatcttactgatctcttcagatcagtgcatgaaacacttcattccttttgaggatgcacagtattaaattgtgtgggtgtatcataatctcttcagccaatcttccactaatagacatttagactgtgactaatcactgccattaaaaacaatgttgcagtaaataactttgcatacctgacattttgcaaatgtttgaatacatgtataagaaatttctagaagtgttattgctgaattaaaacatatgaaaacttgtcattttttgagagatagtgccatattgtccaacagagaatttgcaccgatgtacactccaatcagtgaaaagagtggcattttcctaatactttcatgtaaatactgcttattaatttttctgacctactcaagtccaattaataaaaaacaatatcttggactaattatttagcattatctatcagccttgctttatctagatttttaaaattttaactgttattgttcattgttgccatttttctagatattatgcatatttttggtattcattatttatactttaacctggtggttgttttaacatattgtggtagttttgtttttgttgttatttaatttccaggtagtagaataaatggattttctggcttttatattgattttagttttaccccaccgtgaccagataatgttgtctgcattatttccatgtttgagaacatattgatgctttcctagtgattatttttttgagaattttcaatggatcatctgaaaaatgtttaatctcacctattagtctacggagggtaactatatatctattacatctcatttttaaaccatattgcttaaatcttttgtatatgttttttattcatttaatctttcatgaaatggaaaaggagaattgaaatctacgattactttatttctgtgtatttctccagatactgcttttttttttctttatacaagttatcattgcaggaattaggcctacacaaaagtgcaagaggtggggaagtgaaggtctagaagtagactaaggattcgagaaggtgtcctcactaaccacttgtgataaaaaattaaataaatatgtgggctttgtctctagttcctgacatacagctcctaaagtccttagaatctgcagagttctgtgcctttggtgtgccaacaagttactggtggctggagcaccctggatagatgcaggatggaggctgggcaccagcaagtcctaggcatggttggaattatagcactttaagcccgacctcccaacctctgggcagaggaaagagggtagagattgagttaaccattaatggccaatgaactgatcaaggatgcctatgaaattaaacctccattaaagcctgtaaaggggtttggaaagcatctgtgtcagtgagcgctttggggtgctgagaggtggcatatcccaaaaagccatgaagactctaccccttcacccattcttttccgaatgcagctcctccatttggatgttcctcagctatgtccttgaacataaatcagttacattaagtaaagtgcttacttgagttctgtgagccattctggcaaattatagaaactgaggaggggtttgtggaaacccccatatatatagctggtcagtcagaattgctagtgacaacctgaggcttggggctggcacttgaagctggagccatcgtatgggactgagtccttaacctgtgggatctgacactgactccaggtagatactgtcagaattgagttgaattgttcaacaaccattggtgcctagagacttgaaaattgattggtgtgagggaaaaaaaacccagacatttggtgtcagaagcgttgtgaataaaacagttcagatcagtgctcctgaagcaccagtgtggtggacaagtgggagctttcaggcatgtctgagaagccagcacatccaaccacgtaggcaggactgtgaaatgagagctcagggagaaagagagctggtgctgttgtgcagtgattacctttgtgggtctgaaactaacctctgatgatgggcttgggaccactatgctctcagggctggcagtgaggaagaaaagctggacctggaattgagaacaatgagggctattggaaaccactgcgtctatctttgtccctgaccatgaagaccttccagaggcatccagaccacattttgaatcttcttcaagtgaactttttgtctcccagaaccatataggaaagggaaatctggaaaatgaattttctagcttaacaaggttgactcagtacaacacaactcacctttgctcattatgatattccaaactttctgaatcacttgttatagatgtgtctcctacatacagtatagagtttagatttgattttgtctaatcttggattttttaaattttaataggtgagttcagttatattgattagattgtgtagtagaaagttatgcttttagttaatcaaattttttgttacagtatttcctctggtgactgtatcaaaataattcaagtagactgtatgttcttggctttgtgctagcaatgtgtgtgaacccaaaatatctgagacaggtctttaccaatttagaaagtttattttgtcaaggttaaggatgcacatgcatgacacagcctcaggaagccctgatgacctgtgcccaaggtgactgaggtacagcttgcttttatacattttaggaatatatgaggtatcaatcaatatatgtaagatgtgcattggttctgtctggtagctgggacaacttgtagtggttggggacttccaggtcatagctagataaaagacaaaaggttgcattattttgagtccttgatctacctttcactgaatacacaatttagttgagcatagtgaatctgcatttttacataaacagtggggcagaagaaacagtcagatatgcatttgtctcaggtgagcagagcgatggctgtctgtcctgcacctgtgaagattagctgctggtttacattgccagggtgaaattgcacaaaagtattttagggtaaaaatcttgaggcccacaaggaattttaaccttagagctctaacttcatataatatccttaatcctctctctctttaaacattatctgttgacttctggttatgagcaatgattaaattaatagctttcctctcacttgcaactgtcacctgatcttattttattatgttctctttctcagtgtttacctttgtaatattaaataggcttacccttctactacttcaaatgttattgcttagggaccatcaatagaagacgagcagcccggaagacacttcctcccacttctcacccctttgccctctcaggccatctctctgtctcgttaatatttgtaacagagtttgcacgtatgatactgttgctcccgtgctctgtgccatgtctcagaaaaggaaggtaaaatgcctacgttcctctctcatgtgcacattagaagtatatgggaagctttgaatgtgttcaaagttaatgatttccaaatttagtcacttagataatattattttctaacgtttatttgccacacagcaagataattttagccacccactggtttgtagaaacccttcactggagaaccacttgtccagtacagatataacagcaacttccttaagacatttcagaaaccagaaagtgatcaattattttttatctaacttgagtttataaggctcatgtgtgctccttacaggggatattcttagactgtcattcatgcccctatcctcatcatattcccacaattctagtaaaccacagcttattactgagacactatcacattgaaaccctaacataagagctttccagagataaattaagtaggagcatacatcctgggagcaagcaagtggatcccaaaaagcacagagatgtgaggtcttcaatcacgggcagcttcctgagccggcagccagtgaggtcacataaggccccttgctccaaagggtccctgattgaaaatctttgaaataattaattttgtatttaaatttgtgctttttaactgatgtcccaggggaaaaaggggcacacactgaggcctcaaacccttgcctcacaggtagattttaggctcccagcttctctgcctctggatgccccaaaccccactcagccctcacctcacacagtgatagctgccatcctgtactcgaggcgaggcccaggcacacacacaggtagagttggggatggttacacatccccatagcatcttcatgtggggcatgacagagctgtcccttgccaggctggaaataccaggacacatgaggtaggcgcatcagtagtggcaagcctcttgcccacccttggttcagataacaagcgtatcctggaacaaaagttgtggtccttcagggaatacccatccttcttggactgggaagctggtacctggaaaccagagaccgatttccctgcctggggacagggcatctgtcaggtagctcacagaagggataaacagacagctggtgagccacaggtgtggctggctacatcacagggctgacccccatgcaccttggtagccccttgcctgatagggtataatgttaaatagcaggtaaataacaccatgacaagtcaacagagataccaggaagaaagtaaaatatgtgcatatggaattttgcactattaacggcactttattctggtttttgaacaaaggatctgcatttttatcttacattgagctcctcaaataaagtggttagtcctagaagtaatttaagtacaagacaatcttaccaatggctctagctattagggcataacttcacaaaattacaacaagtgctcacaagtactattgtaggctattctaagtaggccacacatgtgttcagtcctacttagggattaaaggcatatcaaccacttttttggggtatttacttgcttcaggaggtccaatcatttgcagatttgcagaatacttctccaggttgtgattcttttgctgtgagctcagtggaagcctctgtaaacctgactgtgacatcttccctttaaatcatctgttgttatgtatggactgctccttttgtactgagcaccgggattcagatttgtgaatggggaagtatatacaaagataagcaaaacactgactgtagattccatattcaagcctatctggactcatataatcgatgaattcacatgcatatattttggctgtttggccctggaagggagggaagttaaaacaataaaaaaaggccggtttttcaagagcttagaatgaaattggcagcaaaacacatattcatattaaagagaaataaacaatcaaaattaataataattattatggctgtcagatgaacagtgtcttcaaagagttataggaaagataagactgtttattgactatttaccataggtgaagcagtgtgctagcattttatgtatgtgatttcttccttccacctctcctgagagagggctattggtatcctcattttatagacaataaaactgaggctcaagtagcttaggtagtttccgagggccacacaacctgttgtcatttaaaggcaggtctatgtgaccccagagtattctactgtaaaatgtaccttccaaggataactgtctcatctctatttattcagtacatttgccattcaaaggactttcacatctattacctcatttgatctgcacaaaggcccttgatagaaagctcaccaccagaacggggagctgaggcacagagcaggtgaagagcccaagttcattatcgattcacaagtgaggctcctctgatctcccatgatctctacttgtctggtaaatgaatggactgaaaaatgagtgtataatcaaagtgcgatttgtccagggtggtattgtatgaataatttatgtagcataaatactgctggatggagcacttaactaaacccttgatcagatgcctgttattatctggctggaagacaatcaaaaaatgaaatgaaatttgggcaaattccatacacacttgggaaaggccacagagagcaaaggaagaacacaaaaagagaggaggaactcttgagagtttagagtgcatttggattcccaagactgctggaagtccatgatgaaaacgtgctaaagtgtagctgcatatctaggggagaaattacatgtagccactgtgattgcaattaaactggaggctcctttctggctatgatacggtgggtgggttgtttcatacatttgtagcttggcatgactgattctgacattgctaatgatcttaatatcactcgtacactgatgcatatgagcctgtatcagtgtgtattttaaaattcatggaatataaaattattgatctctcctcaaaatccaaatcaccataccacaggcttcatcactgatgtcagtaactaaaaacagctctcatgaagaagccacagtacaactgaaacaaaaccagaagggtggtcacaaaagggaatatcaaactttcaaaactcgaaggcccaaggcaaatgatttattgggagttggcataaaaatttctatgacatccccttgtcttctttccggtccttcttcacgttaatcatacagtgggcctttattccaaataataacttttattcctgtccttacaatttctccaaactcaaagctttgtgtcactacactgtatctattcaggtttttttaagaaatcaattcataattcagcatgcacactgctacggtactggtccagtctttctcacttctgtcctggaagacattatctgatgggcaagaacactgaatgacttgtccctagctagccatgggagtaccccatctatgcaagtttgctggaatcttgtgctgctcagaatataatactggagtttcatgtgttctcccaagcaaatttgaaactccctgaaggcaaacatagagatttctgctccattcaggcttgtatagaaatctggctggctttttaagtattcacagggattaccttcctgactattaattttagcttgtccttccttggcatcactttatttagtttccaaagacattgatttcccacttttgctgtgaatacttccctcaggttccccctgagttgactatttggacaagaatgtctagaactctgtctcacacctaaaatatggctctagctctgattggaagcatcatattttcatataagagatgttctggcctcctgccttgcttgaaaggtccatgcttgctgagccaacttgtcacactcctcttagataggatggctgttagtttctgttctgtttctcttataggcttctcacacagttagacatagacttccttgtatgtatcaactgagctctcatgttgagtttagtgttttattttttaatctttataaaattttgtgctcctaaagataaactcatgaaacaaaaatatttagcatgatgatttgttgcaaagtgattgcttgtgtaggcaccaatcatgttgagaatgaaaacatcacaagcattcaaaagtccccattatcacctccctcctcccaaaaaaaaccccatttgtacttcttgtttttctttatagtatttattacctctgcagcaagcatccttaaacactccgtatttttcaactctataaacagaatgtatcattttgtgtttcatttcttgtgtataatattatgtccccttaaggttctttcaagttgtttgcagcaatacagatatttcattattttcattagcaatcaggaaaatccacacaaaaccaaaataagatttcatacacaatagaaagaatacctaaggttaaaatgaaattttaaatggacaatttcaagagttagcagagagctgatacactgcctgtgaatgtaagtatatccagataatctggagaacaatttgttattatctactaaaatttaaatgtgtatacccacatcccgtggctcaacaattccacttctacatatgtatccctctgaatcacatgcacatcatcctaacagcatgattcatagtagctagaagctggaaacactccaaatgaatgtcagaagtaaaaggataaattatttcataatcttacaattaattctgatgtgggataattcctttaaagttttttgtacacctttctttataggtgttatatgtctcactcaaaaagaaaacgttaaaaaattctttattgtacaaatttaaatagaagtactctatacctctatgctgggtaaatgaaatactaggtctgttcaagtctttcgcccacttttttctatttgaatgtctatattgtatatatctattcaactgatacatatatatgtgtgtgtgtgtgtgtgtgtgtgtgtgtgtgtattatttgtagtaattttttaatatcctggattggagccctagttctctcttgtgttataaatatgtcatctcatcttactgtgtgtttgttcattttcttaattaaatgaaaagataagttcttaattttactaatctaattcagcaatgtttttccttatagcctcttgcatcttgttttaaaaatgtataatatattctatcatctagaagccttattgttttacctttcacatccgtatttataatccttttgaaattatttttgtggattatgtggagtaaggtcacactttattttttccaattgtccacatcattgaaaagatcattttttcactgctctacagcatcacctttgctatatatcaagtgtctctctctctatatatatatatatgtctattactaagtttccaattatatccccctgatctatttgcctaaccttgtgccaatatcgcatgtcctaattactgtagttataatgatttgtggtagatacaagggaaaaaagtccctcacctcattcaagagcatcattagctatacttcttatttttaattttttatacaactcttagaataagcttgccaagcttctaaacaaaatgtattgcgatatcaattggcattgcattgaatcagtagatcaggattagttcaggaataactcacattgttacaacattaagtcatgaatcaatgaaactggtccatctctctcttcatttatttagttcttcttgtatatttcactcaatgatgttttaaaattttctaaatacaaggctgtgcttctctagttacatttattcttagatattaatatttttatgatacattataaattgtatcttatttaaaaataggatcttctaattgtttattactggtatacggaagtaaatttattttactaaattgaccttgattcatcagccttgctaacctcatgaatcctaataatttatttatgaattttatcacattttttgtgtatataatcaaaccatccatgattaatggcatttatatattttcctttctggtcctaatatttaaatcattatcttgccttattacattgaaaaggaccttcagtacaatgctcagtagaagtaagaattatagacaagcttcttcattcataatcttagtaaaaatatttcaaaatttcatcaataaatacgatatctgattgaatatgtttgtagataacactttactaacttaaataatttcatttaatatttgcaatataccaaacatatggatatatatattatatgtacatatatttataatattgaaggtggatttttcaaatgctttttctgcatctaagattttatttttatgtcattaatataatgaattacactggttaatttttaaatcttaaacaaacctcaccttttaaaaataaatccaaattaattactgtatttagctctatatatctagagatctaaatatctgtagatactataatgatgttatgataatagcacattattatgattagcatattattatgtcatgatatataaaatcaaggattctacatatcttttttacatattactagaatcatttgactattatattttattttttaaggatgacatatatagaaatgtgcaaaaatcatagatgtacaattcaaataatcatcataaaatgaacaccctttcataactaagttggctaacactttgctacaggttttattagatcatagcaatctcataaaccatggacacattaagagtttttttaatttactttttattaatcaccaggcttaggaatttcggactgaaactcagggtattggaaataaatatttggggcataaagattattgacattctaaccaagtaagggctagccaggccctcagtttttggaaaacattgaaaagagtaatacgttttgaaaacaaaatcgagtgggctgctggcagagctataggcaaaggccttaaggtaggaaaagatcaaggattctgaagtcagatagacctgggtgtaacacgatgaaactaggatttctcttctgtaaaaccaagaaatgattgaattattgctttccgtataatagtcttttttttttttttttttgagacgatgtcttactctgtctcccaggttgacgtgaggtggtacgatcaaggcttgcttcagccttgatgcctcagcctcctgagtagctgggactacaggcagatgccaccacgcctggctaattgtgtgtgtgtgtgtgtgtgtgtgtgtgtgtgtgtagagatgaggtttcacatttgtgcaggctggtctcaaacttctggcctcaagctattcttctgcctcagtctctcaaggtgctgggattacaggcatcagccaccatgcttattttaagagtcctgagaccaaactgtgctggttggtaaagctcaatgcttggcactcagtcaacgctcagtcaatgttaatttctttctttctacatcttccttcagttaacacaaacttacaacaatgaagaaataaacattaaatgctctacagggccagtttttgttttcttttgttctttaggtataaacaaggaactaataagaggaaaaacatagcagcacttacagcagaaggaaaatccagactggatagtagctgaggttgtggtccctccctcccacttagtacagagataaagtgggtaccaggtgttcaaactataaatgctgagttaggagggatgtatacaagggtgtgaatcctgctatcacagtccccatagcatgagcacatgacctattactttctgtaggaagtgaagaagggtatcgggtaaaactctcttctgtgcaattattcacacaaaggaatcaaagagaagggaagagatggcagtagcagggctagcagctggacatccatagttttatttcactgtatccatgtacttagtcccctgaggtgagcttcgttgtttcctttccctttggtgactcaacacagactccccacctgtgcatgaagcactgcacatacattgagctgggccatggtgattgggcttttcctagaagataaactcttccatttttacataaatttaaatgtgtagcacagatctcctagaaatgtgggtcatgtttttattgaaaattttgtatttgtctattagtaatttccatacaccagaacttctgttaagattgcattaaaggagtggacatccttcatgaggaagatcctctgtgacattcctcctacatcatcttttggaggccacctttcagagtggcatgcatttcactaactgggtccttcatcccaatacagcttactgccagtgagctagaatccaggctgaaataaagcaagccaggacttttaagaaaatgaaacgtgattacaattttaagcacagatatctgagtgggtccttggcatgttttgccattatttccatagctttgcccttgaaatgtgagacagcactgaaacactctcctatcctcctctcctaacagagtagcacacactgatattgtcagcattattctcaaagtgttacttcagcttaagtttcccttattttcatttgattttctggttttgctttcagaaaatataaaccgagccaagaatttgcatcttcctagggcagaaacctgaggtctattctggaggctttatctgaatttcacctctcctcacatttcctaatcccacttttccatttgatattattctatcactgtctgacatattatatatcttacttgattgacttgtctcttacttgtctcacttagcacaatacaaactctgtggaggcagagactttattatgagtccttaatacctagagcagtacaaggcatatagcatatgctccatacatttgtgtagagataattcattatctcaatttataacaagaagcactgcatcctaaattatccaagttgatttggggtaaaaagttaggttgggaaacgaaggaaaagaatatttaaacaatctataatgaaatatattaatttaatgagtacttaacactgtattttctaatcaaatagtactcagtaaaaaaagccttgttcagcataagtgaatttctttccatagcaccgacttcttaaaaaaccagtacttacctactctcctgttctgcactcaagcacgaaattgattaaatcacttaattaaataccaatttaaattaccaattctgaggctccacttccagaatttgttaaaatgtaacatctctgtgcctcactctcagagtttctgatttagtcagaaattaagtgggaggattgcttgagcccaggagctcaagaccagcctgggtaacatggcaaaatccggtctctacaaaaaaatacaaaacattagctaggtatggtggcatgaacctgtagtcccagctacatggaactatatttagtcagaaacacagaagcatacatttaaaaaaattttcagggaattcttacatgcagtaaagcttgcaaaccattggtctaggtatttttttttaaatgacactattcttttaaaatcatttttctttcagtccttctgaaataaggtttgttcatgatcatgcaacagatactttagaatatatgtatatatctttttatatatttgtgtttaaaatacatacacacacacacccatgttatacacacacatatacaaagcctataaagccaaatgtatatccttaaatgttttgataactgaaggacctgaaaagccacagcacccaccttggattgtcatttgtgcaaactataagtcttgcattcaacttcaaacagtcgacaagtcattctcagacctgtccctttcagaggacatctctgtcactgggcagattgaagggatagtaaagaggattcaaaagcactgagccttgttttccagtaagaaactgacatgacagtaagctagttcactgtgtacaccatcatgacccaatctgcgtgtgggaattctgagctcttgagagaacatgaagagtgttttgggaggaaataagggtagtggaaggtcaaggagaaatagttctttgatagcagctcacacttcttaatgaaagctgcctgctacaggacttgtggagagctgctatgtgacagagagagacacgtaagggagaggaggaggaccaacatttgcgaaggccctctgtgggctgggaattaacatgcgtatctcatttagtcttcgtaataacccacatgctaaaaaaagtccatttgtattttagacagttcagttttaccttcagtttcctgtaccacataatttgtccagaatcatagatctagtaaatgggacccaggtctatctggctccaaatactctttcatgtatacaatgctgctaggccctgggaggaggcagagtgtcagaattactcccatcttactagtggatatggtgaattcacactggctttctttctgttggtggatcagaccaagctctttagggccgttgcacttagtgttctctttgcctggaacactctcacaagcgagtctttgtgaggctgacttttcctgccatttctgtgtcagttctaatgaattctatcccgagtttcctgactacctagaaagaaggaacttccccactcactctcatcgcgtcactgcttcattgtcctcttggcacttatcagctgaaatttctgtgcattgtttatgcctttgatcactcatttattgttctatttttttaattagaatgaacatttctctttttttctctttttagaatgaacatttcttaagagcaggaagcttttttttttttttaatgcctgttgtatacttgatccttagagcaattcatggtaattactaggcacttagtatgtactggatattttaatagaatgggtaaatcttgttctcaccagtaaaaacaaaacactttcaatttttaaaaattttgtctatagcactgtgggactgaccgatagtaatttttgagcaaaacgagctcaccaaattccatatgggtgatgtcatgttatgtacaaaaataatttgagatagaataggggccgggcatagtggctcatgcctgagatcccaccactttgagagacctaggagggatgatcatttgaagccaggagttagagaccagcctgggcaacacagcaaaatcccaccccttaaagacaagatataagatagactatgatataacattttatttaataaagtctaaacctcaaagtgatagtcaaaagctgcagtgaacagaaaggaaaggaagaaaccactgcaggctctttacatcagggaatagtgtattcatttattaatattaatttagtgttggacactgtaaagcagtggttctcaaacttggaaccaccttgaggacctaaaaagtgctcttatgactgggttccacctcagagtatctgatttaattgttctgtggagtgacctgggctttgggatatttaaagtctcccaagatcactctactgtgcagacaggtttgaggaccactgttctggggatagagcaccagccattgtggttgtcagagtctgatgcaagtgacagattcagcaattacggtatagggctggaagttatgtcttgtgataaccatgactgtaggttactatggaagcacaaagtagatgctccccaaccgaggtcctcccatcacctcccagagcctaggctgagctgcaaaggatagagagacaaaaaaggaaggccattgagggcagaaatagagagaattcaattggcagggagcaaaggtgagccagagagaacttttgcatctttggtgcatgaagtagcaagtaaaaggaagaaaaaagccaggtctggacaagtactctttgactcaggacataaactctgtcttaagagatgaatagaacatgaataggctcagagaaaaggaagttaatcttggagaaaacaagagttataacaggtttagaaactatctggtgtaatcagctaattttatagatgtcttaactagggtgcagaacagttattcaacctgtcccaaccaaccaaccaaaccacgtaaggacagaacctcgactgcaatgtaggcttggcgatttacaggcaagttttcaagcactgcagtgcagtcataggggaaaggcatgaatggaagcaaaaagagtgtagtgtgcttgaaagagtcacaatactggtcttacaagaaagtaaaatagatatcaactaaatgaagacatgtcatttttctcgttatatgacctcaatgaagtgcctgggtatgcaatcacccatacctgagtcttggttcaaaagatgctcttctttttaagttgaggaaggcatgtgaggggtctctgttggatctatttttttgatgttgtttgaggataaattttggtgtaagaaaggtgctggtgttaacaatagtgccataataactgttcatctgtataacagatttggatcactcaggaggttcagtgtgttccctgccttggccatctccatcttactgacagcatttctgtatcttaaaagcatggaagcttttggtcttattgccatacacacacacacacacacacacacacaaacacacatgcacacacgcatacagatgcatacaatttgtggcctttgctttgaatgaaataagtgaacacccttactacctcctctaagtgtcttaacttcaatttattaggtacagactgaccctttaaatcacacttcatcagtgcgaaccctgaccaaaaacacaaggcttcctctccagctgctctgtggcacacacgtgtgcattttccttcctgcttagcatgcttgtgttcctgaaatattttggaggctttctcctttttctgtattttggtttcaccgacatcagcacacccaaggcagtggcgctgcaggagagactgctgtgcatgattggtgtgtctgcacagtcaacacaattattgcctatgtctgacttccaggacttttatcatcattggggagagattcacaagtaatagcaaatgtcgctgtggtcaaatggtaaattaggctttaagaggctacaaatgggaaaattatgaggtattttaagacacgagacgtacctgagggaactccttgccccatcccccaatcattcctaaactatcccatgcacccagtttttacaaccctcatcaagacctgaagtttccctaccactgcagcccacattgatctttcccttatatgaacatcagctgagttttatagtgtgtatcaaacaatttagcacttaacgctaattaaatgaggttaaataaaatcacttctgcagaagtgcctgctgtgaactgtacaagacagatgcatggaactattaccaccattaattagattaattggcttttgtatgttcatttttcctcctcagctctttagcaagcattctactggaggtttcataccagctaattcatgatggggagaaaggagatgctaaatagctgtggatttattaaagatgggattacgtggtgggccagattcatggctcgttatgcacagtggtcttatttcttcctgccaccattttctccttgaaaatttcccctcatctttgcaaagggaacaatgccagaaccctatccagctatatttagacagccagaaatgaaataactgtaacatgattgataaccttaagtccagggaaatgatattactaattaaatcgtgaaacattaggcaggctgtcaggcacagatatatttaaagtcataacagcccttgcttatttttaaagtgtttgcatattgaatgattctggtaaaattgtttctatttatcagaccaagtataaagtgctcatctccatggtatctgcaagcatagcagtcaatctaagataaatccaggcccaagagagcaatttctcctttatctcacattctctccttctctgtaacccttttatgaggttcactaaaatgagtttcattcaactttggaattagcacattccacactttacaatttctagaagcacaagcatgtgatgagctgagatagaaggaaaaggcacaagtcacagagcttcgatttactggatgcttattgtgtgccagatcccttagatctttgagttgctaatcttcctgtcccaattttacagatgcaaaaccaaaccacagaggtggtaaaagacacacacacacacacacacacacacacacacacccacaccttttcccagctaacagggagcagattgcttttggaactgagggctctttgacacccatgtcagtgccccttcaaggtctagtgataagaaaaaaaatatatgtatatatatatatatctcacattaagaagcagatgagtttttttcagtccaagatggccaaataggaacagctgcagtctacagctcccagcgtgagtgatgcagaagacgggtgatttctgcatttccaactgaggtaccgggttcatctcactggggcttgtcggacactgggtgcagcccatggagtagggtgaggcatcacctcacccaggaagtgcaaggggtcggggaattccctttcataaccaagggaaggcatgacagacagtacctggaaaatcaggacactcccaccctaatactgcacatttccaaaggtcttagcaaatggcacaccaggagattatatcccatgcctggctcggagggtcccacgcccacggagcctcactcattgctagcacagcagtctgagatcgaactgcaaaaaggtggcagcgaggctgggggaggggcgtccaccattgctgaggcttgagtaggtaaacaaagcagctggaaagcttgaactgggtggagtccaccgcagctcaaggaggcctgcctgcctctgtagactccacctctggggacagggcatagttgaacaaaaggcagcagaaacttcagcagacttaaacgtccctgtctgacagctttgaagagagtagtggttctcccaacatggagtttgagatatgagaacggacagaatgcctcctcaagtgggtccctgacccccgagtagcctaactgggagacacctcccagtaggggccgactgacacctcatatggccaggtgcccctctgagacgaagcttccagaaggacgatctgacagcaacatttgccattctgcaatatttgcggttctgcagcctccgctagtgatacccaggcaaatagtgtctggagtggacctccagcaaactccaacagacctgcagctgagggttctgactgttagaaggaaaactaacaaacagaaaggacatccacaccaaaatcccatctgtgtgtcaccatcatcaaagaccaaaggtagttaaaaccacaaagatggagagaaaccagagaagaaaagctgaaaatactaaaaatcagagcacctctcctcctccaaagtaatgcaactcttctccagcaacggaacaaagctggatggagaatgattttgacaagttgagagaaggaggcttcagacgattggtaataacaaacttctctgagctaaaggaaggtgttcgaacccactgcaaagaagctaaaatacttgaaaaaagattagatgaatggctaactaaaataaacagtgtagagaagaccttaaatgacctgatggagctgaaaatcatggcacgagaactatgtgacgcatgtgcaagcttcagtagatgatttgatcaagtggaagaaagggtatcagtgatggaagatcaaatgaatgaaatgaagtgaaaagagaagtttagagaaaaaaagagtaagaagaaatgaacaaagcctccaagaaatatgggactatgtgaaaagaccaaatctacgtctgattggtgtacctaaaagagacggggagaatggaaccaagttggaaaacactctgcagcatattatcctggagaacttccccaatctagcaaggcaggcctacgttcaaattcaggaaacagagagaatgccacagagatactcctcaagaagagcaactccaagacacataattgtcagattcaccaaagttgaaatgaaggaaaaaatcttaagggcagccagagagaaaggtcgggttacccacaaagggaagcccatcagactaacagcagatctctcagaagaaactctacaagccagaagagagtgggggccaatattcaacattcttaaagaaaagaattttcaacccagaatttcatatccagccaaactaagcttcacaagtggaggagaaataaaatcctttacagacaaacaaatgctgagagattatgtcaccaccaggcctgccctacaagagcttctgaaggaagcactaaacatagaaaggaacaaccagtatgagccactgcaaaaacatgccaaattgtaaagaccatcaatgctaggaagaaactgcatcaactaatgagcaaaacaaccagctaaatcaaaataacgggatcaaattcacacataacaatattaaccttacatgtaaatgggctaaatgcaccaattaaaagacacagactggcaaaatggataaagagtcaagacccatcagtgtgctgtattcaggagacccctctcacatgcagaggcacatgtaggctcaaaataaagggatggaggaagatctaccaagcaaatggagaacaaaaaaaagcaagggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagcccttagagacctacaaagagacttagactcccatgcaataacaatgggagacgttaacagcccactgtcaacattagacagatcaacgagacagaaagttaacaaggctatccaggaattgaactcagatctgcaccaagtggacctaatagacatctacagaactctccaccccaaatcaacagaatacacattcttctcagtaccacatcacacttattccaaaattgaccacatagttggaagtaaagcactcctcagtaaatgtaaaagaacagaaattataacaaactgtctctcagatcacagtgcaatgaaactagaactcaggattaagaaactcactcaaaaccgctcaactatatggaaactgaacaacattctcctgaatgactactgggtacataacaaaatgaaggcagaaacaaagatgttctttgaaacccgtgagaaaaaagacacaacataccagaatctctgggacacatttaaagcagtatgtagagggaaatttatagcactaaatgtccacaagggaaagcaggaaagatctaaaattgacaccctaacatcacaattaaaagaactgcagaagcaagagcaaacacattcaaaagctagcagaaggcaagaaataactaagatcagagcagaactgaaggagatagagacacaaaaaacccttcaaaaaaatcaatgaattcaggagctggttttttgaaaagatcaacaaaattgatagactgctagcaagactaataaagaagaaaagacagaagaatcaaatagacgcaataaaaaaatgataaaggggatatcaccactgatcccacagaagtacaaactaacgtcagagaagcacctctatgcaaataaactagaaaatctagaagaaatggataaattcctcgacacatacaccctcccaagactaaatcaggaagaagttgaatctctgaatagaccaataatgggctctgaaattgagccaataattaatagcttaccaaccaaaaaaaagtccaggacctgatggagtcacagccaaattctaccagaggtacaaagaggagctggtaccattccttctgaaactattccactcaatagaaaaagagggaatccttcttaactcattttatgaggccagcagcatcctgataccaaagcctggcagagacacaacaaaaaaagagaattttagtccaatatccctgatgaacatcaacgcaaaattccttaataaaatactggcaaaccgaatccagcagcacatcaaaaagcttatccaccatgatcaagttggcctcatccctgggatacaacgctggttcaacatacacaaatcaataaatgtaatccatcatataaacagaaccaaagacaaaaaccacatgattgtctcaatagatgcagaaaaggcctttgacaaaattcaacaatccttcatgctaaaaactctcaataaactaggtattgatgggacgtatctcaaaataataagagctatttatgacaaacccacagccaatatcatactgaatgggcaaaaactgggagcattccctttgaaaactggcacaagacagggatgccctctctcaccactcttattcaacatactgttggaagttctggccggagcaatctggaaggagaaagaaataaagggttttcaactaggaaaagaagcagtcaaattgtccctgtttgcagatgacatattgtatatttagaaatccctatcgtctcagcccaaaatctccttaagctgataagcaacttcagcaaagtctcaggatacaaaatcaatgtgcaaaaatcacaagcatttctatacaccaataacagacaaacagagagccatatcatgagtgaactcacattcacaattgcttcaaagagaataaaatacctaggaatccaacttacaagggatgtgaaggaccttttcaaggagaactacagaccactcctcaacaaagtaaaagaggacacaaacaaatggaagaacattccatgctcatggataggaagaatcaatatcatgaaaatggccatactgcccaaggtaatttatagatttaatgccatccccatcaagctactaatgaatttcttcacagaattggaaaaaactactttaaagttcatatggaaccaaaaaagagcctacattgccaagaaaatcctaagccaaaagaacaaagctggaggcatcacgctacctgacttcaagctatagtacaaggctacagtaaccaaaacagcatggtactggtaccaaaacagagatatagaccaatggaacacaacagagccctcagaaataataccacacacctacaaccatttgacctttgacaaatctgtcaaaactaagaaatggggaaaagattccctatttaataaatgttgctgggaaaactggctagccatatgtagaaagctgaaactggatcccttccttacaccttatacaaaaattaattcaagatggagtaaagacttaaatgtcagacctaaaaccataaaaaccctagaagaaaacctaggcaataccattcaggacataggcttgggcaaggtcttcatgactaaaacaccaaaagcaatggcagcaaaagccaaaattgacaaatgggatctaattaaactaaagagcttctgcacagcaaaagaaactaccatcagagtgaacaggcaacctacagaatgggagaaaatttttacaatctacccatctgacaaaggactagtatcaagaatctacaaagaacttcaacaaatttacaagaaaaaaatcaaacaatcccatcaaaaagtgggcaaaggatatgaacagacactaccccaaagaagacatttatgcagccaacagacacacgaaaaaatgctcatcatcactggccgtcagagaaatgcaaatcaaaaccacaatgagataccatctcataccagttagaatggccatcattaaaaagtcaggaaagaacaatgctggagaggatatggagaaataggaacacttttacactgttggtgggactgtaaactagttaaaccattgtggaagacagtgtggcgattcctcaaggatctagaactagaaataccatttgacccagccatcccattactgggtatatacccaaagaatgataaatcatgctactataaagacacatgcacacgtatgtttattgcggcactattcacaatagaaaagacttggaaccaacccaaatgtccatcaatgatatactggattaagaaaatgtgtcacgtatacaccatggaatactatgcagccataaaaaagggtgagttcatgtcctttgtagggacatggatgaagctggaaaccatcattctgagcaaactatcgcaagggcagaaaaccaaacactgcatattctcactcataggtgggaattgaacaatgagaatacttgaacacagggtggggaacatcacacactggagcctgtcatggggtatggggaggggagagggatagcactaggagataaacctaatgtaaatgacgagttgatgggtacagcacaccaatatggcacatgtatacatatgtaacaaacctgcacattgtgcacatgtaccctagaacttaaagtataataaaaataaataaataaataaaaaatacccatcagaacagaaaaaaaaagaaagaaagaaatggaagcaatgtacaacaaaatatttgcgtttaatacaactagatggtggttgcatcatacatttgtaccttgtgatgtatttaattcataataaaaagagataaagttataagcatattacttagaaaaaaaagtagatgaaggtgtaattcttctccagaggtagtcacacttgtgagtgaagttcttttaaagacagttctctaaagccagtgggatgaagagaactctatgggcttcgaggttaagcatatctttgccccacagccaggctgggctaagaactgtgtggccaagatcacataacttctctttcccaggcatcctcatccccttctgtaacatgcagcaatgatacccactttgctagtatttaagaagattaagtgggaataatttaaaaaaaaactacaagaagacaaagggcaaggaagaggggtgagtgtaggacttcctgacatttccagaattgcattcatgcaggggttttcttattctctgttaaagatggtattaaatatttcctagtgcacaaattttggcaaacataataggcacatcttgccccaacacaaggtattagattgagcacaataaaattgtgaggaaaggctggaaaatcatgttaaatagtattaagaaagccttaattgaggctccaaaatgattgctttaaaatctctttatcttggtttgttattttcctgacggatgttggagggaagggtgccttcagctgacctgtgttgcattctaaaaggctttctgttaggattgcaaatgagtaaacagatactgtccctaatcctgaaagcactgaagacatcatggtaaattacatgcacagaaggaaagaaggatcttttggcattaaatcccggtctgggatctcatcttcattctatatggattgtcaatttgccaaattcaaagcctcaagctattgtaattagactttgaaaatctctctctgatttccttttcaccattgacaaggatttgctactgaaaattacaaattgcaaatatattgtcagggcctgcaactggtcatatttcatttcactcttaagttccaagaaattacctttgttttagtgtttaatttagttggcttcaaagtactaactctgatatgagtgaacaggagaaggaatgagaaggaatcacagactcctatatcttggtggtcaggatccttcccaaacacagtgccctgttgccaaatctctgggcccaccgactcaggctcaattcccactgtgcttgttcagtcttttgcctgtatacctgccccctcctccatccaagctaaatcttgcaggtggaatgagtgccctttagcctattcatgggctgaccatacaacttttgagagtggaaaaaagaaaatgatcattcctgaaaaagtttcaaaaaatgaggcttggctgggccagacaggttgtctggtcaccccatctatgcaaagctatcttctttataggtgcagtccaggggtcctccatggaagtttcactggtggcgacagcatcctattagctcttccaacactaactgtgagccccaaactcatttttatatttaattatttcaaggcttatataattttttatcatactttgaatatatgccatactaggccaccaaccctaatcctaaccctaaactgtcatagagaatcttctcctttagtgctcggtaatgtactgtggtcagagcagacattcagacattgaatgaatatatacagaatatgcattcattaaaattatttgtatgcttttcctctcttttataattaagaaagaaagaaggtgatactgtaataatagtaccagccccagaagtataaagactctgagaagaatattcacataaatattatagtaatagccatttgtggagtttgatttttctgagaaatttaaacattagggcaatctagttagccagttttcattaatgtgaatagctgtgttttagttgatgtatccttcacctaagacttgggttattgtactgaccctgatgaaatagctatgcaatcttaagtgcattatttaaagctgatggagccccacttttctgatttataaattttagtgaagattatctctgccttagagccatactgtagtaatgcatttgaaaccatgccctcgttaagatcacacattctatatgcaaaaggcaccttgttgtttatcttgtgaagaaatgccatgagatgcttcccccaggatcattcagtcctgccaacaatcttatatcgtaagtattactaactgcatttgcagatgaggaaatggagaagggttaagtaaattgaccacattagtgactgccagatgtgggattcaatctcaagtttatctgactctccagtcaggaattggattgtatcattgtttcagcaaattcaatgatgtgctgataggtgactgatcgggggtaatagattaggaattaatctcaggattcatttagttctggcggctccatgcagattcaacccaaatgtgtttgcgtagtgcagctgcaagacattgatagtatttctccattgaggagagtggatggtttctatacaagagctaaataaaagattttataggaaaaaaagccccacaggcatgttataagcattcttctatttgtgtattttttcatcccactatggaagctttagaaagaaataggccccttctcttatgaacagctctttttagttgagtggggataaggacaatgtttcattttgctgtgtgtcttggcattgtgcctcaggcatgagcgtgcaatgggtgtgtgtgaagagtggatgaaaaccaagggcttcgtcctctcctggaaaaaccatcaaagagacctaaggagacatgtattaataataatctacagagacggtcctttgaatatgctcacactctcctgagataaaggatttcacaggcaggtcctgttctgctttggcaggaagaaaggagattattcaaaggccctgtaccgacagtgccattgggtttcataagggcccattttcagactacacttgagtggaaaggtctggagatctgagcagaacctatcgcttctccttgacagtttgctgagtataagaatacacaaggttcctcatagcgctcactggtgaatggtcattctcaccaaatccttttgttggcttcataaagtgcagagttaatggtctgtattattgtagtttgatatttaagtgagctgaactgtgctgaactattagagttaagattttcttgcacagataaatatttcctataaaatatggtattatggtggtttccattaatctggttgtattatgcttccaaatgagctatctgattttatcgttagaataattttgtgagacaacgaggatcaacttcatcccattttacagatcagcaatttagttaacaagtggtcattattgttcctgaggctatccaaatattcaagctatataagcatccaataattgtgatataatattactaacactaatataacaatattatcaatagctaatatttcatgaggactcactatgtgttaagcactcagctaagaatcatttcaattttctcacctgccaattggagatataattactgttctgtccactgcagggggtgtgtacagattagatgcagtaatgtgtgtttgagtaccttggcatgttcaatactgttcaatctatgtgtccatttctcagcttaccaactgtactaatgaattcttctctctagctcactgaactgcctactcctcgcacctctgtctaagctgcttttgtcatgcagctctattcacatttctctctttaattccttaaaagcaatactaataaccacaataataataggaataataattacagtgcatgtcttccattgtagaagcctgcctggtttacaaagatggcatgtaattgatcagcaaaatatccctgagaagaaaataggctagttatcataatgctcatttttcatttgaaaatgcaaaaaaggtagttgagattcagaaagactgacaattctaactcaacctggtgacaaagtgaaattcacactcagatatttccattccgctccatagctccttctgttttaagtgagtgtccctctcccttccaaggccctttggtccttaaaaaaaacaaaacaaaaaaaaaggtctatgagagtccctatagcttcttcaaagcttcttatatcaacaccttttgcaaagtgacttgccttccttggatgatctaagcttccgtacagtctgaaggagttctatggtgatcatctctagttctatttctctttaaagggcctggtcacacagttggggcaagggcatgtgtcattctttctataggaaatgctttccctctgcttatctggctggagttgtagaagattccacccacatgtctcctctcctgtgaagcctttgccaacacctctccacagagcactgctctctttgtgtctcttctgtatccagcactgactttctgtggagcaccagtagtgctttttttccctctgcagttggaacagatctgtgattatgtcagggatcagctatcagacccctgacatggtgacagatctgttctaactgcagactgtgtgactcctgacagctgagaccacaccttggtcatatttgtgtgtccatgtcctagcacagcaaatggcaaacaaaaaccccatagtgtatattttattgttttctacagtaaatttttgaatgaatgaataactttaacaaaacaacacctgcatctgttaaagggcagtgtgtctaccacttctgtgaagcagctgtggtctgatggaagttgaagtggctaaagtagcctcctctttttctgtgagtccttaattgctgttctttcctgcaacattatcagtgtaatgtgctaactcatcctacgtgtcacccaagcacattttgtagatgtgtgtgggacccaattctggtgtcactcatttgtaaaggccaaagttgaggtgttgtcaatgtctaaactccgtttgtcagtgagcttctcaggggttcgttccactggaccattagttgcctaatcctaccctcattttcttcctggagtaaaagaaaagaaaattacaagaacgatgaaactgtgtatattaaagggaaatagggctgacacaattgagaaatactcctccacactagttagcccttgaaaaagaaaaaaaaaaaatggtaaagccaaggcaagccatttatattaacacacctgggttccagacagaaactatggagtctattaattaaaattagtttggaaacaacattctattataagataatcttttcttcagaaagcttgctattagtaaattaacctcagccagtgttctggcacaatgaatgctctatctcataaaatccatattgtctgcttctagtcaataaaacacacaatctaataaaacccaattgtgcatggtcctggggcccagaaatcatgcagataattgaaatgaaagacacacaaatataaataattggctgcagtcaatagtcctaatgatctttcccacctagttttttacatgtacttggattccccatcttcgcagccaccatttcccaatattcttctgacctgtccattccccaagactctatcctcccagaagaaaggttacattgtagaatgattgctgaggtttatacttgaataaactaggcttcaaattgtgattttacctcttcctggctgtgtgacctgaattatattgccaggattttggtttctttatttgtgtaactgtataaaaatatctactatacagattgttgggagaattacattgaaatgaaagggataaggtatgcccatgtggctagcagagttccatattcattcccatttctttcctttacaagcagtgaggctcttaatagaatggcaagaagaacaagaagtaagaaagcctggagaacaagaagtaagaaagcctgaaagactcaaacactgtataatttttctctgaataagctaatgaacggccaaggttttcaccttttatgaagcgttatcatttgcaatatttctgagaactcatatctgctggagaacaggatatttccccagccagctcccactgagggccaggcgtgtttccagaaagcaacatgacattgcaatcagttttccaccaaagccagacacaggcaagcaaagggaccttgggctggcccgtacttctttggacctcagtcattccacctctataaggaagatgtaagcttgttttctttatttcctctgcgtttctgttatacatgtctgccctggattagtaagaatgggcttcaagaaagactaggaaaaaaaaattagaaaaggaacaggcaactcaagtgctcataagaagaacttacattaatcaaacaagtgtctgtatccctctgacactgcaaatactctgcctccccttgtggagtctataagcttgtctcatcctctagctatttccactcctattcctttctccacagaaactatacaccagtgtctacacatccctgtcaaatatttctcaccaccaaaaatctaggtgtgaagatccaggcttcgtttgttcatttggggttttgtgttttgtgtgtgtgtatttacacaaactgtgatacttgccagtgtcttttaattcatggtgctgccatataaactgcgtttattcctttctgtcctccaagctaggacaatcacaatctccttcacgaagacttattgatggcctgcttttttcatcatgccattatctgaactcctgtacaatggagtcttgtggtggcgttgaaccttaaatctaggtgaactgtctaacagcagatgaggaatgttgaagttgtgccatgcagctaatctacggcatgtggttttcatacttaaaggctgtgatgtccaatttccaattaaatagagacacctattttttccctgagaatgtaatcttgtcttgtaatcacctgaccctctcaaggatatagtctatgtcttttccaatgtataaatccccagagctgtaagtgaatcagagaaagcttgagaaatggcttcatgctttcatattttgagctttctcactgctgcagccatagggtaacaaatatgagaagaataactaacaatagaggggagaagtgaaacagctacagaacttacagactttcaagggggttatgctccaattggcccatcgtaagttaaaaaaatcatagattgaaacacactttgtatactttacctactcaacatcaaagcttaacctagtccaccttaaatgggatcagtttgacacttattatacattagcctacagttgggcaaaatcatctagcacaaagcctattttataataaaatattgagcatctcatgtaatttacagaatacagtactgagagtgaaaaacagaatgtttgttcaggtacttgacgtacagtttctactgaatgtgtttcaccttagagttactgtgaaagtcaaaaatcataaatagaaccatcataagtcagggactgtctgtagagttaacaagactagggaacgtgtaagcaaaatcaagtttatactgaaactggatggctgaaagcaatgcacctcttttctgcacattgcttagactgtcacctcctcttggaagtggcccttcatcagaaaagctctggtgagtgaaagcaacatgctcccccttcacaatgctcttttgtcattgtatatgcagtcttgtctttttgggatgtcctgtcacaattcctttggagttttagacagaacaacctctaagaagtgtgacctctctaacctaggctggaggagaaattcctcccctgagttctcctgcctcacactctttccttcagcatgacttatattgtgctgagttctgtgctcatgcctgtcttctcctccagcctatgagctcctcaagggctagatgaccctttctatcaccacctcgtactgcctagaacatggtctgactggctactggcctgctgtccgtgtgttaacatagggtgtgtgagggagtcaatttgtgaatgaatgaatgaatatatgaaaaaaaaataaagctgcctttgacacttttataatgtctcttttcctctgtagtttttttttcaaatttgttctccatgttaatccaaactttatttgcatataaatgaaaaaggaggaaatacaaggaaaaaaatcctcaattttgtctggatccacataggacttggtgtagagaaaacttcagtgaagtcttttgactttgaattctaaaataaactatgagcccatttacccagatttaatagcttaaaaccactgcagcatagagaagttcaattttagagattttttttcagtcacaaatacacatgtatttaacacacaaaaaaaattctactttgggcgctttaggggaataaaaattgaaattaaaaccagtctaatactaaggggcttacattctggtgaggagtatgtgacacatagatatatcaatgctgttgcgaggtgcagaaactgtgtcaggaatctggagagaaaatggtggacttgtacttgccattgaagagataccaagatgtgaacatgtggagaagtcggtggtcgctgtggagagatagtagcatgcagagggccatgagcctagagactaacattgtttggctgaagtcaacagcatcagaggaggttccaggttctaaattcagaagaaaagccaaggagatgccctgcacatgccttcattacccactatgattcatattcaggagcaactcaattttgtgggatttcgtagatttcagcagggagcataatcttaccaaaattagatttcctcaatgaaaaaatggagaactgaaaaatgttacctcaaagagaaagttagagatgatcctttaccgatgaggaagtgtgggcaaaagcctggcagttgaggccgacctcctctccctcctctctgtcagcatctcactagtgtatgtgatgagactcaggtgaggccccagcactgatgagacactaagtgtacatgagctctctgtttcttgtcacatggcctcccctatacagcaacaacaagcaaatgagaaaagagggcaggcataagccaaagtccacctgctcttaaacacattcgtaccatgatttcctaaggaactgttatcaatatcctgttttcattcagggactttgacaatactgtctgagggagccttgtactcttaatggagcagcatgcagagaagttagatttcatgcctcattacaaatattaagagatggactttcagtgatatgtatgtatgccttttcatgaagaccttaaagtttgtttgtttatttttttcacctgagagtttctctacacttcattactctataactgtaccaccatacattgggcttcaactgttctagcatggccagagcatctggagctggagagaagctgtattctgcatgcaaagccaaattggagaattggtccccgagtttgagagaaaatctatttaatttgattattgacagaaaaataaatggctctattatttgtctagaatctccgaaatacggcatgtaagaacctacatgatctgaattccaggagttccagctgatccttcccctacaaacacacacacacaccacatatcatatatatatatcagccctctagatttacttataattctagaagaagccatgtcctgcccatcagtagcagcctttgcataataaacgtttcctctctagaacactcttggcctaactattattagcccttcagtactctactagggtgctatatattgagtcctgagtctacaggaggttcccttccaccacatccctgcagctgttcaatcttcttttcatcctggaaatgaacctgtgggaattatccattgttttattttgttggagtttttttttcccccataagactatgagccactcgaaaacaaaggtcaagctttctaatctttgatcaataaatctaaatatattcctaacaaaataaatggtgtaaaatgaagtatttaatataaaatcctcttatttctaccccaacacacacacacacacacacacacacacacaatgctgtttcaagagacaaaaaagctctcaagatgttatctgatcaccttcataccattgaataaagaattgttcccatttgaaaaatactaaagacaagagaagttcaatgacgctccctaaagcaagtccggccccttgaaaagcaggagagtagttcgcaccatgatctgccctctcttggtgtagacttctcccagttccccttcacctggtagtttacttcagaggaggaacaagagagtctcgggaaagaggactctcagaagcaggatacttgccacgtgaggcaggtgcctgtttctcctgtgcagtggtctccagagaccggcgaaggagactctgatctgtaattatatccttccttcggtctctcattagtgcacactgttgctgaatacagataagcctgtatttgagaattctgtgcccgatcattgttattaattatagggaagatttgatattttaaaatatatttgaggaaggagccaagatggccgaataggaacagctccggtctacagctcccagcgtgagcgacgcagaagacgggtgatttctgcatttccatctgaggtaccgggttcatcgcactagggagtgccagacagtgggcgcaggccagtgtgtgcgcgcaccgtgcacgagccgaagcagggcgaggcattgcctcactcgggaagcgcaaggggtcagggagttccctttccgagtcaaagaaaggggtgacagacgcacctggaaaatcgggtcactcccacccgaatattgcgcttttcagaccggcttaaaaaacggcgcaccacgagactatatcccacacctggctcagagggtcctacacccacggaatctcgctgattgctagcacagcagtctgagatcaaactgcaaggcggcaacgaggctgggggaggggcgcccgccattgcccaggcttgcttaggtaaacaaagcagccgggaagctccaactgggtggagcccaccacagctcaaggaggcctgcctgcctctgtaggctccacctctgggggcagggcacagtcaaacaaaaaaacagcagtaacctctgcagacttaagtgtccctgtctgacagctttgaagagagcagtggttctcccagcacgcagctggagatctgagaacgggcagactgcctcctcaagtgggtccctgacccctgacccccgagcagcctaactgggaggcaccccccagcaggggcacactgacacctcacacggcagggtattccaacagacctgcagctgagggtcctgtctgttagaaggaaaactaacaaccagaaaggacatctacaccgaaaacctatctgtacatcaccatcatcaaagaccaaaagtagataaaaccacaaagatggggaaaaaacagaacagaaaaactggaaactctaaaacgcagagcacctctcctcctccaaaggaacgcagttcctcaccagcaatggaacaaagctggatggagaatgattttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaacccaaggctcgagaactatgtgaagaatgcagaagcctcaggagccgatgcgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatgtggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaaggaaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatactttatagacaagcaaatgctgagagattttgtcaccaccaggcctgccctaaaagagctcctgaaggaagcgctaaacatggaaaggaacaaccggtaccagccgctgcaaaatcaagccaaaatgtaaagaccatcgagactaggaagaaactgcatcaactaatgagcaaaatcaccagctaacatcataatgacaggatcaaattcacacataacaatattaactttaaatataaatggactaaattctgcaattaaaagacacagactggcaagttggataaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctctgataaaatagactttaaaccaacaaagatcaaaagagacaaagaaggccattacataatggtaaagggatcaattcaacaagaggcgctaactatcctaaatatttatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaactcagctctgcaccaagcggacctaatagacatctacagaactctccaccccaaatcaacagaatatacatttttttcagcaccacaccacacctattccaaaattgaccacatagttggaagtaaagctctcctcagcaaatctaaagaacagaaattataacaaactatctctcagaccacagtgcaatcaaactagaactcaggattaagaatctcactcaaagccgctcaactacatggaaactgaacaacctgctcctgaatgactactggatacataacgaaatgaaggcagaaataaagatgttctttgaaaccaacgagaacaaagacaccacataccagaatctctgggacgcattcaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaaatcaataaatccaggagctggttttttgaaaggatcaacaaaattgatagaccgctagcaagactaataaagcaaaaaagagagaagaatcaaatagacacaataaaaaatgataaaggggatatcaccaccaatcccacagaaatacaaactaccatcagagaatactacaaacacctctacgcaaataaactagaaaatctagaagaaatggatacattcctcgacacatacactctcccaagactaaaccaggaagaagttgaatctctgaatagaccaataacaggagctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatatgcaaatcaataaatgtaatccatcatataaacagagccaaagacaaaaaccacatgattatctcaatagatgcagaaaaagcctttgacaaaattcaacaacccttcatgctacaaactctcaataaattaggtattgatgggacgtatttcaaaataataagagctatctatgacaaacccacagccaatatcatactgaatgggcaaaaactggaagcattccctttgaaaactggcacaagacagggatgtcctctctcactgctcctattcaacatagtgttggaagttctggccagggcaatcaggcaggagaaggaaataaagggtattcaattaggaaaagaggaagtcaaattgtccctgtttgcagatgacatgattgtttatctagaaaaccccatcatctcagcccaaaatctccttaagctgataagcaacttcagcaaagtctcaggatacaaaatcaatgtacaaaaatcacaaacattcttatacaacaacaacagacaaacagagagccaaatcatgagtgaactcccattcacaattgctttaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacacgttatacaaaaatcaattcaagatggattaaagatttaaatgttagacctaaaaccataaaaaccctagaagaaaacctaggcattaccattcaggacataggcgtgggcaaggacttcatgtccaaaacaccaaaagcaatggcagcaaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactccaacaaatttacaagaaaaaaacaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccattccattactgggtatatacccaaatgactataaatcatgctgctataaagacacatgcacacgtatgtttattgtggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatcacacgttagtgggtgcagtgcaccagcatggcacatgtatacatatgtaactaacctgcacaatgtgcacatgtaccctaaaacttaaagtataataaaaaaaaaaaaaacattaaaaaaaaaaaaaaaagaagaaaaaaaaaaaaaataaaatatatttaatgggatttggagctttgaagttcatgggaaggattgaaatgtgatacatgttgatagtgactgtaaatgatacacagctaatgaaaatttccattgctggggtgttgaattaatagcacttggcatttgtacagcaatttttattttaaaaagcattttgtgagcaatattttgtcttattctcagaagagcccacttaaagcagataggacaaaggtcaccatacctgctaacaaagagaaagggagatggaggcacagagaggagcaggcaggtgtttgaggccaggagctggcggcagtcgtcctgacactgggcaggtgtctttaccaccggaagctgccacctcagctcagacccgagctgttaaatgcctagatgcctaactgtgccaaaagccactcatgctgctaaacttagttcccaaaacaaaacatacacaaacacaaaaccctcccttcccaaatttcctgagaggggtaggacacaggaatatgagaaaattttcaaatcatattaaatttctttcagtgctaagaaccttgacactctggacctttcacctgtgattttcacttctgggaatctatcctaaataaagagagagaaatgttcacagattttttttttttgaataaggatgctcatctcagaattatgaaagtaaacatttgaaaatgaaccagttcttcaacatcagaatacttaaataatttatattatatgtggggatcttatgaagctgttaaaatttctacttccaaagaatatttaacaaggtaggaaattcctgtgacttaaccttaagtaaataaagagtagataagaaattaaagttatgtcaaattattaatagtagttatgtttattatttttattctatctctttgttgttttagtttaaaagtttcacaataaacattatttgagtaacagaaaggaagacattttaagttttatttgtaaaagtgatattctaaattaatgtattatctcattaaatgtggtttcctcagcttctcttatggccagacactcttcttaggagccaaatatgccagtctcttcccttggggagctcacatttgagtgtggatgttggctggggttggggggagacaaaacagaaaataaacaataaacatacaaagtacatgacatagcatttataacaagtactctatgatgctttctcgaagtaatccaaagatgatacaaaaaggggaaaaatgtgcaggatacagagcttggagaaagacggagagttgccatttgaaggagatgatgaaagttgggcttttgaggagtgtagcatttgaataaagtcttgaaggagatgagagcctcagccagaacataacttcttctttaatactttgggcaaggtttgttttcagttttttttcaaaattcagagaagtaattcaatgcatgtactatatatcagctaacacactatatattagctaacacacagtgggatttgagacagtgcccttaagcaaacacattaatatttctgcagggaaacatgaatattcatacaaagcggaataaagagagtattagcccacctgagttctggctagggttctccaccaaatgaattttgggaaaaacatatttgattacacatctttatggatttcaggaagagagataaagagttgtaaaattgtaagacacacagaggttgagtgaagtgatgcaatcagaaataacatttcatatttattgctgttagcatttacacattttgctccagatgtccttctgacagcgctacagctctggagtgggtttgaaacagctccattgaggggatggaacggctctaactagctctgttgggagcctcctgtcaccaagaggcaagtggcctgggcggcttctctcagagggaactcctgcagggcatagaggcttgggctcgggcacccttcagtgttcctcttctccaagataatgcacgtccttaaattcatcaatgcatctaggtggatatcttcaacagtgacttttccaaagggagagtagtgaggcagaaatgtttctgagatgccgaataaagccggccgttagcctttgcgaacacgatgctgattcatgtgggaggtttaataaatctgtgcagaaggaatgtttggttgatggccacgctggctgcgggcactttcactcacactgcccatgccttgcctcacaccaaggtttcacaggataactgtctcaggttgtcaaggcttataagctactttattatatttttatttagtttttaactaaattactttggtgaacataatttctaaaatttacaggacatctcatgattgaaaatattctcactaccgcgtgaacccaggaggcagagcttgcagtgagccaagattgcgccactgcattccagcctgggcaacagagcgagaccccctctaaaaaaaaaaagaaagaaaaaaaagaaaatattctcatttagttttggtttccacattccaaaaactaattgagaaaacattttactatggaaatgcagattgtcatgagccagggactagtggtggttttgtttcctgccgtatcgtcatgtttctaaactctgcctataacaaagcaggcataatgcatctatggagagagaggtatatatatatataatatatacatattatatatatacatattatatataatatgtatatatataatatatgttagggcctattcagtacattcaagtaattcagtacattcaaggaaactattgataatgctcatttatctcatatatatatatccactaatgcatattatatgagatatatatatgcactattgcatatatatcaaactattgataatgctcttttatctcatatatatgcacatattgtatatatatttgcgtgtgcacatatgtgtgtatacatatatgtgtgtatacatgtgtgtatataaacacacaaatatacacacagacactatgcatctatagagagagaggtgtatatatatacacacacacatatatgtatgtatatatacacatgtatacacacatatatgtatgtatatatacacatatataggcacacacactcaaatatatatacatgtatgtgcatatataagatgagtgaatgagcattatcaatagttttccttgaatgtactgaattcctacaaaatgatcagcagctgttctttttcagttgtattccaggttaatcacatatgttacctgtttccttgcaatgcttcaaggctgtgggtgtttcgttaagttcttcttcacttccaaccatccagatctgctccagttagtctgttcatagccctcactctactctcattatccttccagtcattacattttgggtccctatatcttatatttaattttgataaatgagtaaagagaggaagtggcctgttcagacattaaatcttggtgcatattattacaaaaaaaggatcactagatcaagaggaaggaacatgcatttgctagcataccatgtgttccaagatggcgtcaattgcaaaaaaaaaaaaaaaaaaaaaaactcaggaaaactcaacttcattctgagatcagttgaaatgggggctaatatcacaaacacactggctttacagttgcattatctgtattcagagctctctgagatgtgcaaccagggcaaataacacaattttctgcattacttctctttagctaagaaattttcttcaaacagaagggaaaagaaaaagacagactaaactcttttgtaaaggctatcaccaggtctgagagcagtagtggagtgagcagcgccaatccgagtgagaatagcaacagtcaggctgctgctgcttcttcctctcctatggccctgactataaaaataaaactcctcccatttttacagggccagcaaacactgaacagctcgcagctggccgggccaactgtgtgtcttctgttgccgccaaaacaatccccttggcatccgtgaacagtgcagaagcaggttcttcaccctctcagaccattcctgatggagatgaggagattctggcttttcaccttctggccaacactgctgctttttgttaacatctatcctggtggttagaacctagatctctgtctcttgtaccctctctgctttactcaaaaaaatctggaacaatggtgaagtgggaaagcccttaattctgtactctttaaaaactactgtggaaagtaaagggatgaaatcctaatcagaatttttttttctacaagagcgtgtggatttatttccgattaaaaaaggaacagcaccagaaagtattcatttgctgttatatcaaaacatttagatttgtttgccctactatatttaaattagtgtgttaagtaactgagaattgaaatgcagcaacatatagttccaaacatgcccaaggtgtatatcccagcctctgtttatcgattttgtgcattcattgactaacttacctcatggaggttgtagttacaaccccaaatctaggctggtaacttataaactggctatagatatggattatgggaacagataatttagagatattggataatggattcttagtcagtttcagctgctataacaaaaataccatagacttgtgtggcttaaaaaacagacattaacttctcacaattctggaggctggaagtccatgatgagggtaccagcagattcaatgtctagtgaggacccatttcctggtttgcagatgactgtcttctccttgtaccctcacatggtggggagagagaaagaaagagaaaaagaaaaagaaagagaaagagagaaaaagagaacaagctgtctcttgtctcttcttatcaggatactaatttcttcatgagaggtctaccctggtgacctaatcacctcctaaaggtcccatctttacataccatcacattgggaattaaggcttcaatatgtgcatttgtggggggcacaaacatttagtccgtagtatggatattagagattgttactcagccccctgtcccttctgaagagtagcgtgtgcttttggcatatccaagtaaatgcagtcattttttaaaatgcctatttaacacctactacatatctatgggtcaagctcagtgctagagatacatatgtgaataacagggacacggtatgctggaagtgtctgctaggggtagcaggaagttctaagcagaagacctaacacggtctaggatttgacttcccaacttagaccccagagtggggcagagaaaggaggtgcacgtgtccaatgagtacaagggagaaacagtccatgatatggggtgaattgggccggagctcccagtgggaaccttgtggccagtgtcagcaatttaggctgaatcctaagaacaatgccaagccctgagaggtttctaaacagaggagagagatgaacgcattggtcccctcttttccgctaggttcattttgcactgccagatctccacagtgactctcccttctctacgcttcctcatgagcttgctttcaggacttggtaagtgctgctgactttgtcaagagcacttggaagtcggatgaaccaggtttaaaaatcagctctgccacttaccagttgtgtgattttagacattgtgttaccgagatgttcttcctcatttgtacctcctagtgggttactaattaaatctctgtttcagcacttaaaaaatgttcttctctgttgtctttgtcatatgaatttcaattaaatgtcttaactcactggcctaaggcccttaagaatatgtatgtaccacgtctgacagataacgcaggacctagctctatggagttgtctcgtgtaaagataattcacccctgtctccctagcctagataatccctgtttatccttcttcccaggtgaacaaggatctcagacccaggaatcaataacaactactattagtttagcccggacatacactgcatgtgattataccaaatgtacatgtgtcctcaggcatataaccaagaactaattatctcgtgactgccaggcactgttacttaaggaaattacaacttcttaaggggtggctgagaggataagtgagaataggaaaataagtttataggacacccactgaaatacattaacacgcacttgccatatggtgactcattaaattaaacttgactgaaactatgggaagtggatggtggcaaatgcatttttttagaaaagaaagtgcagtctgagagaggtaaagcaacttgctgactgcgctctacctcaggtaagccagcgcacatacaggagaagggtaaaacagggcttgtctgactttcctgtctaagtaccttacctgaggattcccccaagaagtgaagcaacacaaaaactgatatgatttaactattattgactaaatgcatactatatgctaggcaccattctaagtgcattatatccacgtcccattgaatttcttatatggtagattgtactatcatccggattttgcaaatgagaaaactgagattcaagcaggttatgcaagtagcccaaagcctgtgaacaaatacgtggcagagctggagtcgcagatctcccttttgctcattcctttgttcttaagtattcctcttacgcaccagaatggaatcattatatatgctgtatgaaattaaaattgatatatttttcagggttgagatcagttaataaggactggaggaggttttgtggagggagagagcatgtggagggacatgggctgagagctggagagaattcagaaggtagagaggaatgaggagggcattccaagcaaggcgatgtcacagccagtgtgttggagaggaacatgacagattggagggaccacggacagaacagacaagcaagcatctaaatttcaattctgaaggaaatagccagtgattctgtcttattatagcatatacttctccgcttggcaatcataattctcctctagtttcctattaaaagaaagttgtaactgggagacaggcaaatgaaaatcatcctcattcatcaatgttggtttctatagaaactactggtgcggctccatacagaatcctggaatcaaggtcagctagaccatccctagggttagttctgctttgaatattccaggagtgattaaccaacctaaaactacccttaggccaaggctgaaatttgaggtcaggattgctaaagtagatttataaaaacttaacccttcatagcataatgacatgatttaaataattcacatcactcactgattttctgaagataggagaaaggatagtgaaattcattaaaaagatggaaacaaactgaaaattaggaaaagaattagaaagcaaacatgaagtggggcacacacagtaaatgatgcttaataaatatttaaaataatagtctccaatagcaagaggtctagagtgtggcccctggcatccaaccttgctgggttcagatgctgactaggctgccggagaagtgaatacagtaggtcaatgtcttagtcagctcaggctgctatgaaaaatactagaggctgggtggcttcagcagcagatatttatgtctcatagttctggaggatggatgtccaatatcaagatactggcagattctgtgtctggtgaggagggcctgcttctcggttcatagacagtcatcacctctctatacctttacatgaagatgaggcaagaaagccccccgggacttttttttttttttttttttttttgagacagagtcttgatctgtcacccaggctggagtacagtggtgtgatctcagctcactgcaacctcctcctcccaggttcacgctattctcctgcctcagcttcccaagtagctgagattacaggcgtatgccaccacaccccgctaatttttgtattttttagtagagacggagtttcactatatgttggccaggctagtctagaactcctgacctcagttgatccacccgcctcggcctccaaaagtgctgggattagaggtgtgagccactaagccgggccctggggctttttttcttttttttaataggacattaatcctatttctgagaaatctgcccgcatgacctaatcacatcccaaaggcttcatctccatatgccatcccagcggagattggctttcaacatatgaattttagggggcacaaacattcagttcataacaagtagatacatcagttatttaacctccaatgtcctcttctgaatagctagaatacaatcctccttagttacacgttctgttcttgtgggctttccttgtgaagtgggcccttttgagccagaaggagcctggttattctatgtctgagccagaatgagcctggttattctatgtctgctgagtttgtattcccctagagcagaccctaagacaggaattcaagtgcaaggggtttgattgggagataaacggaacagtagtaggtgccagagacaagaaaggaagaaagggcatggcaaaatgggtgctatgagctgatgggggtgaggagaggtggaatgagagccaattcactgggaaatgcgaagggccagtgtacaacacctcacaattacacctcccctcccccgaggtgcagaagttcacattgttcttgggtagagggatgcagccaaggagcaaaaattatcctgcactctgtcctgccacatgatggacaaagagacctccactggaaagagaaacttttccaatgaagaaaggtcagtgctgccttgagaagtccagtgtgctgaagtgccagaatggacaccattttctacccagctcagagcagatcaggcctccagtgtttgctccataaatacccatcaaataatgaccaatgggatgaatgcagcctcaagggatgaatgcagcctcaagcccaggggttcttctcctgggtttttcactataatcagatgaggaattttaaattgcctgatatctaggctccagtgcagaccagttaagtcagattatctgctgtggggtccaagcatcagaatttttaaaagctcaccaaatgattccactatgcagccaggactgaaaattcttgttcaactaacacatgaatcttttctacaaagtccttgacagatggccatgcaagcctctttttgaaactcttcatggggagggactctgctattctcagaagcaaaccattcccgtttttttttttttttttttttttgatggcactaattgttccaattttttttccttactgtgagccaaaacctgcttctgtaccttccatcagtcattcaagctctgcagtttggaaaaatgcaaaatgagtctattccattttgtacatgactgctctttagatattcaaagcctgcaataatgccctaacttgaccttcatttttatgctctaaacgttttcagttccttcagctactgctcttcaacctcctgtaatcattttcatttgccaataccacttttctcctgtggaattctcaactgaatccgtggtctgtgtctgcagttggaaatatacagggcagcaaatgttaaatgaatagcgtgtgtgtgtgtgtgcgcgcgtgtgtggtgtgtgtaaagtgtttaaagtgttatgagtgatcggctgacttaaagtaaacctgctttactaggaaaaaataggatttactaggaaaaaaataagatttcactctttctgttccatctcccaaaatttgttttcttaaacagcatttttctctcttggctaatttgtttgaacacctcagctcttgttttgcttttcagggaaatgtagatatatatttaacatgcataacttgtagaggagagggcgtagaaaaggtttatatttgaggttttttcacccatccgttttttaggagtgctgagccatggaattcatggcctgaaaaacaaaacaaaataaaaatcaataaatttgaaagaaagggagtactgcatctgtgatacttcagggaaagcaattcttaccttaatgaccaagtctattgcaaattctgggggcaagcagttgagcctcttctggacaagtgggatagagcaagcctttgctccactggagataatgtgcgtggccagccaccctcacctcgtataaaacagaagcccagttggccttgcaaagtgcatctaaaaaagggttcagggtgagggtagatttgtgccaattaatgtatcatgttgcagaaaacacagacaaatagagttgacaggtaatcttgatttcgtaaaagggttaaggctttgagaagctcatggtcgactctgaaagaatcttaaagagacagtttggaattccagcaagaccagtgtggagcagcaggagggagagtagagatgacctagggacaagaggaaagacttgaatcgcagggcagtcaatgttcctccagctccactgctgattatcacgctgatctgtggggagtaaaattccctttcaaagccttggcttatggatttgtgaaatgaagatgaatgatcatcatgatgtcaatgttcaaccacagaattgctgtaggaatagcatgagtgaattcctgtgccaggcctggatggcagaccctcaaaaatgtgaacattttgcctatttatttttgttttttttgatacagagtctctctctgttgcccaggctggattgcaatgctgtggtcttggctccctgcaacctccgctttccaggttcacgcgattctcctgtctcagcctcccaagtagctgggactacaaacatgcgccaccatacctggctaattttgtatttttagtagagacggggtttctccatgttggccaggctggtcacctcaccttaggtgatccacccacctcggcctcccaaagtgctgggattacaggcgtgagccaccgtgcccagcccattttgcctaatttttgagagttcacagagctggtagttcgggatcaaacttcagctccaccaatcaccaagtagcatgatctagtgaagtcactgattacctctgtgcctcagtttcctctgtaaaataaggaccataacattacctatcttgtagagttattattaagaccaaatcacctgatagttatggaaagcagatggagcagagcctgatacatagtttgttgcaaaaagagctagctagtaataaaggattctcccctaactgtgttccactagttctaaaacctttggggctctgtttattcaagtgtaaaatgaagaacgtggttaaagtctttgaggattcttaaccttattcttggtatcgcaggatttgcaggttgcaccgtgagtctggtcacatgtctgtctccctcacagccaccctcttcccctgggtagagagaccatgagtttttattttccagtgcctcgttggaaaacaaagactcagcatttgataaatgtttttgaagaaataaatggagtaattcatataaaaattcagtaacacctgttcttttggcattggtgtttggcttctctagtgctctatggagaagaagctgtgttaggctcttggagacaagaaactgaaaggcaaactttgacttttcggtttcctagttttcccaccttatgtttctttttcagtattccatctttatggttcctttactgaaatttcctcacttactttctatcttgtttttctgtagttaaaatttgaatataataattctttttagaagaaagaaggggtccatacaaaaagaaagaaaggaaattccacttctattaaatagtttggagtaagttatgtaacttctttgtgcttaatcattcataatctaaagggcatctataggaggtgcaattagtgaccattcaaaattcctttctgtcttccttcctgccaaaaccacaattttcttcaagaatttcccttcttccacccaactgtgtgctcatgaggagatcccaacctaaccttaacaccaaagtctaggacaatcatggaagtctaatatctctgccaagaactgcctctgacaagtttatatgacaaaattctagcaaagcgaaggatgttcttgccctaaaaggaggtgcttaagaataaacagctcattttattctattggacagccataactctgttcattttgcagctttgaaatgaagatgacatgctgcaaatggtcaagtggaaatatagagagaatgaagggtcttgttaacattggtgggtcactgaattaaacaatcctggagccactgaacctttccttgtttcctgagatgatgaattttcttttctggttaagccagtcaatttggccttttctattactgacaacccaaaaccctcccttggaaaacattatccatagcctagaatgattgaaggagttgatgagataatgtacaatgcctagtacaaccatccctctgtatccatgaaggattggttccaggaccacccacagataccaaaatctgtggatgctcaaattccttatataaaatggcatagtattttcatataacctacgcacatcttccccttttctttaaatcctatctgagtgacttatagtacctaatacttgcgtatgtcacttcagttgcttaaattcaacgtaatactaccatgtgtggccaattcacgttttgccttctggaaatttgtggattttttccccaaatattttcaatttgcaattggttgaatccacggatatagaacccatgaatgtggagggctgactctatttactttttgtgccagacaggttagcatgtccaacaaatgttgatacatttatgatagctttcttttcttgctatgagaggatattttatttgtttctgggttacctaatagttatgttcttgtcctcaaaatagattgttgcctttctaggcatcagattggtgcacttcctcttaccaagacatctcactagggtgaacatttggcatatctttccattaaacctcaagagcgcctggcaggtatgggacaggtgtgctaaaggtacaaggctggtggccagtggagtgcttcacaatagacagaaggaataataagatgccctcgacacccacaggaatcttacagttcaacttctagtctgtcttctttgattaagaatttcttaatggtcatttcaaaccctagggagagaggttatgtgaggtggctttgagagacatttatacttcaggggtttcaacatgcatagtcccttaacagaacaattgcctttattgttgacattgcatatatgacattgtgtgtctcttgggatataaaactcacttaatgtaaaaacatctaacatagttgttttggttgtttctttttattcagatttttttaaaaggtttaggtgatatctcagtttgtgagttgaagctttggaagtattcttgttcttaaaccggaatctgcaaactttttctgtaaagggctagatagtaaatatttctggctttgcaagccatatggtgtctgtcacaactgctcaactctgttgtaatatcaggaaagccatagacaatatgtaaatgaatgagagtgtggctgtgttccaataaaattttatttacaaaaataggtggcaggccagatttggcctgtgggtcatagcttgccagttcttgtttttaatcagtgaaaagatcaatttgaacactttgtcccagttgtcactaaccaactgtgtgaccatgttaagttatttaaccttactaggtcttagtttccttaatctggaaaacaaaagcactggacaaagtgacccctaggtttgcctctacagctaatatgtgaaattctgtgatttcagcatgactcttcaagggtatagctaaaaactaagtaaagatgaataagaaccttgtggtcttgttttgaatacactcaattctgaagtcactatggagtatcaacaaacagcatgtccagctgtattaaaaaatcaaaaattctatgaaattcataagaaaaattgttcatccaagttttaaaggactcgagggataaatgcatttgaagaaggagaataactaggagtactactacttattaagagtcttccaaagactaagcaatattcctgttttttacagatattgtttatccttacacatagcctatgacatagtgtattgtctgtgtacaccagaggaacagactctctcttattatacatgcaggagagaaattataagaaatcgattcacatgattatggaagtcccagtatctgcagtcactaagctggagactcaggagagcagatggtataattctagtctgagtctaaaggtatgagaaccaggaacaatgatagttaaagtttcagtcagatgtcaagtctgaaggtaggagaagaccaaggtcaggcaaagaaagagaatattatttcactcttttataagagtctgttctatttaggccttcagtggattgaataagacattcttgggctaatagagaataagactaatattcccatcatggaaataaagaaatacaaatctacagtggtggaaagaaatgggataacattaaggtgatcagatcaacagtcggagtccctccttctccccaacaataagctctttagtggtagaggcagaaattttaatcctcttctctccagtgttttctgtctttgccttttttttttttaaagttaagagcaatagaccatggcccataagcaataaactatacaaactgagcctgtaggtatacagaatagtggcataattaaataaaacttacaacagagttaatgtgacacacacctaatgatatacataatgcagttttgaagcacggtaattaggtataaaatggtaagctgttgacataaatggctgcaattagtattgcttctgcacaagcaaaccctgtgttaaattttacatttgtcacttggttggttctttgggatttataaataatcatcattgttgacagattttgtaactgaagagtgcaaaactatggaaattcatggccaaagagccatatttatttatttcattttatttgtttccttatattgtttgtttgtactatatcctgccagtttcacaaaggctttggggtcatctgcataaaccatctataatgcaattaaaaaatgcatatacaatgataaacaaaacagcaagatcagaggaaatatcaacgagaaaaggaagtatagataataaaggaggctaacagttaactttgcttcttgtagcaatggctagatgttgataacatctgtgaactgagtgcctaatacatcaatttatttcttattattttaacaaccccgaaaagtagatgtttcatttatattttatagatagggtgagatagatgaaagtatgttgactatgttcattcagccagcaaatgagtggagctgagacgaaaacttggtcttcatgactccaatgtcatagtgcactctactggatataaggagacttggagtgaggtgaggtgagggagatgatggggtttggatttggagaaaataaactttggcttcctagcacctaggaaacagagagaagagaagttggtagccttgcatggcccatgcaaacccaagcactaacaggaaccacatgacagctcctagaggctattagcagtcagcaagcacccagcatttatttaatgatttattgataggaggagatgtttcaaaatgtattaagtatgtgtttgtcaatacactgatatattacttactcatttgagtgtggacccactccttgctgtaaagagtcatctgtattttaaagaaaatgattttgaaagatgataatctctgtgctcattgcaaatgcagatcaaaaaaaagaaaaggacaaaaacaaatgatctctgccctagattaagagaggctaatggtttaatgttctaccacagaccctgaaaattaaaatatgagcatcattaaacagatcttgatgattaaaatttagaaagcttttcagaattcatctgtgaattcaatagaagattatggatgattggaaaatattttataggttcaatgatatttgagacatatttaatcatatcaagacttcaagagttgagaaaacaaagcaaacacaggaaaataataaaaggaaaaaagggtagcagatgcacaccatatgtgtggacatgattgtggcaaagctcattcaacttgaatcctgtgccactcactacctgaaagccttgggcaagctatttactcatctcttatgcatatttctctctgtaaaaatgccacaaggtaaagaataaataatgtagtgcgctttaagttcatgctgccaagcctggcacataataagtactcaataaatgttgggttttttttgttagtaattattgaatgaagtataggacactggagttagaccattattgcatatttaatttatgacagagattgtattgattatttataggtattacttcatttaaacttggtaaaaaaattatgaggcagatcttattatctttacagacagtaaatcaagacaaaaagaggttcagttactcatgtgatgccacaccaagtaaaggtggcagagctggactttacacccacacaaagtccaatgtagctggcttgccacctggttagttttttctcaagtcatccacagtatgcagataaaacccttatcattgatttgggaaagatgacttgggggttaaaataaaggaaacatgattccttctctttatttctgtcctacccccacatgtagtgtgaaatgaagagtgaaaagtagaaatcaagataagggtaagattaaaattttttaaactaggattttatctaaaattaagagaaaaacactaatttttgtctttttgaaaagtaagcttggaattatttagtttctatatgcctatgtgaatcaataactataataatcataataatggcaagcacatcatagaatgtatttcaaggcatgttttttatgcatgccaccatgatttctgctcctctctgcacctcctcatatccctaaacatcattaaccaagtagaaattccaaagacagacagagtcctttgaaagaaattttctctaaagtaaaagtcatcccttgaagttgacaaaaaaggggacctcaagtttctagtgacagtgtacttccaaaatattatgtaactggtacattcttgaaccctttctcctacgaccattaaagacttagaatcatggattcttaaatttgggaaccaactacagggcatatttaatctcatccatcctttcatttcgcaatggtggaaactgaagcctagaaatgagatcatgaggaactggaagtatcagatcaaagcaaatatatcccacccatcagtgtttgatatttgggccacaccacactgaccctccaccccaccaacattgcaatgaggaaggtgacatgctgcctccagccctggagaatagggctatagaaatacctaattcatttatatcaaattgtcatcataggagacccttagaaggaaagcctgtatctacctactgacagagagttttcatttactgcaaatgtcaagatgggattagcatgctttgaggagtcaggcatgggggtgtgaatctgatctacatgaagatgcttcaggacagaaatgctagctctcagggctcctcattttacatgaaattgaacaacaaaaaatgctaactaccttcctcccctaaaggtcaatacaagcaacactggctttgcttgaagtttccattttgaaagcaatgtggtttcctcccttaaatctgcactacaaaaaagttactaccttttgtgacagcccttaagattatatgcctcccccattctcaccttaataactctcctctttcatttcatttctttcaagttaaggaaaggagaaataaaataacatttactcttcttccatgaagaacaaatcttctctttcttttaacttcaattattgcttctgcatgcctctaagaaaaaaaaaagaattaaaacctctcttaacaacattcacaacttgatcattttcattctttgttccaaggtctatgactctgttcttcacttcacttacttagctggagtctatccaaaacattcattttcttacatctgtgtttatccctagtatttgttcttagtggatttcaaaacatgactgttctccttgtgtttctggctctgaaaacactaaaatgcatgccaaatgttagagaatgtacatgcacttttgaagtctttcagccattcattcaaagaggtgtgttcagtgcagacttagacactgttctaagcaacgctgccatgaacacgcaatactcctgccttcatggaacttacagtaagggatgcaggcagtaagaataataaatctgaataatttacagcaagtacatggagcggtgcagtgactggctatctcctcaaggcatgtgccattgattaagacacaacccccaaaactccccattgctttcacacccagcctgctcattcatagatagattataatataatttcagatagctgtaagtgacaaagagagaaataaacccagctaagtgcagagactctgttttatatgtatatatacttttctttcctcctgaaataatatctctttgaggaagtgacatttgaacagacacctaaataaggtgaaaaagtaaggttttggagaagaaaattctaagtggaggggaagtccatgacactaaaacacctttgatttattggacaatctgctagaacactaaagtgattggaaatacggaagagaaaggcagaaagggagaagagagaggccaaggacagattacacagggccacgtaaatcacataaggaaatgtggatttcattctaagcataatcataagacactggaggcttttgggtaggggtttaaatgaggccgtttcaatattcacctcacctaggtaactctgtagagggtagatctcagctggggaaggaaaaatcaggttttgtcttaagctactggatgggtggctggcaggactgggtagcatgtttgtgcagggaaatggggaacctgcagactttatgacacattgtggtggagcaggtagaacacaagccctggagccagccagagaagggcttgatcctcaggttgtaatctatctgggctgacttaatgtctgtgtacatgtggataaagagcttgatctcaactgtgaagtgtggacactgttgcctaccctgcagtggtgttaggagttatcaggtgatgatataaacagagtttctaacagggcagctaatgtgttcatagtcaaagccacagtcttttgagtcagaccaggatttgaatcccagcttaattagtcactttgcttggtagaggagtttgtgcagtaggtaaatctcagaggtcctttctcctcttctgcagaatttgtagaatgatatccatttcacacgattgttttgagaattaaaaccatgtgtggaagcacctaagacacaatggatgcaatttagtagctgccgcaaggttttgaactggttcccttaacctctctttgccacggtttctccttctgtgaaatggaaacgtctgatatgtttgtgaagatcaaataagaaaacatatgtgtagtgtttaccagaatgcctggcacgcactttatgttaaaaacaatgtagggtgatgtcatgaacatcaccagcaggacctttctctcacctcccctgctccaagcacatgaaacacatttcacatcaaagaccaagtttctgaatggcttgaggtgctcaggctgaagaatgcctgcaatcctctatctctgcttttaagtcaccaaacatggaggggtagcatattctagggtaaaagacattagacagaatctggagggatctgtccctgcctctacgattaaaaatcagaaattttccacataaaacccccagattgctgacttggctttggtagaaatctgaatgttttacaacaagtacatggagcggcgcagtgaccggctctctccacaaggcatgtgccattcatttagacacaacccccaaaactcctcattgctttcacacccagcccgctcattcatccttgttgcttaatgagtatgcagaggattgtgagtgtgaaatcgtggctgactctaagacagaatatcatctagacctggagactctccagacttccagatcccagaattcatgttttctggtagaaacatgaatactaataatgcagacaaaattcttgaaacagccaaatgttgggtctgtgatttgcctgctctggttcattagccatcgttcctatggcttcacatctgggagtctgtaaacaggccatgggctgaatgacacggactgttgttttgtttaaaacgaatggctgtaatcctgattaaagcatcatgtgggagattttataataataattatctgtagttcccattagagccagcaggaatctgaatcacatttaataatctaaagcttggaagtagtgacacttaagtacattgagatttaagtatagggattccaagaatgaggaagtgggtattgctgctctctagccttgattaagtctctaactgtcagatcagcttagactagttgatactaaaaccttctctggtagatcattcagctacttattgtcaattttctgttataccttgttctcttattgacttccacttttacttattcttaatggtggtggcagctctattattgtgccaataattcaagctaattaacagaaaccaccaaaagaaagatctctactatttccagttccttaggtttccttccatgcagtgatggccaccagagggaacaaatcagacaattaggctttatgattagaacatttatatgaacaaagactaacatgtcattggcagagattaggagtctgcagaatccaagaagtccccaagctacagactcaatcctttctctttgtcctttgataaaacttcctcaaatccatctccaagccttcccccaagatggagcccacaggattatatctaaggcctctgcccacagagtgaatgccaatgcaccccttccctttttttcttctttaatgaccttaactcttgtatatatgaatataaaacactcttcattcttctcatttttgtatatattttttgtcctgtcgtcttctctaacttctccaacttaacaaattctcttctgtaaactatgtctcagatatctctctctttcaaacaaaagactaataatccatactcagggacactttaactgttggtatttcttcccacctgaagactttacttttaagtgatgttctcatgtttgggaaaaccacacataattcattaaaacatgttgcttctgctcctcaacacaagttttaggggtgatctctatttaatgtattttcacatgtgactgtagccttaaaaccataagagattaataataaagtttcttttacactccagggtcagtttttacttggcaatattaactccacttatcaccaggagttgtcaagtaaaacaaaacaattttgtaaaagggttctcacttttctcaacactgcataaaaattcttgaaaaaaacacttttctcactgtgttttttgttttttaaagcaaaaaagcaaggtagcaggtttaatggggaaaaactgatttcactaccgtgtactctccctagtattctgaaaataattgtggggcaatggagaacagattgtctcttcacatctcttgttaggcagggaacctgtctagacagcaatcttaaggacagctgagctgcttcctgcagggtcatagctactctgcagtgtgagagggccagcccagtatgctttcaagagcccaggaaaggtcacatatacaaagaactaccttccccttcctgtgctgattcttcatgcctgaaatctgttgaagaaagacaagtaggatcccaagtggtgcaaggctgaggcaggaagccaaaccaaaataaagaaagggagggagtaccagaggagacagaaggaaatgtagggaggaagagaagaaagagagccaggaaggaggcacgtttttattccaatgcttttcagatttttctggatgtatgacccaggataagtcagttccttactataaaagaggaagaagggcacaagcctcatgaaactgttgtgaggattaaacaaggtcttgctataggaaacacatcaatgtattagttaacgtgataaatggtttccttcccctctcatgattacatttttcaactgtaaattattaattctatcagggaacagaaaactggcgctctgtgtttataagtccacactatagcatagatgggtatctctgatcatttcctaacaaattatcttaggaaggtgagcaagcaaggtaaagagtctgcccggacgttggactgttagagagcagaaggtaaagctttatcgtgctaatgcatatttttcaactttcagtattttcttagcatgggttttattagtttggcagtgatagtggcaagcataagctcaatgtcccttcacccaaatgactccatttgtcggacaaaaagttcttcatcttgtaaacattcagatggatgttaagaaagagttggagcaaacctgctccgatgtggttggaggaagaaaaaggtacgttacaaaatatccccttaatactttcaaatatctgcaagaatctcatttggggattagacctggcctcaacagaaagaagaacaaaacaggaaagcaaatggaattgtttagcaccatttatattttaagacattaacatatgtcatccgtgatctcagatcttctgtataaaaatatagagtaaaaaaaataaaattaccaatggctattaatgttattacatcattactatttattgaaatttttttctcaccaaaacaaagctaagcatttatatattaatacatactgtcaattgaggatttgacctatctgcgtggaactttggagttgatgtaaactttaaaaaaattcactccatctgaccatccctacctctgacatagcacacctgacagccatcatactccttagatggaatccaaagattctacctcttccttgaatcacgatgcccacttagaatcagtaggctagctatttctattcggagcactgcctccatgttttgtttcttgatgctgcttcttttttttttgttcaattcacaaacctgtcttctttcccactggactggatcttatccttcacagccctcatgcatacttagagaatagcatggggcaaaactgaagagaaccagagggctgctttttcttttcatatctcttgtggtggcattggggttcttattggcctgggttagggactggctcggggatgttggacatgaaggctttgatgatgctctgcgcagctatccactcactcaaaggacaaatggacaaaagcagaatctgattcatccattaaaaaaattgattttgaggatgatgaagaaacacaataaagaaaaaaggaaaaacggttccttctgaaagaaaactttagtatgggcaaagttcctgtaaaggctcttgagttatgaatagaaaccgcaaagacttgacatttattgtgaactttcaaggaatgctggacaaaatgtgattcatttttagaaaagtaataaatcgtaatgcaatggtgcacttccagcaaaacccactggaaaactccatttctaagattgaagaaccctatcctgttggatttataatgcttcaaaaatgaaaatatgatgcccaattattaattattattgtttgtttgtttaaggtacagaacaaagtgagggcatatttaaggctcttagactcagacttagcatgtgacttccctaacatgaagggagcagtgtgaaggcagtagcccctggttctaagagccagcatcatctgcatagagcaaaggtccaacaattgatcttatccttcagagccttactcttccacatgcataatgcgagggtagccttccaccaccccacatagatgtgtcttgtccttctcttcatgtgggaaaagaaaatgggtaaagaccaggagtagcctcagtatagactgcacctacagctaaaaccaaacagactcaactgtatatttagggaaatgggctatatattcatctccaggagagagaagaggcagcatgacttagaaaagcagggtaatcatctacaacaggaccactaaaggatgacacaggatctgaggacaagaactgaaagaataaagagaggcaggcagcatatggtgatagttatgaagaaatccactttcagacattatgtcttaaatatatatatatatgtttttgtttttgtttttcctgaaagggcattgggttgacttctgcttcagtcactgacataacctttgcttttctttctgagagttaccttgggagcagcccaatatggatttgacttgttcatttggcatgatttagtacctgagttagcttttcagaaatcttgccagtattagcattgtgtgcagatgcttctcagatgagtggcgtcttgggacatcagcagagatggtgctattaaatcacacagccagtgtcctctgccattctatgaaaggcaggcaagagtgccgcagcttcccgatgcctccagataaactacagggccttttaaggagtgccctgggtaagctaccacggtggtgaggtgcatttgggtaagtgtgatagagacagccaaggtggcggccatgggccacggtgagctgtgtcagcctttcccattgcatatggctgcctggctgcctctatggtgaaaggtaactgtgggtagtagaaaaatgattggtgaaaagagaacaggaataggaaaagggcagaaaatgcccaccgagacaggtaattggggaagaacaaatagacagagggagtggaaagaccgtgttcacagaccccatggcacatcccttctagctgtgtgaccttgcaccagttaccctggcttccatatctcttacgtaggaaacccaacaggctcttgtggctgtgttctgatccattagccatttgagaagcccctaacttcctttcccatcttctctaccctgccatgtaggttgattttattttttattcatttctaagttgctgagaactatagtaacaaccccatatggctgtcactcagatagaaagaaggttattgctttttcaaaacaggatagagttacagcagcgatataaaatgttggctttcatcgagtaatttcagatgtcctgttggctctcctgtcctctgcaaatgctctttctctgttcactggccggaagctgcttcgtgtccttcagcaaggtcagagaaaggagctgaagtatattttctgctagatattgaacacacaaattatggtaccccatttggccagccacaaaatgcccttgcctcgtttttgatcactggggtgccagcacaacagtatcaccacaaaccctcagcacgttgctaatttgagctgttctcttgatatgatggcagctcctggatgggcaccaagagtcataagaaggcagaggaatggtcagattggctatgtgagcagccatcaccagagtccttggggtcatcctgcgagctgaagtccttggcggccacattttgcaaattatttctgtctttaactcagactcttggctttctcctatctctggtgttgggaattgactatttcctcagagtcaaggtctatctactagagcaaagggcaaggtgtcctagccattctgggcattcagtaaaggccaagcttttttttgtacacagagtaaatacagacacacagctctctgaggaaaatggtccagaaaggatttctgtcagccaaatttggttatgttttaggttctttatcagcaaataggaatactatgactcccttcctcacttagatgtaagccagtctctttcggccagcttattagctcagaggctatcttcatttgtccttgtgtactcaaaggctggccataggacctactcatgaatgacaccaaaatgctgaatgatttaggaattaaggctttaacatttctatttacttttctctgtcagtatttaatgaaatgcagttttcatttcttttagactttcatagtttccatatccctcatgcctatatttaaaataaattatgtagagaaaggctgcatttttccttttgaaatagcagtgaaatttgtaggaattcttgagagtaccaagaaatatatccacatgaagatggatgtgataattaacttggtataagtcattgttaaataactactaaaatattttttatttttttaaataactactaaaatatatttgtctgattataaaagtgagacgtgctcagtttagaaatttctaaattccaaaaacttagaaaatatgaaacacttgtaattaaatcagtgagtaatattgacttttaatatttttgatatcatggtccttttctctttttctttctttcttttgagacatggcctcactctatcacccaggctagaatgcattggccgagtctgggctcactgccacctctgaccccggggatcaagggatccttctgcctcagccttcccagtagctgggtctgcaggcatgcaccatcatgcccagcatttttttagtatttttagtacagacaggatctcgccatgttgctcaagctgatctcgaacttctgagctctagcaatctgtccttcttgacctcccaaagtgccgggattacaggtgtgagccatggcacccggcagtatcatggtctttactttggtatgtttgtaaatgcttgctctctctctggctctctctctctctctgtgtgtgtgtgtgtgtgtgtgtacatgtgtatgtgtgtgtgcataaattgtttgcacagtaatatatacagggcacctcacttttttgcactctgctttatttcactttgaagatattatactttttaaaaattgaatgtttttggaaaccctgaaatgagcaatctattggcaccacctttccaatagcatgtgcttatttcttgttttcattacatattggtaattctcacacatttttcacacagttattattataactgttatggtgacctgtgaccagtgatctttaatgttagttatccttttccttgtttcagggcaccaaaagtgcacctctataagacagcaaacataagtgataagtgttgtgtgttatgactactccactgatgggccattcccctatctcactccctctccttgggcctccttattgcctgacacacaacaataaatattgaaaatagaacaactaataaccatgcaatagcctctcagtactcaagtgaaaggaagatttgcacctctctcactttaagtcaaagctagaaatgttcaagcttagcaagggagacaagacaaaagccaagacaagctgaggcctaggcctcttgtaccagttagctaagttctgagtgtgaagaaaaagttcctgaaggaaattaaaagtgctacctcagtgagcccacaaatgataagaatgcaaaacagcctcgaaaatgttagtagtctggacagatgatcaaaccaaccacagcattttcttaagcagtagccccatctagagaaaagccttaactcctttccattctgtaatggctgaaagaggagagaaagcttcagaagaaatatctgaaactagcacagctctgcttatgaggtttaaggaaagaaactgtctccataacatacaagtgcaaagtaaagcagtaagtgctaatgtagaatttgcagggaattatccagaagatctagatgacatcactgatgaaggtggctacactaaacagattttcaatgtagacaaaacagcctttcttttggaagagaatgtgatctaggactttcatagctagagaggagaagtcaatgcctattttcaaagcttcacagaacaggctctttctaggggttcatgcctctggtgtcttaacattgaaaccaatgctcatttaccattctgaaaattctagggcccttaagaagtatgctgatataatctacttgtgcctcataaatggaacaacaaaacctgaatggcagcacatctatctatagcatgatttcctgaatatgttgagcccactgttgagatttactgctcaggaaaaaaaaaaaaaaagattcatttcaaaatattactgctcattgacaatgcacctggttacccaagatctctgataaaaatgttcaaggaagttagtgtgttttcatgtctgctaacacaacatccattctgcagcccatggatcaagtagtaattttgactttcaagtcttattatttaaaaaatacgtgttgtaaggctatagctgccagttagtggttcttctgatggatctgggtagagtaaattgaaaactttctggagaggattcactattctagatgccactaataacatctgtgattcaaaaaggaggtaaaaatatcaacattaacaggagtttagaagaagttgattccaaccctgatggatgaatttgagagattcagcagagaaagtaactatagatgtggtggaaagagctagagaaatagaactaaaagtggaacctgaagatgtgactgaattgctgcaatttcatgatagactctaaagtgtgagacgttgctacttatggatgagcaaaaaaagtgattgcttgagatggcatccactcctggtgaagaggctgtgaacattgttgaaatgacagcaaagaatttagaatatgaatttgagaggatttactcaaattttgaaaaacgttctactttggataaaaggctatcaaagagcatcacatgctacagaaatatctttcatgaaaggaagagtcaatccatgtggcaaacttcattgttgtcctattttaagaaattgccacagccatcctaatcttcaacaaccaacaccctgatcagtcagcagccaacaacactgaggcaagaccctccaccagcaaaaacgttatgacttgctgaaggctcaggtgatcattagcattttttaacaataaaatatgtttaattaaagtaagtacattttttttagacataatgttatgcacacttaataaactatagtgcaaacaacttttatatgcactaggaaaccaaaaaatgtgtatgattatctttattgcaatatttgctttacttaaatggtctggaacaagacttgcaatatttctaagttatgtctgtatgggcatgtatacatcacacaagtgggatctacacatacatatgtatgtatagaagcttacatatatataatttagcaccctacttttgttcaacattaatttacattatgatctttcccttgtcattaaatgctccacaaaagtttgattgaattaattaatttatttttaatggcttttatactcttttattccttataatttttttgccaaataatatccgtatattctcctgtgatcttttttataatttcaacttttattttagattcatggggtacacgtacaagtttgttacatgggtatattgcacgatacttaggtttggggtacatatggttccatcacccgggtagtgagcatagtacccaataggtagtttttcagcccttgcccccacccaagtagtccccattctctattgttctcatctttatggacaccacacccaatgtttagcccccacttataagtgagaatacgcagtatttggttttctgttcccatgttaatttgcttaagatgatggcttccagctacatccatgttgctgcagaggacatggctttattcatttttatggctgcaaaatattccattgtgtatatgtaccacatttgtaacacattttctttatgcagtccacaactgatgggcacctaggttgatttcatgtctttgctattgtgaacagtgctacaatgaatatactagtgcctgtgtctttttggcagagcaatttgttctcatttgggtctatatgtggtaataggattactgggtcatgtgtgaattttcactcttataaattaaaatgtggaaacgaacacactagtttggtagtccttgtggctgaaaatactgagtccacaggagagctccaaagtttgctatgttctttgcttccccatttccaggatctttctcctcctttctaatgtcttccttgttctccatgtccctggtctaaagaagtgatggcacatgctgtgcgtgctccctagacttcagttcccttaaaacatggcaaatgaccattaagtaagaggagacaataccactatttcacatctcattctgggggaacatgaattaatttctatggatgaaataaagagaaggaaagccatttactgaacttgatgatgaaagattgtcaaagtaggaaactcagagctctgaagcagtcctccttctaagggtcttgtcacctttacatcaggaagcactcaattggatagtataggggccaagggaaaatttccccattgcctctgaaaggtagctgaaaatcactgtcagaaggcagattaataggaagaaaggcatacaaatttacttgattatagttttacatgacacaggagccttcagagtgaagagctgaaaatacaagagaaactccacttttgtgcttaggttcagtgaagtttggacagttctccaaactttgattggacaaatagagtatgatctaatgtttacagactgagagggaaaaacagacaagcattgtctgtctagcttcttctctgactctgagcagcattccttctttctgggcatggggcagaactttctctggaagggggatcttatgacctaaaatcagacaaagtagatcagataatgtctttgttattgctggttttttttttttttttttttacatggcgtttctctcttgttgcccagggcggagtgcaatggcatgatcttggcccactgcaacttctgcctcctgggttcaagcaattatcttgcctcagcctcccaaacagctggaacgacaggccatgcatcaccatgcctggctaatttttttttatttctagtagagatgaggtttcaccattttggccaggctactctcaaactcctgacctcaggtgatccgctcgccttggcctcccagattgatgggactataggtgtgaatcaccacaactggctcagataatgtctttatggccagtttttacacagaaaggcgggaggaaagttagagtaatatttttaggttttatggttggctttgggaaaaaggggttttagcttctgtggctagccccaggggagaatgaggggccagagacaggagggtcggagaaggtcagagaaaatcttttgtttctgagaccttcattttgggatatcatttttctgagctccaacaacgggcagacagctatttatttacttccaaaacaacttctgggttctctatcagaaagtgtgatgagaaaacagaagctattaggtagaacaggtctggactcaaatcctgactcttgtatctgaaacgttatatatctagatatgccatttcttccctttccatgtgtcctaatctgtcctaatctaaaaagtggcaaaaatcccctatttatgttggtggcttggagaaacagatacatgaatgtatgagcaatgctgggcatgttttagatatttttaatcaatgctcattctgtgtgtgcgcacgcacacaaagcacacacaaacacacttctcgcagaacctcatagcaaggagatatttggggtaaatgctgtaatgtacctacagagatagttttaacagctcttcctgctttctatatcaggtttttgtttgtttggttggttattttttgtttgttttgtttatggtttacttttttttttttttgaaacagagtttcgctctgttgcctaggctggagtgcagtggcatggtctcgtctcactgcaacctctgcctcctgggttcaagcaattctcctgcctcagtctctcaagtagctgggattacaggcacccacaaccacgcctagctaatttttgtatttttagtagagacagagttttactatgttggccaggctggtctcgaactcctgaccttacgtgatccacccgcctcggcctcccaaagtgctgggattacagacctgagccaccatgcccagccaatggtttacttttttattgtttgtgttcttcagcatcccttcttgtcaactcctgggttattgcacatactaagcaactatcttttctcagtgatgtatttctttcagttgaactcactgtacgtgtagaaattaacaccctcatttacccaggcatccgctaggctataaaatcaattcctttattattccttgctgtctaattcctctatcttttgaatagaagtgttgctttccactagaccttatccaagttcttaatattatcattcagtttctaggactacaagctaggctgagcactctaattatagtctaaccaacctgatcaaaatttgggaattaattggtagttcctacatgctgagatctcccatagtaatttcaatgtttttgtttaatgttttatttaatgctttgtttaatgctttagtctgcttttggaaaccactatttagcttgtgttccattaagactaccgagtcaactttgatctcagttcctcagaggtagtgctcattctccaccttggaactgaagtgtttttgttgtgatggtgatggtggcagttgaatttttggttttggactttttttaaagaacttctaagttcaccttttaagattttcacatttatcctgcttgaactctagatagtgtgctcattatcacagacttcatatagcctgtaaatagatagcaacagcaatagtttgaatatgaatacaatacttgtgaaaagctctctgatttttatttgttatttatttatttatttatttatttatttatttatttatttatttattttgtgtgtgtgtgagagacagagtcttgctctgtcacccaggctggagtgcattgcatttttagagctctttcaagaaaggctgtattgatattagtgtttcacccactcactcccattccataccccacccagcccgtgaccctggctttgcattctcatgtacctgcactcattctctaacttcagctgcttattattattattttttttaattttgatatggagtcttgctctgtggcccaggctggagtacagcagtagcgtgatctcagctccctgcaacttctgcctcccaggttcaagcaattctcctgccttagcctcctgagtagctgggattacaggcatgtgccaccatgcccggctaatttttgtattttttgtagagacgaggttttgccatgttggccaggctggtctcgaactcctgaccttaggtgatctgcccgccttgacctcttaaagtgctgggattacaggcgtgaagcatcatgcccggcctaacttcagttattggtactgaacacatcaattttgcttaggaaaaggtatgaaggctttctttgattttattctccttccttttttaaaaaatcacaaaacaacaaagttagagctttttcttagagtgattacattattgtatgatgctgcattctaccaaaccagagcaatcatcattcaagatgaaaatgcttcctttaattatatgaaatgtcagtctgcaagttgcacggcatggaaggggttgggttattccaaatcaccaaaagacaaatgtatttacaacttctattaaaatcctaaccctgtagctttaacaaaattaacaggatttcgatgcattcctggtaagtttgacttataaatttcaattcttggcccccatgccaaagcttgatgctgctcatctgcttctttctgctccccgaagatagagctatttcaggagacacgttttgtatttccatcaaaaccagggagagcttcattaaaaaataaacccatgattcttttccattttttttttctacctaggtaatttgggtaattccacagtgaatgaaagagatgaaaagatgtgatttaagacacattaaggatgtaaatatatacaaaaatttggcttcttgtctcttctccaacaattaatttcatgaaagtgttttctggtggcttacaaacaatgcatgaacatgcacaatggtctttgacaggatgtcaaagagcctgcatggctgagatgacttccatcacagaaaatcaatttcctgtaaatagtgaagaagcaaagattttaggccaacatcagatatgattctcgagaatctatttcctgcttgttttctggaagcgcttggtggaaatttgaaatagatattttgccccatcaattaatttcttattttttcatcatcatcagaaatatcaaagttaatattttatcaatattttagaccccattttgttccaacagtacattcaatacagttaaaaaataaatattgagtgtttcctgtttgcaatctgaatatacatataaatgctagtgagaaatgaagaaaataaagattcagtaaccaaagcctaaatctacataaattgaaaataaaatgataagtttagaaatatttagataaggttaaaattgcatataaattcaagatgagttttattatgactcattataactaattccaacagttgatagaaatcatttaaagaattgtaatactgtttggtaatatgttatgtggaaacatagttaggaaatctttccacttcctcagtctggatttcaggaaatgaaagcccccccaatctccccccaaataattcaagctctgctgtgtaagttataggaaataccctcccctgccagctcatttcctcttattgttcaccttgaatggggccctcagctaccttttcatgcctccctctccctacagatgtatcaagcctggtaaaagccaagggcttccacaggaaaagagctaggtcagagatacccaaggccaccatgaagtccccttctgtaagagaatgtgaaggggagtttgagaaaagccagaatttaaaaaaaaaaaattctagccagtcaactcatttagaccaatacattaacaagaaaaggaaccaagtttcttctgtgttcacattttcgatgtaattttgtatttaattccatctaaatattaattttatagttatattgcatattttataaaatgttagatatttatttgaataactatagtaattaggatagtactttgccttgaagactcaataaataattgtagaattaattaaagtatgtaagaatttttgtgttcgtaagagtgattttatgtttctgcatcaaaattatattgagtaggagtttcttttttgtatataatcaagctgtagcaacatagtatattaagcatcataaagatattctaggaatataaattacctatgtgcaaataaccctatattcaggttttccttttttttttacatttttaaaattatttctttctttctagctagctgcctatctcctggtatatttttattctatatctaatgaaactagttgatctagctaacaggttaagtggataaagtgtcccattgaattacatgaaaattgttctgcactaactgagaaaggcttacttccagccctggctctgatcttcactgtatgtatgtacttgagcaagtcatttcgttttatgtgtgctatttcttccttaactaacaaatagaaatcatgtatctcctgcctgcatcactggctaaggtgaagatcaactaagattataaatgcgctctgagatgtagaaaatgctatatatttataagatggtatcatttgtacaatgatgatgatggtattaattatgtgacagactaatctttaatatacacagcaggattttctcttttaccctttcaatcctgatttaattgatagctatttctggatctaagatatgttgagattcaaagctggcactgggacagagggaatgtcatgattccaaaatgtattagacataaagtcatccaaacagctataatatgtagagttttgttttgactcatacaagtttaattatctgtaatttaagaaaagtggctttaatactaactacttacaaatataatttcttctcacaataatcagaattgggagcgcacttttagccattacattaatctagttttcctttgtgacagaaaactatatatgtgtccgttccttatttatccttcatatgaatattgtttatcagcactggaaatctcaccctcacatcctcttcaaatgaaatatgaaaaaatgattagtctacacacaggcactcctccttaaatataatgctaggtgaatttacaaacagttatctcaatgaattatcaaaatatttctaacaagggattgattgtcccaattttacggatgacaaaactgagactcaggaagcggaagtaacttgccaaagctcacacagtatgtctagaatactaaaaccttgtatcgatcaagacgagcatgttgacctatgcacaaggaagctttgaaatctagttcatcattgacaaatccggtgaaaattaatcttttagtctcatccttcctcttcctaatcttcttatgagactgtatgtttctatttaagtatttttcagctacttaactgtgtccactaaaattctccaatgtttttacaagttccaagcatttgtcatataacatttcactcatatttttgcatttaggtcgttctttgtctccaaggtattaggttttcttgccattcatcttctgcctgtgtctttagtacccatgaagctaccttggctctgctgtttctctccttttaatcagaagatttgttccattttgttccataccagccaagttatttcactattacatttctgaatctttcatgcttacagtttgccttccttaccaaggagcctctgcttatgacagcatttttcttcttcattctcacaagtagcaagtaaatagcaaataaatccttcaacatggaagaccctccaccttttgcttatttatttttgtaatttgtaccaaccctttatatttggtgaagatatcacttttatcaggaagactactaggtacattggtatgatttagattcttctctatggacattaattgctatattcctaccacttggctatagtgactggcatttaataaacattccattagtggtagaatacgggagcaatttaatggatgaatgaaatgtgtgtctaaaaatgaggttgcttaaaaaattctgtttctctgattcatgttatagtgttagctccagaagggaatgttctctactaattattttatggtaatcttaaaaacctttaatggttttccatcttaactatttttgataaatagtaaaaatgtctagtttcttttgaaatacattcaagtcttgtgaaaagttgagaatgagatgtatattcaatgtgtcacaatccagtggaattgaacttatgttattgtgcttgtattatattgcacaaggttgaatagcttcctttcaaaaactgtcagacctggcattaatcaatccaatcgaacagtaaactacagtctgtcctttcttatttggcaaacagataaagcacagttaatatatttcattgcaaccctcaggtgttctgtttctaatgtttactttagaaaaggttataatgaagttgacttactttattcatacattcattcaaaacccatttttcagtgtaatgtgccaggaatctctcaaaggctgggagtagagagaagaaagataacgtccacccactcaaggttttcacaatcaagatggggaggaagataagtaggtaattacattcagttggtgcaaaaataatcgcgatttttgccacaaaagtaatagcgaaaaccgcgattacttttgcacgaacctaatagattatgtgattaagtctcagcagataaatgcccagaattttatgacaaaaagtagaagggaaaaccactcaggccaagacatttagaggattccagagggagttctacatttgctaagttgcaactagttgctggtagagtattggggagttcgagggaggtcgaggagtttttgagtgggagagaacagcatgtgccaagacatatacacaagatgggcagaggaagtgtctacaagactgaaagcttattggctgaattatattataggaacattggattcgtatatctgaaagaatggaaggagacaaagctggaaatacaagtgagaattacttcaaaagggaccatatatgcccctccccagctttggggtgggcggagctttgcatggagaagcaatgtgattatattagcatggtgaagcagcacgctggtgtatggttgtcagataaaatatagttacatttcagataaagaatgaatcttttctttcagtatcaacatgtcgcaaatcttgcatgggacatatttacacaaaaaagttattcattgtcaaattgaaattaatctttcactgaacatcctgtatttctctgtgttaaatctgacaaccttactctgatagcagtgtggagaatgaattggagaagaaaggacaaggcagaaaggccgattcaagggacaacctattaaaatctgcattcaccctttgagtcacaatggcattgctatttattacattgtgctaaagtgcaggatgtggacaactttgttaccatggctgagacccagagaggcacagcctgaagagaaagacaatggatattctggaacaaataggagattttagtgctccaggttttacaggagcactggacctaagatggaaccatactttaaactgggaagaagatggcatgtgtgcacatttcctctgaagactgtggggtaaaatcgatactgttgtaataaaacataggaaacaaagacccactgcatttatcctgggtctcaaggagaagtattcaaacatgccccatattcgtgtttgtataatgatttgaacttttcaatttcttcccatactcagtatcttctatctacatcacaatggctttgcagtcaggaaacagttatcattaacccaattgacagataaggatatctgcacatatacacatattctgccttagtttccttattaaaattccttttgcatgtcaaatccaagctgaaactccacattttctaccaaaatgttcagcccacagtttcttctccctgccacttactatgtcagcattactgagccctgcacaaggttcctctctgagaccttgtttggttttggcttgtgaactcatattgccacccactggactgtaagctgccaaaaggcaaggacaaattttagcattttccaggacacttctgtagtatcttagtattaggcgtataaaagactcctaataaatgtttgattatcagactagcagtggaagagccagaaataaattaaaaatctagtatctcaatatgcagccttctgctcttttgggttaccttcatactttttaaaaattttcatcccctgtcaaaccatacagaggtgtgatttcaaggagaatgaagacaacactggaggcccagagttattcagaggatgctttattcatctcccaaactcggtgcaggaatgagcaccagccacactaaagaagagcgtctgtttaaactgcaccatcaggatagggtctaccaatgagatggagttaaggaagctgacagctgactgcaccatccttggctcctcttttatgaaccctcagggtgtgagttcagtcttccccaaccattgctcagcttctttgcttcccagggagggggattgtgagcaggtccctctgcatatcagagttgaatccactaactggttataatccgctcctaactaatgagcagttgctttatgttaatggatatattcaaatatttgtttacttgttagcataggacatacgtgtatactcctataaataagataattgcaaagtacgtttactatgtattgtatagagcagctattctcatggtaaccatgccaacaagtatatcagaacccccggaggatttgctaaaacacagcttgctgggccttagggtcctgagtgggcatgagaatttgaaattttaacaaggtccccaggtgatgctgattgtgtttatccagaaccacacattgagatccatcgatgtagaaaatacagtttcatatttgtctgtgtacgtgctgtgcacacactggcttacatatgaagacatctattctatagttgtgtgttatgtttagacaaaaattactgtaaatatgcttatctgcatagctactcatacatatataaaaatatacaaataaaatgtttactcacaaaagttgtttgtatatgactttaagtctaaataaatgcttatgaaaggttataagcctatataatgttatgtatacaaacacatatgcatgtttgtacatagaaatatagttatatttctaggtgatacttgtgtatgtacatgtgtatagtatcaacgtatctttcccttttacaacaaaggccttattaagtataacatcaaatttaatattttagttaaactcatcatcaaaagcagtgtttaagtgttccaacctgagggcggagatgtctccatgctggccctgttaagctttattagaaggatgatcttttcaatttccctagagcctcttacatatttgctatatttcacatatggaagtgccaaattaaataagcttcatggtctttcagaaccaccagggccctcctataaagtcaaatttcaatcatttcacttctttgccttcctcccaaagagatagtacaattcttctggcatttaactgactaaattaacaaaaatgcagtgcaaactcagtgtgttgagtgctcctgggtcttacatccttcttgtgctaaaagggtctgctttgttcaaaggcaaactttgtctttggaagaggaggaaatgcgagacatgagtttggggcctgacacttaggagggctaaggtagaaacaaaagaaatgaaagcatcagattgaccacatctcctgtgacatacagtacaataacagcttctttcttccctactccacagttcttcaaatgcaatagaagagaaaaaaagagcaacctggaaggaaaaaaagaaaaggtagcaaaaagagatggatatgcattactagtcacttcatttccaagacatgattatgctttggttatatctcatgacatcacattgcaataaatattacccatcatgcataactggtggctgaggtccagaatctttgggtaaactatttaagaactctcaactaaaagtggaagagctagaatttgagctaagatctgcctgatttcagtggttagatccagaagcataaatcagtgctttcctaaaatggtctgcaaggaagagttaaataataaataaaaatccctgggaattcatttaaatatacatgttgcaatggggacaagagaagcaggagaggaccttgtgggcttgaattttgaacgagtaaaataattttgggatatgaaagaggggagacttacatggtgagctgtcaacatcagcatttctcaaaaacaaggtggtgagttgcccaaataggaacttcactggtataaagtctgaggttcatatacttttacatccacagcttttagcaggatgtttgacctgtggtaagttcacagcaaactctcattaaattagttgcctttttagagctgattctgcttcaagttcaacttcccttcctggtcctctgatgactaaaacaattttaccaggggataagatttcatttcaaatccgagataaggttaaatgcaaataatgcagaaaaagaggaaacatattgactcagcacctgggggtataaatgatcaatggtagatcatcttctgatattatggtttattggagagatggagaaggtcactgaagatctgatcagggagtagggatgagcacaaaaatgagagaatctggtggtatcagacaaagtgtgcttatttcactagtttcctggcatctggtcttctgagcagaactgcaacagaggaaaggcaagaaatggctttgggagctgggagaccctgtgcacaaaagccttcctggcagcctttctttccagggtcattgtgcttagactttgttttacatgagaagaagaggtatcaacgattcaccatagaaaacaaaagatcctgaaggtaggaaaaacagtagtaacaaggtttatgaatcagctaaacttgtgtttccccaaatatatttgtttacgatgatcctttaagaagtttggaaatcaagtcctttaacaaaaccaaacgtgattcttaagattatataagttaacagaaacatctatttataaaagaaggaacaaaaagaaagaaggggccgggcgcagtggctcatgcctgtaatcccaggactttgggaggccaaggtgggcggatcatgaggtcaggagatggagaccatcctggtgaacatggagaaaccccgtctctactaaaaatacaaaaaattagccgggcgtggtggcgggcgcctgtagtcccagctacttgggaggctgaggcaggagaatggcgtgaacccaggaggcagagcttgcagtgagccgagatcacgccactgcactccagcctgggtgacagcgagactctgtctcaaaaaaaaaaaaaaaaaaaaaagacaggaacagtgacaaagtgagagagagaaagagagagagacaatgggacagaaagaattagagacggagggttatctcagcaccaggtagaattcagcagtggcatctgacattgtcatgcttcagacattctgccatcatgaaaaattggattaatcataacctaaagggtttcacatctgggtttcttaaacctggcctaaatgagtgaatccaagaccgcatataatgggatttcagtattttgaagattaagtttttcatgaattcttcaaagtttcctcctgccaaacagactgaaataaatcaaaatatttaggaaacacatattctaatcatgagtggcctctagataattaagaattgttatttttaattttagttatttttcaggagagaaatatttgtcaagcaattgtgtcaggcatttttttaggtgttggagatacagcagtaaacaaaacaattaatttctgatcttgtggagcttattttctaacaaagggagataaacaaagtaaatcagtaaaatatgtaatattctgaatacttaatattattgaaagccctcataaagtccatttctaagccttgctagccagaatgactcccggggtcaatgcagaccctgtgaggtttggaggtgtggaggccctgcagcttggcttggtcctcacacacctaccatgcattttattcatcttttgaccctggagaggttccagactactctgagcctcagttgccgcaactttgaattgtgattctgacattaactctgaaagtttttgagcattttataggagataataggtgtgaaagagtgtgaatgtaactcttgatcaagacagccatgcataatcttcattaacataattttaccaatgtcactaactcaaattaaccaaggagaaaaatcccttttatttatggggattttgttttgttttgtttaatagactggacagaggtctacaccttaagaattggcaagacttttgttggcatctattactatagattccacaccttgcagggcttccaggttggtattctaaatataaagtaacaatgggttcatctaaagggcataggggatgaaggtataggagactaagctgctcttagcacatcaacccctcggaaagatggtactgcggagcagagcaggtgccttcatatgcctggccttttctctgcctcccaagtgggctttgaacaagtcttttaacttcactgagtatgtttgcttctgtaaaattggaaacaattaccaactttcctatttgcagagcttgagaattgagttttctctccaaagagaaaagaagatacaaaaccttcatgcttgaattaaaaattacaaccttcatatgttttgctagaccactttttctaagtactcttaagggtgagcttcatctctttttattccataatgtgtatgttattcaaaagatttattgctttggtggtctgaatagggatataagagccactattaggctaacaattggtagcaatgatgtttttgagcaaacttcaagggtagttagagaagtctaacagagtgtgctttatgagctaaacacaataatggatcgtagccaatgctaaaggttccattagggaggaggaggagatgagtgcgtgagtttccacttacacactttttccctgtgtgagttgaggactcaactggcagattttaccacactgatcctgtaggatgcttattagaccaagtctcccaacccaaaaatcagagctaccccagctttacaaacaaccacttcctggtatttcaattaattaaaaatttatgtagaaaaagaaaaccgaaagctcaattaaactactatgatcctagaaaaaagataggaaaatggaaatttctctcatgctatccaattttctgaagctgctgcttctttcttaaaacaggaataagggtgttataagagatgtctatgtcattgataagatcatagatctattaaataatacagttattaaaaacaatatacaagtattacacacatgtatatgcacatatgttgtgtatacatatacctacgtatgtaaattccatgtctgtgggtagtttgttctaagtattttctcaacttttgtttatataaactactgactatgtgttatttaccccggcatgagtttttatcttctcattctctgggaggataccactccatgtgtctattgtttatcttgcaaaagtagatccttctcatctactgaatgataacagtagaagcctggctttttttgagacatattttattggaacaaaagctgtaaatatatacctatgttttcatggattgtgttttatttttattggtgtctttaaggaatttgcatgttcaaatgcaaacaccaataggtatctttgttttctgactaagatctgaaaatgaaattgagtgcacattttatttacccatctcatcaggccaacaaatccatatgacacagatctggttgttcataaactttttggtgtgggatgtttggagaagatctcaaaggatggggattctctgaaccgcttagttgtgtatttcagggtgtactaaccccttttagttttgaacttccacttgcccactatgcttctttaagaggttttgcttgtttggtatttttgccaaacagactttcataaaatatttcttgcaatgaaagccttccattccttgaaattcttgaaaaacttccaaattatatattatatatatatcatatgtatagtcaagttggagaaagagacaagtcagttgccaaatatggcagtgtgcttaggttagatgacagaggcaatcattcgatattaggagagtacagtggaagaacacctaaaacagactggcctggctgggcccagtggctcatgcctgtaatcccagtactttgggaggcccaggcaggtggatcacctgaggtcaggagttgagaccagcctgaccaacatggtgaaacctcatctctactagaaatacaaaaattagctgggcatggtggctcacgcctgtaatcccagctgctcgggaggctgaggcaggagaatctctttaaccctggaggcagagatcgtgccactgcactccagcctgggcaacagagcgagactccatctctgaaaaaaaaaaaagcaaagaaaaagtaaaaagaaaaatacaaaactctccctagcaggctttaaggagctgcagtctcgtgtctccttagtttgagacattcctggaatcctacagaggacctggtgatggggagcctgtgttctttcattcccatgaaaattaactctattgcttaagtgtggagcaggatgctttgtgtcaaacttgcagatccacatgctccatttttcccctgctctggccctgggatcctagactttctcagttgtttttctttctctctggtgtctgtggggctccgtccatgggatgcacaagggcagacaagggcttgggaagagtgggtcagaatgttcgttgtacattccattcttgctctctgctaccacagttggcctcttctccctggagaatgctgtagctcctgcctgtcctgaccttcacaccagctgccccctgcagccctggcacttctttgcccgatcaagtactgcccactgtggctgtctagggtgattcactgtcctgtgggggtttctttccatgctccccatgccctgaggacagtatcttaactctattccccccaaaccatgcgtctgatggtgccagtggcttcctgctgatatccacaactgacattcacatctaataggcatatcagaatcagagtgtcaaaactgaactccacacactctccacctctcagcttctgcatcctctcagctgtggcacctctaaccaaccagttgtctcgctgaaaatctcagatccttctctgacttccctccttctcctgggctactgtcctcaaatcttcgtaaaatgtcatggccacgaggagtcctaccatgaccaccctattgaatattaaacctcatctcttgcttccccaaaaactccttcttctcctggtcttgctgtatttttttctttgtttcttagcatttatcatttacaataggactgccatcaaaattggatggtttaaagctacagaaatgtatctcatttctgaatgctagaatttcaaaatgaaggagtttctacttcctctgaagcctctgagagaggacccttccttatctcttccatttcttggtagcttcaggtcttctctggcttgtggaagccaatccaatttctggctctgttttcgtgtgtttgtgtgtctctgggtcatcacataacattcttcctgtgtgtctgcctctatgtgtccaaatttctctcttcttataaggacaccagtcatactggataaaggcccaccttccttaatggccttagcttagcttaattaaatctgcaaagaccctattttcaaacaaggtcacatttacaggtacttgaagttaggacttcagacttcaatgcctctttttatttaatttgttgagcgggacataattcaacccataacctatagttgacttatttattatgtccactgtttattgtctatctccactagctaagaattagtatttttcagggcagagatctttgtatcttttgttcattgatatatcccaagcatccagggctatgtgggaaaacagtggttgctcaatagatgtctgttaaattgagggaaagtctgaacagcaagctgttttaagattaacgtaaaatggaattttactcagcatggggaagaaatatccctgaagctctaggttggcattcctgattgtgaaaagcaaacaccttgttatgatataaacagataccaaaccactaacgtttcacttggaaaacaatacctcactggacaaggagggagcgaaatttcaccctagtatttcttttctttattctacaattagtttatgaaatgtgaagcatttatttttaagctaactcctgttaaatcttctgaattccagacctgaggtttgactctttagcagatggtagatatgtaccttggagagaaagagagggtggagagggaggagacagagacaggaagtacaagaggggctgccaaacctcagccctggacagacttcagcaaacaaacagaagtgagacccagcaggaccgggtgtgagctggttttattgctgtccaccagctccaggtcataagtgacctaatcaaccttagcttgcatctttcttgcgatagctttgtgcctgttcgctgcacacagctctgattctcactcatcctaggccttggcgggcatatccagagccctttatgggatccaggacacagctgctgcaatatcccttcattccaaatcacctctcaacccctcccccatttattttctctgcgctactgaacatttccaacacttggtataccagcatcctcctcatcccctccccaaatgacttggctatatctcatatccagaaaggccagctatggaggaccacaggtgggagcaaccacccaccatagctattaacaaaactcaaattgcacatagcacaggtataaattaggtcatatatatatatatatatatatatatatatatatatatatatataaatataaataggtgtgctgtatgttcaggtaatgcaatgaggcctgttttctcttttctagaacatgtggtaaactgacaaacatgcatttactggtcatctgtgtgcttcctttagaggccagaaaattattctaaatatttgaaaatggtttacttccaatcaaactagttactaatctgtattatttggaaaaactgaatccacaaaaaaattttgcttagaataattttcttaccttaggttgccacattataacaatgaaataataataatgtaattataatcatataacataatattttatatataaccttatatattataggtaacattacacataatgtagtaacaatatataatacaactatgtgtaatatagaaatacaataccaatagcttcactaatcacacatttatcttctaaaaaaacgtttcttttgaatattggacacaatggtaaaaactaatagatggaaaagggaaaactagaagttatttgcagtgtcccaattcagtaagtaattgctgttatactatataagggatcctgcaaaccaaaaatcataactaaatggaaaactacaccaatagaaaactggccaaatagatcacaagtgctttcagaattaaataaaaaaaaaactcaaaaagcataaaaaacatctaaagagaacctcaatcgtattaaaagtcaagaatgcacgtttgagcaaggatgagaattcactgaacatttattactctggcaaaagcaagaagctgggcaccactgggagtggtatggccgggtgtggccaagctggagagccaggtggcagggagagcagacgtgaccccacagttcctgcagagagcgtgcatcctggagaaattctcacacaggatcctagaggaacactactgagaatactcacttttgtgcttttagaggtgttgagaaatgcagtgaacccccttgcgcagggggctgccaacttcatctataaaaggtctaagagccgtgagccagaggctctcttgcaatactcaacactgtcccacagcaccgacagaagccccatagacatgatgcaaatgagtggacatggctgtgatctaacaaggtgtcatttacaaaatcaggcagtaggctgggtttggcccctactgtagtttgtagtttgtccattcctgtatatcccaattcctttcacacatattaaatacacacacacacacataattcaaaaagctagcaagattaaacataaaatacacataatcatataagaatgatggcttgtggaggatgcagaggggaatggagtgatcaaacagagactaagcaatggtgtggtggggagtgatgaaaatgaacctagaaataaggattgtcctaactcaagattctgtacccagggccaatttcattttttctaagcaaaggcacacaagctatggtttcggatgaggagctataatttgctcctagttttttaagaactgagattctgtgcagagtgctgccaaattgcccacagtgagttagtatgaagcgcgggcctctgatttgatttgatgatgtacctaattgtggctgggaatcacagtactttttggactcattttgagtgccccttttttgtaaaataaatgataccaggtaaaaaatagcagttttttttttcttgatcaggatgtaatgatttaaaaaatgcccaagggaagaagacaattgtcaagctacatgcacaatggcttaaattgttcaagatattacctctgatgaagaagaaatggagctgtcacgcaatgaaagtctgtccctaggtgagaagggctaagggataagcatactacagtggttaaaagcaagggactggagtggattttcaatccacatcctggatcttcacttcacagctacatgatggactctggcagcatccgttatctcatgttacagtaagcatgatatttacctggaagaaatattttgagggttaaatgcccaatttcaaaaataagacgtgtacacagcgattacatgagatactcaggaataacatggtatagtttgtacgattagcaattcctaattattgttgctttccatatttccatgcaaagatagtacactcattatcccatactccttaacagagagatgtctgttgctacaaaagtataacgtatcatatggaatgctaccatgtgttgtcttgaaccccaaggcatctagaaagcatcccacttcccactgtaaacagtcacaaagcattttaaaataggttcatttttaaaagagccatttttagtgaatttgttaattagcaaattagtaaaataccaaagaaacacaccatgatagtcaaagcttacacagggtcacacaggatccctgtctcaaaagtcccgtaacagtctctcatctgcactgtccccaagccctggggaccatgttggcattacatagatgctgcttagcccatttccttgtcttctgcctgcaaggcatgcagtgagcacacaccttctgcaaaacctctaagtgaaacagtaggtggtctggataaatatagtagcatgcatctcgtgtctcaggttcctaaggttcctacatcatacctcaatctttcatatactttccttcacatgttacatgttttatttcttcattctactatcctgtttcagaaaattgcaggaatatataaatatgtataaattatgtataaggtacgaataatcacaaatacatatctatatgcctatgatctcaatttagggaaaataactgccagtatgtgggaatcattccatggatccctccttcctccacctttgcagatcgcatatcctgttgaattttgtgttattaatcctttgattttcttaagaaagttttaccatctacacttctatatttagttttgtgtgattttaaacttcatataaataaattgagttgacttttcaggcaatattattttcttgagttctgttgatactattgcatatagctatagtttattttaagtgctgaatgattttcctttggaataacatacaacagcttatttattttattggatatttgtgttgctttcagttttctgctctaacaagcagatccatcatgaatactttcacacatatcctagcacacatggggaggacacttgtttagagtatttacctagcaatgggatttcttggacatgaggtgtgtatatctttaactttattgaaattatcaaatcattgtccaaatatttgtaccaattcatattttacaaacaatacggcccggcgcagtggctcacgcatgtaatcccagcactttgggagcctgaggcgggcggatcacaaggtcaggagatcgagaccatcctggctaacgtggtgaaaccccgtctctactaaaaatacaaaaaattagccaggagtggtggcgggtgcctgtagtcccagctactcaggaggctgaggcaggagaatggcgtgaacccgggaagcggagcttgcagtgagctgagatcgcgccactgcactccagcctgggtgacagagactctgtctcaaaaaaaaaataataaaaataaaaataataataataataaaacaatacgtaggtattccatttgtattgactctcatcaaaacttcatattgaaagaaaccttggttattgtcaatatggggggtgtgaaatggcatttcatttccactttaatttttatctgtctaagtactaatcaggctttttaaagattgtgagccatttgagtttcttttttttaagtttgtcttcagatattttgaatatttttctactgggccatctgccttctttcaaatcgatttgtagaaattatttatatattctagatgctaatattttgtcagttatatggttgccaaaattatctttcaatctgtggcctagatttttactcccttcttatgtatatacatgtacctatatattacaatatacagaagcgcttagtttttttttcttttccgactttgattttagaatcaagcggtacatgtgcagctttttcatgagtatactgcgtgatgctgaggtttagggcatgattcagcctatcatcctggaagtgagcaaagtacccaataggtagtttttcaacacttaccctcctccctctctccccactctaggagttcccagcgtctattgttcccatctttttgtccacgtgtacccagaagttgttaatttttacataggggaattagtccattattttctgacattttaaattctctgtattttgcttaagaaatagttttttagcttaaagtcataaagacattgtcttacatattttttaggttttttttttcagttttcccttttacaattaaacctttagtctatctggcatgtattattttgtgtctggatgagaagtatgccagatttcttgccacatgatttcttttttttttttttccattaactgtaaattctattcctttcttactggaaaaaaccttgcaggaccaagtctatcataaaccaaattgccatatatcctggggctgtgtctggtagtcttattttgttttatagtggtaatattctatcccatgccaatattcacacggcaattactacagatttctataattccttatatgtaccaaggtatttcttctcattattttcttctttttcaggaatatcttgcatattcttgggtctttcctcttctaaataaactttactattagcttgtcattgttaaagggaagcaaagctggaaggagaaaatgaaaggacagaggaaaaggaattctgagatggggtgtggattgaatttcaatgaattcatagatctatttagggaacatcacaattgcaaactttatggtattgagtctttctaggaaaaaaattatttctatttatttagatcttctaaaaggtctttccagagtattttataattttttcatgtattttgttacatttattccaaggttctttttttttttttttttttgagacggagtttcactcttgttgcccaggctggagtgcaataacatgatctcagctcactgcaacttccgcttcccaggttcaagcgattctcctgcctcagcctcccgagtagctgggattacaggcatgtgccaccacacccagctaattttttatttgtagtagagacggggtttctccatgttggtcaggctggtcttgaactcctgacctcaggtgatgcacctgcctcatccttccaacgagctgggattacaggcatgagccacctcgcctggctggtattctaaagttcttaaagctaccatgaatttccctttttaaaatcaccttttcaattatttatagctggtgtatctaaacacaattaatttttgtacattgattttatgcatagtaacttgataaacacttttcttcattctcataatctctatgtagattgtttagggttttctaaatatacaatcatcacccatgaataatgagagttacacttcctgctttccaatcaacagaaattttctttctttttcttgaatactttgctggctcggacctcatttgcaatgtcaagtgaataatgttcatggtgggcatatctgtctttttcgtgattctaaaacaatctttgcagcatttcatcaataaggggaatgtttgctctagattggcatagacacccttccaatcctaatttgctaaaagtctttgtcaagaacagatgttaagatatttttgttggatactgactttacatctattgaactaatcatattagttatctccttttagctttcaatttggtaaataatattaaatagttttctaatccgaagccatgttttttcatattgaatattgctgaattctctttagaatttactctaaattactgaggtctcttattcatatatatttctttttgagacaccactcattgttatggttttctcaaaacatttcccttttatcttggttttcaaatttattgacataatcttgtttagactaacctcaataacttaaattcctcttcatcttaagtcacaccctattttacttcttctaatatgcttttattttgaattgtggtaaaaaaaaacacttaacatgagatttactcttttaacaaatttttaaatgcacaatacagtattcactaaagtcacaatgttatataaacagatctctaaaacttactcatattgtttcactgaaaaactttatatctgttaaatgataactcctaattctcaatctgtaacctgatttcgaagctgcaggcacttatgtcctgccacgtatttcttactccctacctgtatcctgaaatcccagtccagaggcacaaattgtccacactctggatgcttctccggttgctcatctaatacccaaatactgactgaaacctgggtttcctgcagttttccatcccctcttatagagcccccttgtttgtcttctgtagcagagccatcttcaggccaaatcacctctaagacccatatgtcctctggaggcagcccaagtgatgtcaatatttctctggggatctgtttcaccctaaggaaaaggaggcatcctgctacgtttcattttctctttttgctgggccacccatcacaagtgctaagagttgaagagcagggcttgtaaataagaatttaattactcctcatttctacaattcactcaaacatctggtaccaggcgtggagccctgaagcactgctcgacctgcaggtcacctaataggaactgagaaggacttctctctcagcctggaccactctcaggtacatgcactacttttaaacctagccaaaaagggagagaataaaattgagatgtaacaatgtttaatgattatggaaattgtatcaatcactcagtgagtcagaagacatttgatcttcattgacattcgaaaaagaaggagaagcagcagttacagaatctttacaataagccatatccgttatgtatgatcacatttaatcctcctcaacacaatcatgctaagaaagggtaattctgtcatcttatgtcaaagaaaacaaagcttaggaaaggtaaatagagtattcaagggtatacatctaaaaccctgcttcttttaacacttaacctctccccatggggctcaccattctggtgtacagagtaatgtataaactatcttgtgagaatcacagtatagttggagagacagtaactatcatgttaagcagtaagtgacaggtgcccctgttgtctggttctgaatttggaggagatgcaatcagggagctcaggaatgattaaagaaggaaagcagtatttgaaattgattcagaagatgaggattttgcatatataaatttgttctcaaaagtctatgatacaagcttagagcagcaatatttcaatacattttccacattccatagtaatggttcatcttagtatcaacattggcaaaagttatggactctgttcattagcctcaccattaatattgttttgcttttgctttgtcctcggcccctaagacagtgtttgcgtaatcaaaatctgagtcatatacatattatatgtatattttatacatatacttcataaatcatgtttcaagattattgttacaatgtaaatcagtctgatgctaatttaaatatcaggatatttatgctgtgccctaagttctggaaagcaaacatgaaaaatattagtataagcattttaaactatgtctaaaatcaaggtgaaagaatgtactctatcattttgttatggcccctatagttctgaagtaagtttctcccaatttcctattctcaatattattacttcagtgatcatttaaaatttctgttagaactacaaggaaaatgaattgtgggagtgtcatagcagccccaataaatgtgattcagtggccattctgagaaattttgaaggaaaactttggtttttaaaatgttaactttatcttgggatgtctttagtagtgtaatgttaatgaataaatccatcctgcaggtttgtgagtggtaaacaaccagtcaggttaggttggagagcaggacggggccaacttcaggagtgaagtctgcatacgagcattgtggtagtccgtttttatactgctatgaagaaatacctgcgactgcataatttataaagaaaaagaggtttaatggactcacagttacacatggctgggaagccatcacgatcatggcaaaatgcaaaagaggagtaaagacatgtcttacatggcctcaggcaagagagtgtttgcaggggaacagccctttattagaccattagattttgtgagacttattcactagcacaagaagagcatggaaaaaattcacccccatgattcaattacctcccactgggtccctcctataacacatgggaattatgggagctacaattcaagacgaaatttgagtgaggacacagccagaccacatcattccacccctggccccttccaaatctcatatcctcgcattttaaagccaatcataccttcccaacagtcgcccaaagtcttaactaatttcagcatgatctcaaaagtccacagtccaaagtctcatctgagacaaggcaagtcccttttgcctataaaatcagaagcaacttagttacttcctagatacaaggggaggacaggcattgtgtaaatacacccattgcaaatggaagacattggccaaaacgaaggggttacaggccccatgcaagtccaaaatccagcaggggaatcaaatcgtaaaacttcaaaatgatctcctttgactccatgtctcacatccaggtcatgccagtgaaagaggctgattcccttggtctttggcagctccaccccttgtgactttacagggtacagcaccccctcctggctgctttcatgggctggcattgagtgtttgtgacttttctgggctcatggtgcaagctgttggaggatctaccattctgaggtctggaggaaggtagccctttcctcacagatccactaggaagtgccccagtgggcactctgtgtgggagctccaaccccacattttccttcctcacttccctagcagaagttctccatgagggttctgcccctgcagcacacctctgcctggatatccaggcatttccatacatcctctgaaatctaggcagaggttcccaaacctcaaatcttgacctctgtgcacccacaggtacaacaccagatgtgagctgccaagacttggtgactgcaccctctgaagcaacgatatgagctttacgttggccctttttagccatggttgggatgcggagcaccaagtcctgagactgcacaaagcagcaaggccctgggcccagaccacaaaactattttttccttccaggcctccaggcctgtgatggaatgggctaccatgaagacctctgacatgccctgaagacattttccccattgtcttggccagtaacatttggcgccttgttacttatgcaaatttctgcagctggcttgaatttctcatcaaaaaatgtttttttgttttctatcgcattgtcaggcaggaaattttctgagcttttatgctctgcttccctcttaaacatgggttccaattccaaatcatatctttggaaatgaataaaatggaatgtttttaagagcaccctagtcatgtcttgaaggctttgctgcttagaaatttatcccaccagatgccctaaatcatctctctcaaactcagagttccacagatatctaggacaggggcaaaatgctaccagtctcttcgataagcataacaagattcaccttttctccagtttccaacaagttcctcatcttcatctgagaccacctcagcctggactttaatgtccatatcaccatcagcattttggtcaaagccattcaatgcatctctaggaagttccaaactttcccacattttcctatcttcttctgagccctccgaactgttccaacctctgccagttacccagttccacagttgctttcacatcattctggggtatctttatagcagagcccactacccagtaccaatttactgttttagtccattttcatactgctatgaagaaatactccagactgtgtaatttataaagaaaaagaggtttaatgcactcatagttacatatggctggaaaggcctcacaatcatggtaggaggcaaaggaggagcaaaggtacatcttacatggtggaaggcaagagagcatgtgcaggggaattgccctttataaaaccatcaaatctcatgagacttattcactatcatgagagcagcacaggaaaatcccacccccaccattcaaatacctcccacaggttcctgattatggggagctacaaatcaagatgagctatggggacacagccaaaccatatcaagcatctactgaggcaagaagacaggtagaatctgaaggtctatagccccattttctaggatattcattgaaagccaaagtaaactgctactgaggccaggaagttcactaaaatgtaagggcctagtgatatgtccagactaggaaagaaaattttaattttcaagaaagtcaaagccattagttgtagccctagaactagtgacagtagagtacacccaatcctaagttggaaactggtacggtgtgaccgtgtccccacccaaatatcattttgaattgtagtttccataatacccatgtgtcatggaagacacccagcaggaagtgattgggtcatgggggcggtttcccccatgctgttctcatgacaatgagtgagttctcatgagatctgatggttttataaacatctggcatttcccctgcttgcacttttctctcctgccaccaagtgaagaaggacatgtttgcttcctcttctatcataattgtcagtttcctgaggcctccccagcaatgtggaactgtgtcaattaaagttgttttcttttcttttcttttttttttttttggaaatggagtctcaccctgtctcccaggctggactgcaatggtgccgtctcagctcactgcaacctccgcctcctgggttcaagcgattctcctgcctcagcctcccaagtagctgggactacaggtgtgcaccaccatgcccagctaatttttgtatttttagtagagatggggtttcaccatgttggccagcttgtcttgtgatccgcccacctccacctcccaaaatgctgggattataggcgtaagccaccatacccggccaaaccttttttctttataaatgatccagtctccagtatttcttcagagtagcatgagaatggactaatacagagagaattctcttttttcctctgtgtgttttgctgcctcctttttttctcagcctgcgtgttttggtgtctctggtagatcctgaagatgtagtcatatgtacatgataattttttaacttcttatctaagatctccaaaaagggctcaaatgaagtttccatttggaagttctaaaagtgggcctttagtccctactcggtgatttaaagtttcgtttgagtatattctgatacacatcttgctttgcagagtatatgtagaaatcacttgtatttgtcctaaacattctgaaattgatcccaagattgagaacagatgaatagaatggatcaaccaagtgttctgggcccattctgctggatagtaactaagtgattaatgccaatgggccttgggcagagctagtgccaatcccagcactgtgaccttgagcaagttacttaaatgcactgaggctcagtttctttataaaaccaggtcaataacacctaaccctatgagttaatttatgtgaattgcctgtcccagtggcctattgtctggactcaataattggtatatggtattataatgatggtgatgacagcaacagtgcagatatggcttaccttgcaggacattttgtgatgcaaagggaaacccttgtcaacataatgcgtgtatgaataaccccttattttcctaacctaccatctcctttccctcaaccacagtgttggggcatgtttgccaagctctctttgtgtgctatcacaagggttaggttgattctggaggtctgagtgggccagtgggggcagttgcatgaagtagtaagatgagggatagctagagaagagagaccaccagtgctccaggctcttgatgatctacatgtggttcatgggccagcggcatcagaggcacctaggagcttgaacctaaattataatctacatttttgtaaaggtaattcatgctcacaataaagtttgagaagctctgtcccagggagtaccctagaaaatcaaaagctgtttcctgggtgagtaataggggacagaagcctgatacatgcaggaattacagggagatgaccaaggtaggaattccatcagggtccagttgttttgaaggcacaggttgcaggcagaaaaaaagcactatacagcccaaatattaatagatatgaaacataagcaaacaattgatttttttaacttttcacatatattctgttcaactctgtatggcaaatatgatgtttagtatcaaatggtagccattcacattttcttagtatgctgaatttattcccaagttaaaattccatttaaagaaacgagaatcccttcctaacacatgttacagactttaaagaactagactctgtgacccagttcatcaaaatgcacttgaaaaattctgtctggagctctcagaccaatgctacacattaaagattttattttcttcctcctgtcttttccaaggcttgactcctaaccacttgagatggagctaaagctgacagagaaagtgaaaatcctctgccttcttgcctggaggaaatgcttggcaggagatttccaagctgtgctgtcatcaaagctaaacttaaccttgttcaggaaaagaaccctcaactttcaaaccaactccttgtcagaccattcaatttgcaaagtacaatgttggggggatagaaaaggaaggaaaaatagcaatgaatgcactgatgtttgagattgagacttgaaatgatgactactcatgttttgcaatgacattaaagttaaatgtcttggttcacgggcacttaccactcccttcatcaccattaatctttgctcacagttttgaaatacaccactttgtgtcttcagcaatgaaacgaaattttcccagggttgtaattgctttccggtatgtcttttctcatgttatttgattgctaaaggttttcttcaaaatgggagatatttagtgaacacaatacaatgtattttcctgctatttttaatctgttcatgcataatttgaagggtttggtgagggaaaaatggaaattgaactcatctgaccgtgacagatttgcaaactctaaatacaacttaaactttatcgatgcttttaaattacagcactgaatacctggacatgtccatataacatttatagcattttatgtcttcatagctacagccaacatttgcttaagaatcacaattgtaattcaggatgagcaagaagagcattttacaaggaaaagtagagcatgctgaagtattttgcctggaacaagcttttatttttagcctgtccccaaaaaatcattatctagaggcctgaaatgtctcaaaaaatcattatatttgaatacctggtaggtcatttcatagagtcctgaagaatcctatttaatatcacgtgggtttgttatctggaccacagagcaattgaaggaatgattgtctattgggacctactcttttcctctgacttctgacatgcaaactttctccagtgtacagttttaacaaatggcacaccacactttggtccagcatgttatatccaggattcttattgagttattatgaaaggtggtatttccaaaattcatataaggaactctcaataatttatacttacctccatgtaatacattcaggtcttctttccaatgccttagcttggatacattttgtgagagtaatagcatgtgaaagaatgtcaaaaaccagaggcctgggcttgagatttagccctgagctctgcccatgcccttcccttccagtgagaaaatatctttctagaagagaataaatatagaaagcagagacatccatcatggatcaaagagactagatggtgactggggacaaaccatgccagtttattgtccattcctgacaaataaatagctctcatccccaaaatacaaaaatccagaccaagaggcctagtgataaaatcgggagggagtggtagctactgaaaactaaaaacattctcgtgttacaacaataggatttcaatttattcatgttctaaatatcatttccttactcaaaaatctttacagaggttcacaggatagttataattgcaaagctgtagctatcattaattaagcattttctttgtaccaaccacttttgtctttgttggtggttcatgacaaccctcatttgtcatgacctccccgtgggaaacaggcatcatcatcttcattttccatggaggaatactatatcacagagaaagaaatggatggccccaatttaccaaatcagtcagcagaacaactggatgcacaaggtactgagacccaccgctgtgatgtttccattctatctcacacattcacttctgccatagcttgctcactcatcagacttcaaggccctacacaaccaggctctcctccaaattactagatatatccccaacttgttcggagttttgacttctttacttgcaaaatgagagggtgttggaggctggaacaagtaagtcagagagaagatgcgttgcctacccagttaatactcttatgaccttcatacctgtgcctcctcatctgtcaaatggtcaccatcttggctgtccttcctggctgagatgatttttgcaaagctcaaataaagaaagcatttagaaatcacactcataggacaaatggtaatgacaaatctcatcgatattctctttaagtgctcacaatcttgaacgcacttccctgtgtgacttggaaacataagtcactttactgttgcccacacattttccattttagagacctgtccagtttctattccgatttcttagtcttcatttaagactgtcctccccttatctaaacctctacctaaccaacaagcaattgagcaattctctgtggtcatcactgtgaaatgcagtgaaagtaggaaagtgagtaagatggggcctcaaagagctcaaggacctgtgtgctacaacatcttcaaaataaacacctgtcaccgagctggtcctcctagtggaggtggagtattatacacaaaagaccccataaaggagaaaaggaatttcttgcctggagagatcaaggaaggctatggagtatttacatcccgtgcagtaagtgcattgttgatgagtgagcaagtggaaggtgatgtgcgggcattcaagacagagtcaaatataaacacagccaataaattggcaaatccaagcacagattgagaaataagcggtgccagaagattaaataatccagagtttgatcatgaagggatatatagaagcaaggaactaaaattttattctgaaggcatgggagactagtgaactcaggtcagtcatctttcttatttcctgaatatggaattcattgctcacctgtctttgggtaattaaaaaccatcaccttatgacatattatgacttgccatctgaatataaatatatggtttttagtcttgtgacactttttattatatttatctaaaagaaagacgagaagctttaaatatgatttggaagtcatctaaatgtgggaccatttatcacctcttttctgcatgatataaagatatgttaattttagaaattgatttgtgagcttcccagttcttcaggataacaaaatagattgtcaatagacctagaaatattgaactaattatttattcttaccttcctttttgtgcaccaggtcatgatgattccaatatggtatgtctaaagttacataactctgtccattccaattgtcattgttttagttcaggctaccattattatatatatattcttttactattctaaatcccctgattgggtcttgttagcacagtctcttaccctcaattctctatccccatctccacccaagacatttttccatatagaaattgaagcaaactttctaaaatactaattgctgtgactctcttgcccaaaacagtatttccttgtttttatttcattttgtttttaaactattttgattcctactgcctgtataagtgcagaatttccttctttttaagtttataatcttcaaaacatgagcttgggaggccctattttaacatattcgcattttaaaaataaattatatatatgaacttgaatgaaattcaaacattttctccagccagctgtcccaacctgcctcatcccttgaaaagttatatgaggtccatgctttctgttccctttaagagtcaccaggttatgtatcagatagcatgatacatgatgcctgggacactgtacttaaaaaatatttgttgaatataagaaaaatgtgataaaacctaaaaagtatactatgtttggtcttggagcataagtaatgcataaacaacacagctcttggtacagaattatcctacatattctgaacagatgataaagaaagtgctaaaaaccgtgtggatggaaatatgtagtagatagtcctgggaatatcatttttcaaggacagtagttggaactggagatgatccacttagaaagcagtagcagatgaaggtaacttaaattcatctatttatctgcctatcatcgatttagatattttacatgaattgtcactttttgttctcacaacaagcctgtgtatagttatcatccccattacatgtagagaaaactgagattaattaacttcccaaaggacacataattagtaagttgcagagtcaggatctgaattcagactggtctggtctctttgcaaatatactacagtctccaacacacacacaaacacacacacacacacacacataagcaaccacattatgatcttgtaggaccactccttctgtctctgggctgccattattttctcatctacatacaccagtaaaggtcaatgtttgttcaaattatcagtacacgtttaacccatccacttctaaatgtttggcattgaccccattggttgtgctattagccagctggccagtactcaactcaagcctatctttctaatcaggcattttcctaagttccagtgagcagaatgagaatacagagatgttcgttttattttagaatcattatgcctagacccatgcaagatgaaaaaggtttatgaatgtgtatggattgattgagctacactttaagatcatggtttcctgagaaacgaggattttcagtgtaatttagaaacactcaatgcaggatcatgattagctgttggaagtttagccccattgtattcaaaaaagagtagatatctagtgagaaagacaacgttctagaagagaaactctcaattctgataactactcaatgaacagaaatactgtctttacaaattctttagttgcctcctttccctcattttaatattcaatgcataatcatctggacaatgacctttttaaaatataaagacatcatctctacttttaattttaaaaaagttctaccttccatattttttctttctcccaatcttatcattcagtaccatccaattcattcatttatgtagcttttcttcagaaccaataaattctgagcataatttggcactactttgtaatgatgtgtgtgtgtgtgctgtgagaagtgttaatagatggggaggagggaaaaggggtttatagaagcagagtgaaatttgtggaaacttttcaagtaggaaacattatattttttcaaagatttgtgttttttcttatgagtctcctataaaacccaccaaactattccagccaccactcttagcttctcctattccagaaacttctaatttttttggtttatgaattttacctgttacactcaataatataaaaggttgaatagctttctaattaagctatgacacattattcataaccttaaaagtttaatagctttaccgtatttgattttaaacactgtcagagtgatgcctttggaggcacagtcctcgacttctgataaagccgatcctaacaacaggtcacttactcctgaacttggtcttacgttttgattctttgaccaactttcagtaccaccaatgatttccttaacttaggcttggctgggacctaccatgtgtagataaatctttttttttttttttttttttttttttgagatggagtcttgctctgtcacccaggctagcgtgcaatggcgctatctctgctcactgaaagctccgcctgccggattcatgccattctcctgcctcagcctcccgagtagctgggactacaggcgcctggcaccacgcccggctaattttttgtatttttagtagagaccgggtttcaccgtgttagccaggatggtctcgatctcccaacctcgtgatccgcctgccttggcctcccaaagtgctgggattacaggcgggagccaccgggcctggcctatgtgtagataattctgctctttcatcctcatgatgccacccctggaagccaagctcaaggctggcataccttgtaagtatttttgaaggcaacatattaaaaatggggtttttaaaaagatggcttaatgggactagagctgggtactacttggctctctcagtgagaaaactaatggaaaagaccattgcaaaaatcataacataatatttggatagtcagaactagaatcaaatcgtgagaaagagaaaataaataagtggaaaactgagagatcatcccaagagaaaacaacaattcaacaggatagaacttgtgtctttcatcctttcactcaacaaagaagtattgactaatttatgtagtctgaaatactaaataccagggcaaaaaaagaaatctgtccagcctgaccctttatatttgcacatcattagctcattatatttgtcacatatgaggggctcagttgtaaacaacatagctcttggtacagaattaccaacatttgttgcattagattaagtcactggtaaattagatttagagcatgaaagtgaaaagaataaagcaaaacagtctgttgtaaaaaaatatttctaacctgagaatcaaaacataacaaaaaaaaatcagtggcaacatcaaaaataacaaaaacactgctttcctctcaggtgtaatctgagaagaaatcaatttagggaagggtatttcagagctgttgagtttgggctcattgtggggcatccgtgtacagatgctcttgaaattcaagaaggaaagagctatattcctacaaaattgtcaaatagagagaggtctgccgtcatattagagtttagaagcaggtttcaactcaggttttgtgcagagtcactttgaccttggttcaaagcccagtttagatattgcagagactctgaaatggacaaaaaatgtatagagtcctcatccatggaataaggtgatggtctccccgttgcagctgttgcagtgactgtgagcaactcagaaagctgcaccaggaggctcccaaggagtcaggcctgctgctgctaccttgttatgcttatggggtttaggatgatgtcctcccaccaagccacttacaagcaggaaattagtaactccaaataaaatatgtcctaaaatcgtacatagaattgctttaaaagcctggaaggaatcccagagccctcttgttagccctggacagcactaaccccctcttctgggtgttcccgcagtctgctctggccccatcaccagtcactattgcagtgcagggagtggtgctgtgtttatctccaccacgtttgatgaatttgcgataattacttttactctctgcaaagcctgacagaaattttgacacctagtatgtgctcaattaaattgtgttgatgaaacaaatgaacaataacccgtgccgttataaagttgaggaatctgaaatacagggaagtgaaaaagagagcacattactagtgcaggcagaaggctcaggactcctggatcccagaccaatggtcttttgcatgtaattgctcatgaacataaggagcttatttcaaaaaatgtatggattatctttcagtccaaagtaaatgattgctttcttgagctcagggtctatgtatttgactttattctgtcttctcacagcaagaagcacaaccatgagtatttagcagctgatcaaaaagcaagttctgcatcaatctggaaatgagtgtcaggatagagaagactcggccttcctttcacgactgattttagaaagctgtatttttggtctactaattatgaagtaatgtatcttttagggtttcatcgtgaagaatgggggcagggtcagattcaagagtaatattatagtatttatttttgttattttctaagtgaaattataggtaacaaggggaaaaataattgaagcaaaaggcatgagttgtcatgtctaagcaccgttgtaggcactccacaaaatgtatgttttatatcttttagacaaagtaggctattaagtgtgcaatgctaagaggaattttatctcacctctaaatacaagtgaatcttttaagctccaaatccccacatacagacaatttaccgtggtaatcaagacgatgcacacaattgaacttcagtaccatctgtaactctattggtattttaataataatgaataaaaatatatgttggcaacaaaaaatgttactcgaagtagaatcattttaaagagtcaatgataatttctcaatagctgtgtagatatcatatttacttggaattctctgttgtgcctttaccttgtaattaatatgaaagaagaccttcagtatttaactgtatacatatactgaagaacatattatcccctcttctttgaattggaaatatgaaacaaaatgcttgtccatgcaaatattaataaggaaatgaatgtttcttttatttttctcttcttaccttttttcttttgccttttttctgtttgtttgacttctgccccctgggtgggtagggtttatctaggggagagtattgaagatgaatagaagaaaggcaaaaaaaaaaaaaaaaaaaaagaagagaaattcaaattatcctgaaagttataaactactcttcatcaatgtttttctgttgtccaggaaataaaataatgtctttcacttcgcagaaaaaagatcatccattataacagttgttataaataatactactactaatggttacctgccttctgcaaaggtgccagaaaactggactagggccacctacaaacagtaaggaaacctgaattttgcttccagctggtcaaataattaactgaataatcttgggcagtcctgtcatctccctaagctccccccaaacccttatatataaagtgaaaggcttggaacctgtaatttctgaagttcctcctggttcagaaatcctcttaaatctgtgaatgtaaagcaaagttacgcaaacaggactgggagtatttaaacagctactggatggaaagagctaaggtgcttttggttatacccacagaagtagatttttatctggggggatgatgggagctagtgatggcctttacattataaagaaaaggagtacagatgacagcaaagttatttgttgaagaaaaatggggaatcaaaaatatatatgaaaaaggatttgcattttaaaaatagacttttattgcatcagagtttttttttaagtttaaaaaattcttttttttaaaattattattatactttaagtttcagggtacatgtgcacaacgtgcgggtttgttacatatgtatacatgtgccatgttggtgtgctgcacccattaactcgtcatttagcattaggtatatctcctaatgctattcctcccacctcctcccaccccacaacagtccccggtgtgtgatattccccttcctttgtccatgtgttctcattgttcaattcccacctatgagtgagaacatgcggtgtttggttttttgtccttgcgataatttgctgagaatgatagtttccagcttcatccatgtccctacaaaggacatgaactcatcattttttatggctgcatagtattccatggtgtatatgtgccacattttcttaatccagtctatcattgatggacatttgagttggttccaagtctttgttattgtgaatagtgcctcaataaacatacgtgtgcatgtgtctttatagcagcatgatttataatcctttgggtatatacccagtaatgggatggctgggtcaaatggtatttctagttctagatccctgaggaatcgccacaccaacttccacaatggttaaactagtttacggtcccaccaacagtgtaaaagtgttcctatcagagttttgctataactcttttggagaaaagacccatgaaaaagcttttaaagatctcattttgaaaatactaggccaatgcatctgtgaaatttggttcattcttggaaagtgattcctgggaaatcaatatagtctatcccaagttgtgtgtcccattggaagtgagtatgagagaagccttttagtctctcattatattttttttcttaaaattcaaatacctatcttcagaccccagtttcttcaccccttcttcttttctacattaaacactaatgaatattcacatacacttttggaggaacagagtgatggattcagcattgttcagacacactgttagaagtctgagatgcatgtggagcctgaaattgaaggagagcacaggtttgcttattgaaggctgcaggagcactgagggagataacatgttctttccttgctccccagccatgtgcttggggtagtactgacccagtctccacaatgctgcagacctgcagaggagagaatgaaggcgcaatgtcatctttatgcaggctcgtgtcttcacccattttattacccctccacttcaccttatcctgttcatctggccagttgtaaacctttaatgtgaatgagctatttatgataccaatttgtgggcaagttttgtggaagagaaaaaagatcccagaaataaaatcattaaaatatttgctctcaaatgtagcagatattactgggcaattcatatactgcttcctattctcattacgggctttatacttaaaaggggacattttcccatctattcttattccatctttaaaatgactctatggctggatatgatgaaaatgactattttgcagacagtgaaaataaaacttagtatacctgaatgtattagctggaatcatccaatcaagagaagaaacaaatctaggaaaaaggaatctccaagctctaaccctcaatatgctttccactaatgcagcctatcacaaatcacaaaacaaaacaaacaagtttattgttctcatttatgctagatcattcttcctttgctttaagaatctgatacatattttaaaaaatatagacatttgaatttagaatggttctatcatcaaacccttaacctgtttatgcttgaggttgcaattttttgaatttttgcaatcagaccttggcgacaaccttgagcagtaggatatagataactcccacatgcttagcgttccaataatggaacattaggcaaaaataggcttccattcccgtttactaggctaatttcataagagacttgctctctcttcaacgtaagcgaggttgccaaagtggttcatgtgagacagaagtgacagaggaaaagatttatctgcttttgggggcagggagtgatttcttccttttagatttgagatttttccattcttattacttttagggacaggagatcaaaagttcagatatgtttcccaaaaagccactgttcaaatgcatagggtctatgaggaaagggctgctgaaaaatcttccttggatctttccattagcataaatctatggattgactaatttccaaagtggaacaactgtccctggaaactgagatacaaggcagacatctttcagaggagaaaacggacagtagggaatggcagttattgccacaagttaatgggctctggaagcttagttctcctggaggtcagcacctcatgatggaggggattgcacaggtctggaagaacaaaacttatcacttgcctgagagtctggactgatagataccaattttactggttcgctgtaatcatagtgaaagtctcctaaatttcctcatcagtttatttatttgtttacatctctatatttctcaatggcctcggagctccttgaggtctagactttattttacccaaagctatcctgattgcctctctgagaatatgcacaaaatgagactttataaatattggttggactgaattaatttgaaatgattaggttacttctactattccatgatcattttaacaatttatatatgaatgcgaagattaccaaaaaagaaaaagaagagaaaaataaattccagagttgtttcttgagcaatgtatggttgagttgacttgaaacatatacaggggtacagtcaattctgctacaacacaatatatgcatttgtaaaaatggcttgctaattgtacaataaaaattttataagaaaagatttaggggagaagtagggttaggagtacaatactcaaaaatttcatcagtcacacataagactataaaaacctaataaaatagtagcagagttgtatacatgctcagtgtctaataaatacataactactatatacaatagctataatactttatgttaaaaagagctacaactttccagtggaagtgggtgtcagaaaagctgtgatttcttgttaagtagtggagagagtgttacctgaaataggaggatggttatatctacacatctggatggatgaggcttagaaggcttctgtgaatgtagataccgtattgatgcttaagacctatatatgtgtttgtgtgtgtgtggtttgtatttttctatggggctcactttttttccacattcatctgatgcttcttgatgacaaaacaggcatacgtacatgcaagatctgcattacgttgaatataatttaataagtgattattatatgtttttttctaatatataaataatgcaacaaatatgtgactttaaacaagtgctttgaggtatgtatgcaccttctgtcacctgtatcttctgccagaggtaaaatggtagtgatctgctttctgttcaccaaatgaccataactgccgagaaaccatatctgcgatttttatgttattcttcttcagtgaggatctggctcggttttgtatttgtcaaatacctcaaaatatttttcaacatttgtatttgggaaaaactcaaaatacactttgccagttgattttttaatacacttaatgaacaataatttaatccttgtgtttctaattaattttcctgcagttagttaaaatactgctaagaatttgctgaataaataagcttaatactatgtaaatgttctttaaaaaaaaaaataaatcaaaccaattcttcctgagagcctttactaccatgaagtttaccttcaaactaaacggcacattttaaatttgttttgagtgaggtatgtctagatttcatgaagtcattgttcaatgtcctatgaaattaaatgtgtacaagacaaaaaataggaaaagaatattggtaatagtatactgactaattggctggtagattgactgatcgatcctgcctcccattctttcctttcttatttcattagctcacgatcccattctttcaacaaacctttatcaaaggcttgttatgtaccagattctctgctagggtcccacaaaatgtgtgtcacccaatggaaaatacaaacagataagtgaattattacaaaaaatttagatgaccaattgtcttagaccattttgtattgctataacagaatgcctgagactgagcaatttataaggaacagaaatttattggtttacagttctaaaggctgggaagttgaatatcaaggttctggtatctggtgagagctctcttgttgcatcatcatatggcagaagacgagaatgagagagagaacccactcctgaaagcttttttattaaagctgtaaacctaagccagtgagggtggagccctcacagcctaatcatctctgaaaggccccaacacttaatattgttacaatgacattagatctcatcatgagtttgggaaatgacaaaaattccaaccatggcaacaatatactaagagtgaagagcagttcctttccatgagattggatggtcaggatatcagtgtcaacccggaggggtatatctaccttctcaagacaagcatctttgctcatggccccaccctgtcccacatttgggcctcatcaaagaatccttagaaagaatactttccacatttaggataggttggaaggatagctgttgaagtaaataccagattcagaatatacaagatctaggactattcactactgcttcacggaatagaaataagttctcagaataagtaaattgttttctgaagactttcacacaactgggaataagatattttaagttatcctactcctctagacacaattattacgggagctcttaggaactgaagatgggagagtagtcaaacaatgtttcccccttttaatcatctcgcttcttatagaataatcttgatggcaataatttgagggtttgctcaagtggcttattgaagaaatgtagctagttgggtttttgagtcagacaaatctaggtgacaattctggctgcgctattttctagcattgagaccttggacaatctgcttgacatttttgaacttaattttcctcatctgtgaaagaaagctggacctgtccttcaggggtgctgtgaggagtagatgcagtaacacatggaaaccgggagtacctgaccttgttcagagcaggtggttaataaatgatggtagttaatttctcaacttctcttcttatggaatgtttcttgctaatagaatctggtctctctccctctgtcctcctatcattatagacaactgtgatgatccactagcatccctgctctctccaatggctttttccagttcctcagacctcactggcactcacagcccagctcaactcaactggagagttggtaagtaggctgactgaaatcctaatgccaagcactaaataattacgtggtgggtaggtgaaggagagtgagcactctcagacactgaaatcatgtccaatggccgtcttcaggaaaatatttacgaggagaggagtgaaaatctaatgtaagcatacttccatagcataatagtcattcaaagtatgctgacttgtgttcacccaaatcacagtatccttttttgattatcacgagaggtctttgtgaaaattactttataaaaagcacttgctttatttttatatttccatagctaacataaatagatataaaacatgttttataataaaatatttataatgaatgtttattaaattttctttcaataagtttaattttacttgaaaattaatattgctgatttttaaaatacaaaaatactattaattgaaagtaagaaaatataaataatctgttattctaccagctagaaataactgtagttaagtatatggtgtttatctttaacatctgtgtgaagtaagagcacctccttaactaatctctcatatgaaatgttgttaacaaatatgatgttggatatctaggcagatacgttttagtcagatttggatgttgacttttctaatgcatagatacataggtagataaatactgcaaaagagatttgaattatttcaatttttaaggacttttaggtatctgatagtatcttaatatctactaaatattataaacttttcctaggtcaagaaaagcgtgtatgcaatttaaagagagctacgggtctattagagtttatattatttaattttgagtatattttccattgatatcttaagtaggttacattagcaggtttttgcaatattgaaccatctttgcattctggaataagttctaattggtcgttgtgttttttttttttttacacgctaactaatttaatttgttaacacttgaatttataattttaatctccattattagtgagattgatttatagtttttgcttgtatgtttgtttcctgtttgtcttgtacttcatttcaccagttttctattaaaatgggattcataatttaaaagttagcaagtgtcactggtttgttgagaaagctgtttaagaataatattctaaaaacaaaagaatggccaaagattcaacaggaaaatttcaattaaaattttgtactaatgtcctttgctgaatattctgtgccaaaaatttgattaagcattttagttttattatgatatttagtcctcacaaagttgttgcaaacattattaccttttaccttcaggtagggttcctgaggcatcagtttcccaagacagaaaaactagtctggggaaatgcttgcattcaaacctaggttatctgaattcaaagttcgtgtttatattcatcccgttaacaaatcgcttcactagtacagattgaaaaggggtgtagcagcaagaaaataaaaactaatcaatcaaccacagttcaaatgcgagctatgccacttaaaaactctctgactgtgcacaagtcacttacctctgccaacctcagttttttatctgtaaagtggcccaggaatgtctgccttgcaacattatgtgcagattaagatcagacttgcatatccaaaatatctttcttacagcagggtagagaactgaactggagcaggaagcccactttccatttcaggaagaaacacaggttggcagaatttaacacggtttccaacagagcttccagagaaaggagttgtctcgatcccacccaaattgtgcagcagcagaaagcaattactactgcctaatagctcctgagcagtttctgggggaagctgtgggtctgatcacaggccggctctctccctgacagacagatattgagtgaggacaagtgtctttgctccaacttattataatttttcggctcaccggggaatttgagtgcctgaatccaaggctagcataaatgtacagagaggttcacttttcttccgtttcccaacaagagtctaaatcagaaaggccaagcagaagacatagtgatacagttgggatgcactgacctagaactcatcctctagtgcatattccaagactcccaagggggacagcctctcctttactcaccgaggcccaaccacggccctcagtgggaattaaacactggctcagggagatacggtatcagtggttctcatcccagggctgtgcatttgaatcacctggagagctttgcaaggagcattgcctgagcccatttttcctatgttctgaattaattgtcttggatgggacccaagcaaggatattgataaagtgaagaaacaaaagcttccaggtcattctaaaatggaacaagagttgcaaattgctacattggaggaattcatgagtaaaaaatccttctattaataattattgagtcccagtatttgtcaggcattgttctagatccttgacacacagttggcacaaataggcacaaacagtattcataaagagctgacatggataataccattaccatacaattacaaactgtgatactgatcaacagctaacatttgtcattagtaataatatcaacataattattttgttaagtatgtccagatatgtatttctactataataaaccatgtatatgtgatatatatgtgtatataatatatagagtaaaatgtatatatatatacacacacatatgtagttgaatatatacagtcagagtctgtcatatacaaagaggtggatatatacaggtttggttatataaatatattcatacatagtaggatgaatatatatgtttatatagttggacatagtaacatatacatgcatatacagtcatgtacaaatatatacatatgtggtatacagatatattaagataaaacttgaaagtcattatattaatgctattaagaacagattttgtttcatgagtggaaaaatataacatttagaaagttaagaagaaaacttataatttttgtttatattggaagtatcagtataaaatactgatttatttgcttccttttaagaccaaacttatgtcctgtctatgcactgacatggcttagaagcaattataacactgtctcaatgaacactcctttttaatgtgtcttcctttaaaacttatcttttgttttacaaagaaaaaacatgcaatatatccaaaagagcaaattgtaccacatggtttgaaatctcagatgctctcgaatatacatgcagatgtaaaggagcatctctccggatggtgagattgtgtgcctaagaattacaccctccctcttcccctggttgtaagctgatgcctggcagcgcacaactaaaaattataacaccactatattgagaacttcccatgagccctcaatgttctgagcccttaaggtacaccaattctatactcacaactaccctttatgtagatgtcattgtgatctctgattcataggtgacacagagaggaaagcaatggccatgcccggctttcacccaagtgatctgaatctgtgtagtgctattggccaaagcaccacaacactatcctgcccagagagccagaataacttcagtgttttagacagggaaagctgtgtgtcatttttattagttcacttacttccctccctcttatgtgattgaagtataattgacaaataaaactgtatacatttacagtgtatgaaatgatgatttgataggtatgcattttgaaataattaccacaatcaaattagctaacacatccatcacctcatgtagttatccttttctttgttttgtagtgagaacacaagacctactctcagcaaaagtcaagcatacaatagagtattattaactatagtcaccatgctgtacaattatattcagagaatgtattcatattagaagtgcaagtttgtaccttgatcaacatctctccattttcttcacaccccagtccctcgcaaccactgttccactctctgcttctctgagttcaacatttttcagattcctcatataagtgagataatgcagtatttgtctttctgtgcctggatatttcacttagtacaatgcccactaggctcatctatgatgttgcaagtggcaggttttcttttttatggatgaataatattccattgtataaatgccacaattttttatccctttattgatcaagaaacacttaggtcgcttccgtatcttggctgctatgactaatgctgcaatgaacattggattgcagatatctctttcagatactgatttcatttccttcagatatatacaaagtagttgtattactggattttatggtagtttcttttttttttttagaaacctccataccgtttcttataactatgctaatttacattcccaacaacagtgtaaaagagttctgttttctccacctcctcaccaacacctatctccttctttataaagagccatcctaacgggtgtgaggtgacgtctcattgtggttttgatttctattttcctgatgattagcagtgttgagcatctttctgtgtgcctgttggccatttgtatgccttgtttggaaaaacgtcaatttagtcttttgctcatttttaaattgggttatttgtttttttgctactgagttgtacttgttctttaaatgtttgggtattaaccccttatgagatattcggcttgcaaatattttctccaatttgatagtttgccttttaatttttttaattctttttcttttttgtacagaaggtttttagtttgatatagtcccacttgctcatttttgtctttgttgtctgtgctttagatatcttagcccatttcagtttcttatacaagaatagctaaaactgggtaatttacaaagaaaagaaatttatttcttacagtgatagaagttgagaagtccaaggtcaaggggggcagatttggtcagggtcctcttgcttatggggactctgcagagtctcgagacagcccagggcatcacatagcaaggtgcctgagtgctctaacatggtagctcaggtccctctccttcatcttataaagccaccagtcccattcccatgacaacccatcaatccattaaaccattaatccattaattagtaaatggattaatctattcatgaggtcagaatactcatgagctaatcaatcatctgttacgggctgcacctctcaatactgccacattggggattaagtttccacatgagtttcacaggacaaacgttcaagttatagcagtgtcatatccaaaaaagtatcatttactttggaaagcaatgagcaatcactctgagtgtgctgggcatttctccactctgccttgttcaatacactgagccatattttataatattctgcctcaacacttcaacttccagcatgttctcctccctaacagatttgctaataaatgcagtcacaatggtctgctttatatagcctcattctattctctcttccaagagggtatggtgaacctgcctccttcagatctactactcaacaccaaatccctgccccttctaaatgtccaaacaccagattttacacacacactccctctctccctcacatacacactcacaaacacaaacatgtgttcggaaaaagagtaggtactaagatacacatgcattattttaattcccagggaatagtttaaaataagtaagtaataaatacttgtcaaagtataattttcaataagttaaaaacatagctctcatgcaaatataaactcataggtcttatacaaatataaactcagcacatcgtgtgtatgtgtgtgtgtgtgtgtgtgtgtgtgtgtgtgtgtgtgtattaaacttattaaggcaggaaccagtaaaatggtaaagctaattcaaagagtattttttgggaactgtgtattcagagacatttggtgagggtggggggaggcggaagaaaataatattggaataaaattgctaggtagatacaaaattagttaatgtatgtattagtcaagattctccagagaaacagaaccaacgggatatatatatacacatacacatacacacacacgcacacacaaatacatatatacacgcacacacacacatatacacatatatatgaaatcatttattatgaaaatgggctcacatgattatggaggccaagaagtcccaggatatgctgtctgtaagctggagaagagggaggctggtggtgtaattcagtctgagtccaaagatctgagaactgggggaaccagtggtgtgaccctccatctgaggcccaaggtctgagaaattaacgaaccactggtatcagtcccagagcccaaggacccaagaacctggaattctgatgtccaggaagaaaagaagatgaatattccagccccaggagagagagagaaaattcagctttcctctgcctttttgttctatctggtccctcaatggattggatggtgcctgctcacattggtgagggtgaatatttctactgattcaaatgccaatattttccataaacaccctcacagatataaccaaaaataacactttaccagctgcctggatatcccttaacccagtcaacttgacacctaatagaaaccatcacaatgtcttacagggttataaaacttgggggttataccttctctattggacacacatttataagttagcatgtgacaacttcacagtatctaagctctgatcacccaggaactagccaaaccaaatgacatgtgcatttttctggaaaattaaataattgttaaatggatttgcttcaaattgttccaggaggatactgaaagatcatactatattttcttatgatttcaaagctttagatagtgttttcttaacacatttattcattggttcatttattacagtaattagtgaatttcttctactctacaccattcagccttccaacactcttgtcaaggaacatcctggtatcccactgggtatcccactcaagatgaaatttaaattgtaaaacccatgaccttcagagcatcaaatccccctcaaaaggatagaatgtcctcaataatatccttgtacctcatcactgctgaactatttcacactgatgagctcccctgcaagtttttgggcatcactgaaaattgctgagtcccttgatgattatataaaaccttggcaaacattgaacataaaggactagggaacactttacccctacgtgtgctcagaactcaggtagactcatgtctgccctatacccaggaagaaagtgtgcgtaactgatcagtttgccatagcagaaaagaccaactcaaacattgaaataaagactaaaggaaaaatgtgctgggcaaatgttaacctatgagctcccccaaccctaggtaaaccaagtttaatgagttccatcaataacaaactaatttttctgagagaaaacacacacttggaaacagctgttgggctgtaggtattgctgtgcccatcaaggtctgggcaatccggcacacgaggaggggattaatagttaaagctcaactataatagtctccatgctgctatctcatcgatagaagggatttgccaaatagaatttttgttctctcacttccacaaacacttcagccttcatctcatcacacacaaaaaaaatgaaaagcaaggaagagaactaattacttttggaaaaaagaaaaaacaaacacaacaaaatacattaaattggaggtcagatcaccattaacttaggttgccaactcaatctatataattgtggcttaggacggatcagtctttgtcaaatatgatttgttttgtggcaagaaagcttttgatctcggcattagagtcagctgggcttcagagaaagacttactgtccgcaggaagtgcaggggttggtggtatatagcatgaagccacggagttgtgggttaggccttcttgaaaatgaaggggaaggatttaagttactttagatgattaaaaggaaaatagaaatagacatctttggccccatgagaggagaggtttgtatttttctattgcatgttttttttttccaaatagagtttggaaaccattatgtttatcatttgttccttgaaattttaatccgtcttcctcactcaatgtattttttgagatgcttgcctgtgtaagttgagattgtgtgtttctagcatgacagttttgttgccatggagaatttgatttcttatgtcaaggcattttcagctccctgggctcatggatggataaaaagatttaaaatccttacctcccgctttggcacagattccatgcacacttaccaccccccataccacttccttgggcagtacttgttacaaattgctaaggaccctaaaggtgttctgaagttggttttcatcttgatgtcatcaggccatccatgaggagatgagggttggaagcaagcaaaaatcagggttcatttgcacaattagcatttcagctgtctagggactttttccagattacaagggaaaatcctgggaacccaatttcataaacaacactacaacgtctgctctctggaggcaacatgagtcttctctctggatttattaagccccatagaatatatatctaatctactctgttttattttttatttatttcttttgtgtgtgtgtgtgtgtgtgtatatatatatatataaattattattttttttttcttgagacagagtctcactctgtcacccaggctggggtgctgtggcatgatctcggctcactgcaacctctgcctcccaggttcaagcaattctcctgtctcagcctcctgagtagctgggactacaggtgcatgccactgtgcccagctaattttcatatttttagtagagacagggtttcaccatattggtcagactggtgttgaactcctgaccttaggtgatccacctgccctggcctcccaaagtgctgatattacaggcgtgagccactgcgcccagcctctaatgtgttttaaaagacagtaagctatacagaaatgggtcagtggattaccccctctccctgtgaaccacccttctctcttttcagcacctttcctttcttgtgtcctgtcctagctgtcccaggcatggtaagcatccaaatctatgctttcctctgtttcatcacactctcccttcccagtcgaattgtgtatggtgggtagaagctgggacatccaccaggagcttgttacaaatgcagaatcttggcttctacccagaactcctggatcagaacccgtgcattaacagctggtgcttctgcaaattgaaatttgagatgcagcattctagaggatcactgaaccttttgttatttcagttctcacctctatgacttatttactgtggatcttaggggtaggagagagtagaaagaatcaaagttggctaagttattaaaaagaaggaattgtgttgaaaacttttgttcttcatttctgtcatcacttcagtactctggtactcatttttctcattttttaagatggagaaacagagtcagagaggttaagtcagtggcccaaaactacacagctaattttggtagggcttgaatttgaatctaggtctgtctacttcacattaatcaatatctttattgatgttgatgtaagatcttagtctgaataaagatgctcttgacataattagctttcaggtaattttggtattcccttagggttctcagtattttaactaaaataatagattttcagacatcaaggaagaaagagaaacctatatatcttgccttttgaatgcccctaaaatcatactgtgtggcctaatatgcctgagggaaaaactaaccttgacctggatatttaaacaatgccttaggcctcttcttttactaggacagctatagatcattgaaagatacaggacagaaaccttctgctatttaacaggagccttgggaccctgtctcaaattgagacaaattcaatgtgatagccctctattcaggctggctaattgcaaaaccacatgatgaggaggaggagaaggaaagggattatagaaaatttgttactggctactaatcaaaagatttgaacatcaccatttggcacaaaaaaaaagttccaagaaagaagcgaatttcatgtacttcatcctttacttttttttttcctgattgtaagtcacttcctttgaaaggccaggttgcgatgacttctaagcagcactccatgaaatgcagtaaaccatcactttgatgtttctaacactttgcaaagagacaagagcttctttaattcattagttcattgaatttaacttaaagcattgcaacaaaactgtaagaatagaattaagagcatgattattagtgacatatttgtctagtgattggcagtttataacagcaatttacaatgtcagtttacaatgttttcaatgtgtgtcacatttaggaggaaataagctatgttcagctggaacattgtgtggtagatgtttttccttcgtctaactgggaatagttagaaggagtctactggatatgttgttggatactggagtcttcttctcgagaagcctttcatttaaacattgtggacatgtccttaaaaacatgagtttaggtttactgaattctccatgagaagtgaaaatggcaacatataacaaacgccaaagaaacagaaaatgggagttaatataatcctttagttcatctttctccagattttcaatttgaagactccttctttcatggtgaccccctcctcatttctccttttgagtatctcactccttgcttatttcagttatattcatctacgcaattggttgatcatgtctggactttaattttctagccaatgaaaatgtttcattaaaaatccagatttgatcaaagaacttttatcatttgttttgctaaggactggcttctaatgaatcttttctacaaaaaatatccatggcaatcagaaagcgttctggggtatctttattggtgtgcttctgtgtgtaaataacagaaaatccagctcacactggttgaaaaatattaaattattcagattaggcacataaagattgaaaggtgttcatatttctatttccagaacagggtggttacaagatcctttaccctataatactttattaagctgaacattcattttgtgagactttttgtatctgtgggtttttttttttttcattacaaaaggattaaaggtaaaaattaattattaaaaacaaaaggaaattctcaaaaagggcaggctccagggctgccagatttaattcaacaataccatcctcagtggcagcattgtcctggaactgataagcctgcccaacatctcagccagctttacaacattctgggaatcaatgagaccatgacctcctgtggcttgttttttaagctatcagagtgtgagccctggaatagcagcataatgaacatctcctaggaacttgataaaaatgtagattatctagactcacaccaacctactaaattagaaattctggcagtagaaacctatgttttcccaagttccttaagtgattctgatgctcacaaaactttgggaagcacttcttagagcactgaaactcttcaaggatccaagacccagaatcaccctttcctatttcaccagcttccacaatttggtcatctgcccagtcctgaaacaatcacagtcaaggaggatggaattaccatcgctgaatttacattcattatctgatagagaataatcaaccatgtctataaatcttcattctatccctttctctctccctttctctccttctctctctcctctccttctctctttcctctttctctcctttctctctctctctttcacagtaatacaattcaatacactcatatttaatcattttgtgtccatagttgtgatgcctgtgagtttatatatatatatatatattattttatccatggtatggtagacactaaccatactatttttatagaagtagggaaatcacttatccaaagtcacaaggtagaaagtgaccttttaaactcaaaaacaccagaattcgaccaggcactgtcttttaaaagaaaattgctccaagaatccaagttaaatgtaatatgctcaactgtgcataaagtatatactgctcatgagaaaaaaaatgtaagtggtaatgtcatcaatatgagatctgcagtttcaaatcacttccaattccagttctcccttttccctttgataatcttgggagagtaatttttttccatatgcctaaaaacaggaacagtgttttaccttgctgctgaatcttctatatatatataaaatcaggtatacataatccactagaatccactaacaatctcttagtcctgagcagcagatgggcagagttagagtgtattgatttgccaagttaaaattgaactgagcctctactcattttataagagaaattttacaacagcactggccgatagaaaattctgcaaggatggaaatatgtgtaagtgtgctatgcaaggtattcactagcaacacggctactaagtatttaaacgtggctactgtgactaagaaattcaatttttaatttattttaagtgaaatttaaatttaaatattcactaccatattgaacaattagttttaaagcctgtaagttttatatacatgacactcccatccaagttttttaaaatgcctgggtgtttttatgcacacatgaatcagcccttggtctgtaggggtcatgaatatggaatatccatcttgggtctgaactccaattcttcccagcccagactgccctcctgccaaaccccctcacttcttttataacttctgaactatgaaacaggcagacagacctcctttcctgctccatcagggccttgattgctccatttttccaaagggaagatatttattggaggacatcagcaaaactgtcttgagtactgagcgtctttcaaaataataacacagctttctcactatagacactgacagacacaccagtgtgaagccaggttcacacactgtctcagaggctgttcgtgctcatatgcctcagacttcaccatttcagccaaaagccagcatcttggaagctgagcagagacaggactttttgtggaagtaattattgaggcggtggtctctggagatagggcctgagggaagcagggtaagacagaggggaaagctagcaagagtatagtctccactgaagtcaaggttccttcagatgccacaaagatgttctagacctcagactacactgtaaagtctgtcatgccttgagacactgggaccagccttttgaactttgtatcaatctgacactcgctgagttgaggacatgggaagtgatagctcccaggcaagaaggcttctctttggccaaggacaaatctctggaaaaggggatagttctagttgtcatctagcactcacagctgaaggatgagttcacctgctagagaggatctggatagagacctgagaacatcctcaacaagaccactttcaaccctaagagctaagcttctcctctcggtgtttctctctgtgctttagatgccaccctgctcttcagaagctctcaattaatacctgaccaagttggtgtataaaaaccccagctccctcccactcaaatgagataaccctaaggtgcttcctatcccactgggatgaaactcactcacagggatgatgtcctgatgatgtcccatagatgggctttcctttctgctctgcctcatcttcctgggatcacttcccaaatgaactacttgcattcaaatccttgttttgtaactgacttccaggaaagccaaactaagtcatacacagaatcactctccctagacattactcttttggcagccatcaactataataaccgggtctgattattatccaaaatcaccactcccttaggtgaacctcctcttaaaagctcctttgttgttttctgcagactggtctcaatcagggtcattccagattttcttacaggtgtttatcatttttgcaacccacatggtgcatggtgtgttggcaagttcccacttatttatttatttatttatttatttatttatttatttatttagtgatgaagtcccactctgttgcccaggctggattgcagtgtcatgatcttggctcattgaaacctctgcttcccgggttcaagtgattctcctgcctcagcctcccgagtagctgggattacaggcacacatcaccatgccctgttaatttttgtattttgagtagagacggggtttcaccatgttggccacactggtcttgaattcctgacctcagatgatccgcccgccttggcctcccaaagtgctaggattacaggcgtgagccaagttcccactttattttcccctggttaactccttagtccctaattaatgtggaactggaagtgcaggaggcgtggcctggaccaggctgcaacaccttagccttcctgcacctgcccaggagcagaaagattacgcccagggttcttgccaacagctttcctcctcaaagattcttgcccagccacaggtcctattacacatgggtgatcccgttctacagggaggagcaggaagcccttctgagtgctacaagcatgtctgtgaatgttgttattactcttacacatactgcataatgttcgatatttatgggagagcctctttctgttattcattaccattaccaggtagctgtgtccctaaaacatctagaacttttacttacagaggcatcgaccatttaataattaaagatgtggctagtgattcaagttagcctcacagtaatttgtgagaatatgcttgtagtttcatagggccttctggaagacagcagaagtaactgcctgggaaacttgtttcctatagggtttattttaggctttaaaaaaaaaaatggtcaggctgtatttttaaaacagattaggtgtggccaggcatggtggctcatgcctataatcccagcattttgggaggacgaggcgggtggatcacctggaggtcaggagttcaagatcagcctggccaacatgatgaaaccccgtctctactaaaagtacaaaaaattagctgggtgtagtggcgggcatctgtaatcccagcttctcaggaggctgaggcaggagaatcccttgaacccaggaggcagaagttgcagtgagccgaaatcacgccattgcactccagcctgggtgacaggagcgagactctgtcaaaagaaaaaagaaagaaaacaaaaacacattaggcatgaaaatgctatgctgctatgtgtgtgtatgacgctttcaactccagttggtcttggactaaatgtactctctttttttgaaagacggttgtgaaatatcgttttgcagagactagtatataatccattttgtgcccatttccagtgtgtggcatcaatcacttctcatttccctttttgagttagaagtggaaataagtgtagaaactgaggaatttctgcattttctactggttattctgcttcatgcttacagcctaccctagtgtgtgcagtttggaatgcaggattagcaataagtgtcttggtatatagaagtgagcatggagtgactgggaggcaggagatctggttttgttttgttttgtttttcttacttaaaactgcagctgggcatggtggctcacacctgtaatcccagcactcagggaggctgagatggggggtggatcacctgagatcaggagttcgagagcagtctggccaacatggtgaaaccctgtttctactaaaaatacaaaaattagctggatgtggtggcacacgcctgtaatcccagctactcgggaggctaagttgggagaatcgcgtcaacccatgaggcagaggttgaagtgagccgagatcacaccattgcactccagcctgggcgacagagcaagactctgtctcaaaagaaaaaacaacaacagcaacaacaacaacaaaacacaattgcttagaattctccatacaagtctattcttgctttcttaagatgttggttcctattgaaacctcaggcagggacttgaaattagaactgggttggagtgcagtctttagccatacatctgggttagctgcctggcccattgaggctgctttgaaaaaatttaaaaagggctactgctgatttccatgagaatcaactgagatactggaaacaatgtcaaggtgaattatgtttctagtgagaattgctcttatgaggaagcaggaggacaaggacctgagggatttgttggtgcacttgagaggccgcttgtagcccagggaagacctgggtgctggatgcaggtttcctgggtctggagctcctgcattgctacttcctagtttatgatcttggaaatgctacccactatcctgtttgcatgatggagatcatttgagaatctctcatctagtgtgacatcaggaacagagctgggtcttgaaccagattgcctgacttttggtacagcatctctattccatctattcctccaaagtcaaataatatagtttgcagagtatgaggcttggagtatgctagaaataactaagacatagcctccaaatcattttggatcttttgtttgtcaaacatttaaacaattccagatgttctctaaggtgagattattttctctttaaatgcaagtgttccctttaagtgtaaacttctttaaatatcctttaaatttaaactgcagagtttataggaatttttgtagttaatagccattgatacatcagccaaaattacagacagcattgcctcagtcaacaccttcaacttgccaaatgcacttatttgtatgtatgttatacccccaatttagagaataattcagaaacaagaagctagtgtaggtgcagtgcgtttttatagtgactacaaatagtttcttcaggctactttcatcatttgtgaaagcacatttattgtttggtggaaagaatgaaatgtttgccatagcaaccatggcaaccctgggtgtcttccctattagctgtaatgcggggagcatcttcaacagcaggaaagagtcctcggcaattatcacccagatagcatccctccattttaaaagctttggctgaaactcttgggctcagaaaatttttaacatgatgtgttgatgaatggtaacaacagctattccattttggttaatttgggggagattaataagctaagtttttttactgtgggaaaaagggagctatgattttctttagacaaatttgcagaaactttaatgctaaatcattctctatttttttgttttggtttgtcttggtttggtttagctttgatcagtcttttgttattttattctttgcaagctaaatttcttgtcaatttatttccttgtttccattcttcatgtaagttcttatcatatgctaattagaatagatgaaggaaaaactttaaagcatgatgaggaagtctagttgtgaactattgagggtaaaagagaaacagttaaggcttaagaattttcattttaaaaataatgatggtcacagaaacagcaaaagtcctatattatagcatcagctcccaaattgctgtacatattctttacgcaataaatcacatatgagtaataaaattctcagcttataaaagaagaaaatgttgataagggaaactatgttatatgcaaaaatcagaagagtataaaatcactcatacattcaccacagacaaaatcgccatatacatttattttctatcatgttttaatattgctgagaggggaccatttcaacaacattttttttttttactgagaaagaatgcagcctcatgaactgggcagcagaagacattgaataaaataaagaatatgtttagaattattttggattttttgaaatataaaacctccctctctataagcctctctgtcaattttgagaagctagagaaaggcagaggggaatgggaattgtgaatatgttgaggaagacagagttgaatgacaaaaatgtactcctagatctggcatctcagaatctctgctcaaatacctacttccagtgattttcctccttactaattttctggagttttataaactgttttttttcctgttgaagaataattgcaaatagctggatttaccctatgttttaatcctgggtgccaaattttccaaacttgctggacttcagtttcctcaactttatgatggagataatgctatttacttaaaaggatattgtatatttattcaagtagacaaaattgcagtgtcaaatagagtccaatgcacaatgacttaaacacaataagtgtttagctctcattcatctactaggtgaacgtgttcaagtaggcaagtactttccttcatgtgatctttccatactgtgattctgccatcatctagatcttgttgtcagctgcatccatcagtggtggaaaaggaaagcaagtggagaaggagcacgctagcctggaagtggcacaaattattcccactcacattcttattggagagaacttgaccacatggccataaccatgaaagtatggaaagctgaaaactgccattaagccatgcactcactgcaattctactaccaaagaaggaagagagaatggatattagtgactatctgccataactgccactgtattcataaaaaacacttaaaaatcacattccacaatagatgctgagcacattcccttccccttctttcctgcatttgaatcttctcaggaatggtgagaaaaaaaaaaagaaaaaaatcaaaacttttctcaaacaaaatctgctaagggctagctgcttactgaagaaaatcaaccacaatttgcaagatgtgcctttaagtcctctatttttccatccttaaagacagaataggattggctttatgccctctatcactctgtctgcattgcagtcctgtactatgagagactctgcaggaggagctggggctctagaaaactctcagttaccaaggagatgtccaaatgacttcttccaaggtggcgagaaagtagactgaaacatcgctaaaatgattttcaatgacatagattgaaagaaaaaggttattgattaactcctctaaatgaaaacttcaattacctctccctacttgatgtcctgagttgcttctatgctatctctacccatggcataatacagtctgcgatagctcccacatgggcttcagaagatttgtgaaacttgggaacagtagaagtgaatattgtcttttttactcctatgtgaaataaaaacagaaaatttaggctacaagtctttcaactaagagagaactcacattgatcttctgcaaacctcaggtgtgatacatacaaaattctcgggccaaaacagtttttgtatgtgtgtcagaatgcccctacatgtcaggtatactgaatcacacgagatccaagaatgttagagactctgtcatgcctctgagattttgtgtatgttgttccctcttccctggctaatctccatcgaactttccaccttttttcctaggatatggctgcacttgcctcaggtttcacctctactattgctatctctagaaggcctctctgatcagctcctgaggcattctgtgctctgtgtacctgctgtttacctcttgtgatggtttctttcacatcacatgtttttgtcagcctctctctctctcttcagcacccagcatactcctggtgctcaacaaacatctgccgaataaatgaatgatactcttcaaaggcatagtcggtgtcctttcatctttgtatctgcagcacaatatcttgaccatgataggttcatagtaaatattcagagaccgaggagagagaaggtaatgaaagaacactaaaacaaggaagagaaggaagaaaagaaggaacgatatattagtcagagagagagagagagagcacatgtaagcctagttcatatatatctgcaatcaaaggctgaagttgtaagaagagaaataaataaaacaaatgtcactaggagtttgtaagatagaagtcataatgactaaggaaatagggatggaagcatggaagatacagcttctggcatgagtcttaaaccatgagagagattttgatggaggtggagaatggaaagtaccagggggttaagtacagaggcagggaagagtagggcccatttgggggtagagtcatcttagttgaacactgtttcatttccctttgatagttgaaaattgtagctatgtgagacattactacaactctctctcactctctctgatcctgttccaggaactggcggttggtccccagcagattccaatgctcaacagtggctccagatggacctgggaaacagagtagagattacagcagtggccacgcagggaagatacggaagctctgactgggtgacgagttacagcctgatgttcagtgacacaggacgcaactggaaacagtacaaacaagaagacagcatctgggtaggacatctttttccttccaatgaataaaactgagatgtgctaatggtaaccagagtatatttccgtcattttccaatatccagattgttggtagtttaataactggtgagtgcccattagaaataattagacaatttttaaggcccatgcccggcatggttctacttcctaggaaaattaggatgtctgtcgcaaatagtttagtatgttcccctttttgtagtaaactgggtaattcactgactgagcctcactttcttcatctataaaaattaattaaaaaacagataaatgtaccaaaaagtacgattattaatgtgattatactaatttactgagtgtttattgacttattagtttattatatgccaggcacttcacatattttgtaacaacacagctagctcaattacatcatttgatcaacattgcccaatgtatgaattgtgacttggtaatctttaaaatctggcctgactttaaagccacgaagcagcttctattgtagatttacaaataattgaaaactaaaactacaaaacaagtagaaaatttagaattattctgtcattggaaacaatcttcagcttcagagtgaaggacagtttgctccaagttacaaaacagaactttcctccccagtcccagccccacactcttgacctcactgtgtgggtgaaaggctgtcagcaaattattaatggaggaaaaggtggaggtgaagcagatagcaaaagtcacctggaggtagcttcagaacctcaggcactgaataaaataagttgtaagtttatattatttttcattgagaaaataagtcaccattttttaatccaaatgtgtgtaaaatgtgaagatacggaaattaatagcatattctttccttttcagattctgtcctcttaaatcaatgccaatttatactttacattagtgttgtcttcacattcacattcccatgttggccccatctccctgataaaaatgaaataacttctgttttatatactcattgttatttgttaattgcctacccatcacttggggttgtaattgaaaacagtcataaattgaggattaaaattagttatggcagactgaatcctgagaatagtattaatgtcatctttattctgggtcacttgtaatattaggttataatatttataaagggcgtaagttttcttcattttcaaaaatagtctaaacagtgagtatacatggaaacaaagaggggaaaatagacaccacagcctacttgaagggagaggttgggaggacggcgagagtccaaaatctacctattgggtactgtgttcaaaacctgggtgatgaaatcatttgtacactaagccccagggacaagcaatttacccatgtaacaaacctgcccatgtaccccttgaacctaaaataaaagttgaaaaagaaaaaaaattgtattttggggactattttattttttctcaattttgaggtccccataaattattacaggttttcattttgtttcacttttagtttgagataagaaataagcacaccttccattttgaggaacaattttaaggtttttatgttgactttagagggacaaatcgatgtgggattttttgttttctctggtacttgtcattgggactggttgtctttagattgagttgtagctttgagttattgtgcctaatttttttgtttttaatcatgagtttcatcttctttagaaccaaataatctactttcagcttagcccctgggttgggatgtatttcgagggatgacaattcctctgggctcatgagcagggggcacaaagcctctttcacttcctcacccttgtcactttccctgtgtttctaaatgattccaagctcctcaaaggcagggatctctttatatgtccatttagcccctgtgcccggtatcactagacacatggcaggaacttattttggggtgattattaagagaactgcagaattactagggctccctgaattgaagggtgggggcaggagactttccccattccctaccttgcatcccaaacagccttgacatggtagggcaggtagaagttgctggatgggcagagaaggaaaggcagggccctccgtctacagtgaggcaggaaattccagcaacagctccccagagatgcttgcagtggctgcagggcaattgggagagaggcagcttcaggagcagccttttactaagtaagtacagggagaagtgatttgaggagggaccattacaacttccaatttaaagagtaaaatagagtggcgttaggcaggaataccatgaccggtcatgtacagtaactaggctcaaccctggaaaaataggtgtccccttaattaatactgggataactaacagttactaaacacctattacacaagatatgtaagcaaatgtaattctttatgtatattaaattgtcattctataaactggtgattcaatgttaacatctccaggaacaagaggcttgaggctcacagagcccaatccaagctcacacaaccagaaactggtggcaaaatatttcacaactaagatttattcctaaatatagttggttgcaaaactgtagtttctgtttctcttttagtacactgatttattttttatttttattttttgattttcacagaattgatttacttttctcacctcaaatgtcaactttgtcaagccaactctttaagaataatatgaagccctattgtttaattcacatgttgctaaatataaaagtgtgaagataccaataatacctatttgtatttgtgtatgttgtaaatagtgcttggactctctaaaaccctctaggctttcagggtgttttacaaacacttcacagaaatctgtgaaatttgccttgtggctaactaatatttattggtgatttcatcagattacgctgctggattaaagagattatcttgagagcttttctttttactttttatttttaattttaaattagaattaagactctgggtccaccaaaactaagccttataactaagacaagaacaatagtcaaacaaaaggttttgcaaaactgtctaaattgttttgtttaacttttcagaaaaagtcaatgtctaaaacatcaagtactggcttaaaggtggtttatcaagaaaatagagaatatatacatatatatctgtgtgtgtgtgtgtgtgtaaatatatatatgcatgtgtgtgtatatatatgtgtgtgtttgtgtgtatgtatatatatacacacaaatatatatatacacacaaatatatatatacacacaaatatatatttatatacacaaatatatacatatatatatatttggagaaagggtcttactctgtcactcaggctggagtgcggtggcacttatcatagctgactgtagttttgatgtcctgggctcaagtaatcctcccacttcagccttcaaagtagctgggactacaggcatgcaccaccacatctggctaattcttttgaaatttttaaaactttcttcttagagatgggttctcactatgttgcccaggctggtctccaactcgtaggcccaagtgatcctcccaccatgacctcaggtttacaggcttgagccaccgcacctggccaatgaagcagagaagctcttgaatgcttatgttcacctggtcttctgcggaccctcaaattttagataatatatagtttgtagtgctctttaaaattgatttaccaaacaatacatagcacatcctgaggatgggacaatccattcaccagtactgaagagatttattacatttcacaaggttcgcttcagaaaaataatcctaaaaggatacctttgcaatgtacggtagcaatttttcatgccctaaaaatccaatttggagagtttctgatctggcactgagtggaatgctcatgaatgaggtcaccaaacagccacttagtgatgcaccatgatttatgcacaagccagagtccctcgcttcactaaataatcaggcatgaaggtgtgtcagggacaaaccctgcaacaatgttcagaatcttagcagctccaaaacctcttcctgattggtgtgtagacatgccaaatcattacaaatattaaaattccgactctgggcagcaacatgagccaatgcttggtaaagtgggtaaacttgtttggaacaaaggaacctcttaactaagtccactcagaccaggtcctgttaacagtccttttgaaagatatgccagaagaaacatgtactgttcatgttatatccatgaataaccacaatgttgagccctttccttcatgagcacaattcccacactgtcagtgagggtcttctgccctaattcaatgtccccacatcctcagctattcatcacatagctcatgtcagtccccttctctaccctatcatctcctgtgaatattctatattttattaatattaaacttgcagttttctcttattaaaattatgttgcctctccccaaacagacagccatatagtcctttattatagacgcttttggcctgtgcactctgatggtctgtgatttcctgtaactttctggaatctgtcttaacatgaaggacttgcatttgttacctggcagttttctcacacagaggtcaattcaagcaatggattatacattttggtcatcagttccccgatttcatccttgagtgacttccaaattctctgggagatgctctctgatcttcatgatttatacacatttattctgccacgttgggcctagaacatcctgagtattgatcactgtttgatatagtattttaaccctaccaatttcagaaaacaatttgagagtgagaatctcatcaccatcaatatatatcttttaagctctcattatatgccaagcactgtgcaaggtgctaggcttacaaaggggcttaagcaatggtttttcccatttctgggtgtgcagaaccattaaggagacaaatcaatggcatgcaacacagtatatgtgtatatggtagcacggcagcagttcacatgcacgaagcttgtcagagagggtgttcctggcaatatatgaatgtgaggggcttagactacttgaaccagaagagaccatatttaagttatgttggcttgtcagcaactacagagtactgtatgtgtaacaaaaattcaataaatatacaaaaaaatgggaagagaaaatggtgaaagtgaggtgcattcacagcaggagaaatgctataagcaaaatcttaaaggaagatgtattaaggacacaaaaaaataataaattagatataagatatagctggttagtgatagaaaatgaatttgaagagagagactggatagatattgtagactaagagcacactcgtatctttttaagctaatacattattatttattagccattgtaacaaagtttgttaacacttctctgttttaattttttgttaaataataaagactacatgtaggaacatggtctcaaatatatttgtcaggattttttaaatggttctctcctttgttctctcacgcacatatactaataagcttttaatacagatattaatttcagttttggcaattattaaaagctcaattaagaacttagcatgcccagaatcttgctgctgatttaatggagaccaccaatgcaaaagcaagttattacaatgtcacagactaacagaaataaagtatagagggaaatgcagaggcttttgattacgatctgattacagttgcaccactggttgcttgcatgaccttgaaaatgtcccttaacacctctatagcaggtctttctccctacccagggcagggatatatctagaatcttccaggcccattgcatccattcctccacatttccttgctcagacactggttcttggcttaccctgtgggttgcaatgtgaaatacatggagataaagcctggacttcactatgaagccagcttagaatagtcaactaaaggatctcaaagctcatcattcaacttgaataatcccagtggttctgtcctaagctcttttgctgattttagatgatcttataactggatagagctctgcagaaaaggaaacagggaaaaactggccaatcagcattgtgaaagcaacagctggtcttcaccccagcttcagcaggctccctccagccctctggctccacatttagcccatgaaagctcctcactgatgcccatctgttttctcttcttaacactagaatttgctgaaatgtttcagagaatttcccaacatggggcctaacctctttaaggagtaaatgcactcacacatttacacatgtggcatttaaacacatcacaaggacagggagtcaatgtgtagtcttcaggattaatattcatatggacacgttctaggggagaccagatgtttgcagtcccctacaaactggttgcatgtgtagtgggataggatccaacagctgatatcaaaataaggaggatgatctgcttaaaattaattctcctaaatccactgctattaaattaatcttattgttaaggtgcttaatgattcccagcaatctcaacttgtaattgtattttcaatatgtataaacctgttagtcctcactctgattcctcttaatctaaagtgaatgtctccaaaacctaagctctgattttttatcttgcccaaattcctacctaaggggtctgtggagtcatgccctacaaaccatcaattctcctcagatgggttttatttgaccctgtatatcatgacttactttccaatctgactctggcataacaaggaagaaaataaaaatgttttaccccaaaatatatttccttgccatacctgggaattactctgccgtctcttgtggggaaaatccacattctataaaaaatctcctttcccctttgttttccttccttctcagatccaggatttaatcaactaagagccaggcacccttttaagtctgataagaaacattttacaacctgcactctctgaagtctgctatctgagaacttcctctgcacaacttggtctccacaatcctttagcttaacctgaacattcctttccattaatcccaggacttcagataaactcaaccaattgttaaccagaaagtgtttaaatttatctatagcctagaagcccccatccgctttgggttgtcccgcctttatgaaccaaaccaatgtgtttcttaaatgtatttgattgatgtctcatgccttcctagaatatataaaaccaatctgcacctgaccaccttgggcacatgttctcaggacctctggagggctgtgtcattggccacaatcactcatatttggctcagaatcaacctgttaaaatcttttacagagtttgactcttttcatcgacaagagttaatatctcaactttaacatccagcaaagtattcggatttttaaaatgtaaatatagtcaatgatgctagctaggtgtaatgactgagttgaagagatttttaaactaatccttatttatttaatgtttagctaacaaggatgaattcttttgtgtgtgtgtgtgtgtgtgtgtgtgtgtgtatgtgtttctttgttgttgttttcttatatagattatctcagctttgaagtgtgacatggattctgtgaccatgataaatgactaaaaccctaaagcactgtttttcctctgtaaagtggatgtaatgagggtagtcacctcatatgatctgtaaaggagagatttctcaaaaacgagcatgcttcaaaatgtcccacagaacatgtcaaggcaaggcctactgggctccgcctgcagaaagcattcagtagacctagggtgggactgagaatttgcttttgtaatgaaatctcaggtgctgctggtgctcctggttggggacctcactttgagcaacagtgcgtaaactttaaatggactgaaccatacaaggatctttacatagcattatcaataataagggatgtcattgccatgaaaggtaggtgtatgtgatgtgcctgggggagaggcccagaggacactggctctcagggtctgctttcttttgagctttgtatacaaaaggaaaagcaaacagtaagtcagtctttctctcacttgataaactaaatactcagtggaaacaataagatcttgtggttgcagatgaagacagtttacccaagcaggctcattagggaccattcgcatagagtcctggcagcatacaggggagctggaggaggagcctgggggagttactgatgcccaaagaaaaggactctaggtcaaatttcgaggccccaggtgtctacctggctctagccaaatggaaatattccaggcctggcaggaacatcaacaaaaccaagaatctctcaagtattttttttttaagttgaaaaaaaaaaagcaggcttcattgaagttattattgcaatggtaacaatcaacattaagaaggaaagcataatacagtaaccacaagtttctactactcttaagtacggtttccagttttgtgggccttaatgttaattgcagataaaggtaactaattttagtcactgattatgtgaggctaataaaagtagagagtgcaaacaaaataagtgtgagcaggcgttgctcttgtgtttcacgtctctgaccaattgcaattgtccatatgagaggcacatttcctactgccttgtaaccaaaggaccgttctgctgctgtggctgctcttggaatcagagagagaagctgaatgatgcccctaagtttgtctaacaccctagacttgtcttgaaaataattctctaatttagtgactcaagaatttttcggaagttaattcaggagctcataggaaaaagaaacagttttcccccacccccccaagtattggaagtacagagaaggactcataaaaattgggctggagttatttaaccttgaatactgtgggtgatttttttttccttttgtaggaagggagtattggaagtacagagaaggagtcataaaaattgggctggagttatttcaacttgaacgctgtgggtgctttttttttttttttaccttttgtaggaaggaagatgtacttgcaaaaaatctccccaaagaatcatggacccctaacatcctgccttatctgactgtaatttagggtatcaagcatctgttaggcacattctgcaggtactaaattaaggaggattcaagagtagaatgtggaaatttcctgtcagaggtaagaagaatgcatggacaggtacaaaatggaggaatatgcacagatgggcacatagatgagagcatgaagtttctgacttgtcagtagaagaagtgctatgatttttttctcccagaaaatattttgattttgcaatgattcagccacatttttgtcctacctgcctgtatttatgaaacaataattgagagctagagttccacgaatggactgtaaaacagagtagaaagaactgatgaacagaagacacagcaggtaagcatgagcaagctagcccactacgtgtaaacagctcagctgactgggtgtggcacctcccttgaatatgaagcattctgcatgtagatgagagaaaggaaaatgcagtgcaggtgcaaatgacagtgacccaaagccatgttcctctgagaagtagacactttcatgcctgggcatcctccaggccttccctatctagtgcatatttttgcaaaggcttatgttgtgtttcagacactgtgtttatatgtgagggctataaatatgtgagaatttaagaatgtatgtgtgtgtatagaagaagaaccaagccacagcttgggcggggcatcctaaaccccttaataggcacgtaatttaaggaaagatcctgtgcttaccagagaagctttgtttagaggcccgttcctaagtccccttgcatcaagcttgctgctcctgcatccctcaaacccagaaatgccaaagctgcaatgctggcataggtgtatataggttagttcatgtccttgattcatgggtgatgacccaccaccctgcccagcagagtccaggccatcttttttctgagccctctctggggagaggtggcagctcaaaaagcccttgagtcttgtttctttttctttggtggggactctaatctgttgctaatgattccttcatacactcccccctcattccacgtaatgtgtttgagttctcttcttgaaatacatttgtcatttattgaataatttctgaaacaattaaatgacaactcaatgaatggctttgtcaattttgtgtaatggaaagtcaaattatcatgtaggaaaagcaaaatctttctttttataacattgctaaaagacttcaaaagtaactgcataattataaaaaaatttgaggtattaaagtttgcaaaatcaataagaatatctcataaacctatttatttttggaaattgaaaccatacacatggacttatttaaatgtaaatgtaaagatgtgaataaagaccaatatttgtagaaggcgatcttattatttaagacaaagttgaaactttaaacatatacatctgtatgtgtatatatacacatatataatagtacataaaatatatatttatttacatacttaaattatatgtttttatatttgtagatttaaatacagtaagttctcacttaacatcatccatgggttcctggaaactgtgactttaagcaaaatggtgggtaacaaaatcaatttttttctcattaatgttataatgaaaagatattgaagaaaacaatgttatttgaggactcattgtacattgttttgtttaaagtctgaatttccaagaacttgtaaaagacactaaggaattaccgtatatacttttgtatatatatttaaataagtttaaataaatatatgtgtggtataaatatatgtgtctatacatacatatctttaattctcagcttgtttcatcttgatttcttcttatctataaattttggttattcaaactttttaccttcctatagtaaatagaggatttagaagatttttgttccactacctccttggcaggtatgccagctgccttactttaaaaagcaacaattgcaattcttcgagacaattataattcattgctttccctaatcagcaggacctcagataaatggacatatgaagatttgttgagagtattgttctgtggttcaatgacttgtgtgatttccttatttaaacaagaacaaagaagccaaagaaaataatgtattttaaaaataattgggcactacttatcagagtggttggtggactggatactaatcaggatagtagactccaaattattttttttccagttacaagtacctttgtttattcaacagtagacacagtgctggcagcaacctgtaactgtactccatggatttagataagaagatgatggggaagggggatttttaagtcacactagatcaggattatattgtttcatttgagtctcttttaattcaagtgtatttaataacattctcctttatgaacggatttggagcatgaactttggatttaggcaaatctgagtttgaatccctgctacttactgatggtttcaccctgggcagcattttatatcctaagccttagagttcacatctgtaaaatttttataaaacctacattagagcagtataagaattcactgaggcaatctacatagactcccaatgtccctgacatataaaaagtactcaagttagaaatatttaaatccttatctaaagaaaacttgaatgctgaccaagactttagcagaatcccaaaagacacatttcttccctcaaatgtaagaaaatattccctcaaatgtaaatgtatcttcaaaatatcccagctcctgcccccagatgtattttcctaggcctgaggcatttgcaaattccagaggccatggcatgccagtgtctgttggctctgctggtaaggggggcagtctccctttcgtggctcctgcgcagtccagcctttctcctgttgggtgatgctgctaagcatgctcccaggatagaggaagcatctgccatgcttgtgggtagacatgggttactaagtaacatgacagaaaatgtaagtggatctggaaacaaggtaaaccaccaggagagccagaaatttaacaatgaccagattttaagccactggcattttgtttaagtcagttcccagtaaaatcatttgagcatggctttagaataaaagctggggacttggttgatgatgggatgctgtatggagtaacttgatggaggcccagaatctcaggaaccatttgtcaacatctcttcttgcaacactaagtaatagcagagccatcgtacattcatttcagaatgggctgcctagccattcaaaatgagtgagtcagaatactgacttttgactaatttctagaagcatgcagttgttttgcaacttgtcctaccgcagacacagattccttaacctccttccactagataagatattatctaacaaggattcccatataagcgaacattttgttacgcgaaagctcaaatagcagcagagtttgtacaaagctgtggaagaaagtcctaaagaaagaatgcaggttagcaaggagaggtcaggaaagtaacagattttgtactagaagagaataggaataagcagccaggtgtggtggcatgcacctgtaatctcagctactctgaaggctgaggcagaaggattgcttaagcccaggagtttacaatcaacctgtgcaacataatgagactccatctcaattaaaaaataaaatatttaggctgggcacagtagctcacacctgtaatcccagcactttgggaggccaaggcaggtggatcacaaggtcaggaaatcgagacaatcctggccaacatggtgaaactccatctttactaaaaatacaaaaatttagccgggtgtggtggtgttcacctgtagtcccagctactcaggaggctgaggcaggagaatcgcttgaaccaggtaggcagaggctgcagttagccgagatcacgccacggcactctagcctgggcaacagagcgagactctgtctcaaaaataaaataaaataaaataaaataaaataaaataaaataaaataaaataaaataaaataataatttttttttaaaaagtaaataaaagcaatgggaataagggatcaagaaaaatgtaggagtctttaaggcaccaaattcagaatcatccctatttggggaaacttaaaaaatcttttaagagaggtgccaagtacaattatcacaggatttgaagtaaggaatccatgccccattcctggctgtgtcccttattattgtgtgcattttcatagccacttaatccctctgagcttccaaggctgtatcttatccagatgcacgtatgcagcccaggcacatagtaggtactcaataaatgctggctttaaataattaaatgtgatgtcattttcaagaaacattagctaggtaggtattgtgacaagtcacaagattgtttgaaaaaaatacatataacatcttttaactgtgtagaaaataacagaaatgtcatcagtttggctgaaacacagggcttgtgctggggtcctaagagataaggcttgatagatatattggctgatgtatcttatgcgtttgctcaggaaaatatggtacattgcttacatctgttgttctagagtaattattaattgagccacttgtcaatataaaaaaaaccttcgttcggataatatattatattgtcaatgtctttctagctgccatcaattcagagtgagcaacttatacttaactcagaaataaagcaaactaaggatatgccgtacctttgaagtatgtgtgacaagaagctggatgatagtattagttgctattacatggtgcttataccagtgtaaattcaggagagggctggcattttttttttaagtttaaagtttaagcatgaggaaaggcctatcgatagataaaactttggttgtgagtctccaatggttttataagttcaccatctttaggaacatacatgaaattagagtgtacaataaggcagtactgtagaaaccctaactgctaaggaagttcctgcagctggctcgtgaaaataatcaaggaaggagcttacctgcctctgtcgatttttattaaaagcaaaatgagtttatttggagaaaagatgcccaatagaacatggattagcaaattaaagaaggatatacttagttttactaagtttcagaagaacaaagtcactcttctattctatggaagtgtatgtaagagctataagattaaactcacttctttgggttagttttaaacttgtgcacaaatagacttgatgtggtaggttgaagagtgctcccacaaaattcctgtgcacctggaacccagatgtgatgttatgtaggaataaggtgtttgctgattaagtacttaaggatctaaaggcaaaatcattctgaaattagggccagataaatctaatgactgatatctttatgaaaaacagaggggacacctaagacaggtcatttaaagaaaaaggcagatactagagcaatgcatatacaacccacgcagtcccaaagactaccaagagcctctagaagctaggagaagaaaagggaagattcttccctggggttttcagagatcatgtgtccctgttggaattatgcttctggacttctggcctccagaaatatgaaagaataattttcttttgcaaatcccccagtttgtggtaatttgttatggcaaccataggaaaacagtactctttaaatattcattattttgcaacctctgctattactcctcacttaactctgagctcctctgctagggtgtggccaccatgcactgaacacagcagcctgcacacaataatttgtattcctccagggcacctagcacaatgccactgctggttcaatacgtccatgactggttatgcattgccaatcttctggatcattaagcctttgctcatactaccatcttcacctggaattctccttcaaattccccatactctcttgacacatacgtctccaccttctgtaaattcttcctcatctttcaagatctagttcagctctaatcccaggtctacaacaacacttctcctgattcaattacttcaagtaaaagtgatcctttgcacatctgcactccctttctcctttctgggtcatctcttcggacttggaacaattcttctctagatttggttataatccacccccctccgcccccacccaacatgttgctccatgcgagttagtcttgtccatgaaactggatagagtgattttggaaaacaaagtctcgtctgatttttaccttcatctctctacttggtctggtatggagtaaacattcaatagtaacttgctgactatttgccctggctgtctcattccacagtgataaaaccgaaatgttctctaaaattacttttccatcattataaatttgacttgaaagccatgcaattgatgcatttgctggggattatctttcgcccgtcactcattaaatctgtcctcatatagcaacaatatttataggaacagctagacgttagcccccaagtgagaaaatgacccatgcaaatgccctggcatgacataaatacccacagcaatgcagattgtgtgatgactctgctgggtggctacagttctggggtatgggcgatggatgagctaacttggagaaggcagcctagagtcgtcaggggaaagaagagggtgcagtacctcattaatttgttcccagccaacagttttcaaagattagccacataataatgcccctagaatatgctctttgtacatgaccaaagatgatctgacaggcatttcaaaacagtaattgttggattgatgacgctgctgaggaaagaggactcattatacccaatttggaagattgtgaatatgtcgtataaatgggttatgaggatgcatttgggtaaaagagctggacaaatgcatgatgacattacagtaccccaatgggtgtctcagacatacagtacattctctcacccttcattatttgaagactggggaacaatactgcatgtttaagaaagtacaagttcaaattgtggccagatgtacgctatggtaagggaatgaagtggttctctagtgcatatgcaatcctctagggacataggcagttgtgactgtgctatcctgtgcctcacttaaaaagaatccactggacaaaaaacatttcagcaaagaagattttatgatgactgccttctatgactcacatgccttcctacaataggacatgtatgcatcattggacctttgacattaaacaatctcgaataattttaaaagcatgtattaatatccagtaatactttttttttttactttaagttttagggtacatgtgcacaacgtgcaggtttgttacatatgtatacatgtaccatgttggtgtgctgctcccattaactcctcaattaacattaggtgtatctcccaatgctatccctcccccctccccccaccctacaacaggccccggtgtgtgatgttccccaccctgtgtccaagtgttctcattgttgaattcccacctatgagtgagaacatgtgatgtttggttttttgtccttgcgatagtgtgctgagaatgatagtttccagcttcatccatgtccctacaaaggacatgaactcatccttttttaccgctgcatagtattccatggtgtatatgtgccacattttcttaatccaggctatcattgatggacatctggattggttccaagtctttgctattgtgagtagtgccgcaataaacatacatgtgcatgtgtctttatggcagcatgatttataatccattgggtatatacccagtaatgggatggctgtgtcaaatggtatttctagttctagatccctggggaattgccacactgacttccacaatggttgaagtagtttacagtcccaccaacagtgtaaaagtgttcctatttctccacatcctctccagcacctgttgtttcctgactttttaatgatggccattctaactggtgtgagatggtatctcattgtggttttgatttgcatttctctgatggccagtgatgatgagcattttttcatgtgtcttttggctgcataaatatcttcttttgaaaagtgtctgttcatatcccttgcccactttttgatggggttgtttgtttacaccgataacagacaagcagagagccaaatcatcagtgaactcccattcacaattgcttcaaagagaataaaatacctaggaatccaacttgcaagggatgtgaaggacctcttcaaggagaactacaaaccactgctcaatgaaataaaagaagatacaaacaaatggaagcacattccatgctcatgtgtaggaagaatcaatatcgtgaaaatggccatactgcccaaggtaatttatagattcaatgccatccccatcaagctaccaatgactttcttcacggaattggaaaaaaactactttaaaattcatatggaaccaaaaaagagcccgcattgccaagtcaatcctaagccaaaagaacaaagctggaggcatcacactacctgacttcaaactatattacaaggctacagtaaccaaaacagcatggtactggtaccaaaacagagatatagacaaatggaacagaacagaaccctcagaaataatgccacatatctacaaatctctcactttgacaaaccggacaagaactagaaatggggaaaggattccctgtttaataaatggtgctgggaaaactgactaaccatatgtagaaagctgaaactggatcccttccttacaccttacacaaaaattaattcaagatggattaaagacttaaatgttagacctaaaaccataaaatccctagaagaaaacctgggcaataccattcaggacataggaatgggcaaggacttcatgtctaaaacacaaaaagcaatggcaacaaaagccaaaattgacaaatgggatctaattaaactaaagagcttctgcacagccaaagaaactgccatcagagtgaataggcaacctacagaaggggagaaaatttttgcaatctactcatttgacaaagggctaatatccagcatctacaatgaactcaaatatccggtaatactttcaaccagcatagcttaatatgcatcataaaacaaatggttttggatgagagaggtacattttttagctttaaaaggaaacattcattcattcacagagtaagagctgtacactgaaatgaaaataccatccaatgcaaaatatgtggaatcccttccccacagctctgactctagttagatataatacatgtcatacttatagacacacgtacacaaatggagtgcaattgtcacatcttaattttgaaaaatgactgtatttaccaaataattattcccttttaatatgtcattttaaaagcatcttgagagataattttatatttttattttttgtgggtggaaatacacctcaaattttataataaaattagaaatggcaaggagttctatgtatcagaaatttctttatggcaatttaagaaataaaattgtcattctgaaaagcgatacatatcaatatcaatgatagcccacataaatgaaggccatgttcatctgctaattcagtgaatcttattactaaagaggtagtggctattctgtgttgggactcatttaaatatagagatatctaaaaatataaatatcctccctacataaaactcttcaacaaaagcctcgctgcccaaactcccaacaatcttccctctcagcagaattcattgtctcaggagttttccccaactgtcccatgaagagaacacgtcgcactttattttataagctttttatttgtcttgctccccaaaagagagtgagatttgagagaaggcagaaactgtaacttacataaaaatatcaataacgattgatgataagaagcagcagcagcagtagcatcgatagcatttcccaatacccctactcctgccccaagcacaaatctgcctcattatgtcctgaattcccagcgtccaggtgggtggcagtgggagccctcctcctcaggagatgttccacctgcctgctacctgccgcagtgtttgccttgtaaccaggccattctgtactcaggagctacaggcaagttactatttctgcagtgacatttccttatttcttggctgtcaaaaacagaggctgttcaggtaccagtcctcctgctcttgagtaagagaagaaaatgctgtatttgtagtgaaaagggtgctggttcaacgctagcaggattttccaattgaaggggtcaaggaaacatgtgcagattaaacaagcacaatttttagtttcattatatttatatgatgattgtagctacttattagttatttataacccaccacagctggttcggtggctcatgcctttaatctcagcactttgagaggctgaggcaggaggatcagttaagcccacgagttggaaacctatgggcaacatagtgagatcttgtctctacgtttcttttttttttaattatccaggcatggtggcatgcacctgtagtctgagctactctggaggctgaggtgggagaatggcttaagcccaggaggtggaggttgccaccagtcaaaatcacaccactgtacttcaatttgggccacagactgggaccctgtctcaaaaaataataaatgaataacccaccccattctaagcaggactatgatgaaagatatataatagaaaagtatgatatgaatcaattagtgaatagtggaaaagaagaaatgattgtacacacaataaatccagtgtgaggctaatacctcaaattagattacatacatagtagagttttctatgacaagcgtcatctttgctaacattgctattgcttaagaaataccagcatcattctgtaaacttaataaattcagagagaaatattagcaatttatccccggttcaccttttacttctaaatgctagtcagattacaaaactgcctagatattttgcaggtcattgaaaagacactagagtttttgggtggaggacaaaatagaatttttccaacagcattctgtttttttttttttaatactttaagttctagggtacatgtgcacaacatgcaggtttgttacatatgtatatatgtgccatgttggtgtgctgcaccgattaacttgtcatttacattgggtatatctcctaatgctttccctctcccctccccccaccccacaacaggccccagtgtgtgatgttccccttcctgggtccaagtgttctcattgttcaattcccacctatgagtgagcacatgtggtgtttggttttttgtccttgtgatagtttgctgagaatgatggtttccagcttcatccatgtccctacaaaggacatgaactcatcattttttatggctacatagtattccatggtgtatatgtgccacattttcttaatccagtctatcattgatggacatctggattggttccaagtctttgctattgtgaatagtgccacaataaacatacgtgtgtgtgtgcctttataacagcatgatttataatcctttgggtatatacccagtaatgagatggctgggtcaaacggtatttctagtctagatccttgaggaatcgccacactgtcttccacaatggttgaactagtttacagtcccaccaacagtgtaaaagtgttcctatttctccacatcctctccagcacctgttgtttcctgactttttaatgatggccattctaactggtgtgagatggtagctcattgtggttttgatttgcatttctctgatggccagtgatgatgagcattttttcatgtgtcttttggctgcataaagacgtcttcttttgagaagtgtccgttcatatcctttgcccactttttgatgggattgttttttttcttgtaaatttgtttgagttctttgtagattctggatgttagccctttgtcagatgagtagactgcaaaaattttctccccttctgtaggttgcctgttcacgctgatggtagtttcttttgctgtgcagaagctctttagtttaattagatcccatttgtcaattttggcttttgttgccattgcttttggtgttttagacatgaagcccttgcctatgcctatgtcctgaatggtattgcccaggttttcttctagggattttatggttttaggtctaacatttaagtctttaatccatcttgaattaatttttgtgtaaggtgtaaggaagggatccagtttcagccttctacatatggcagccagttttcccagcaccatttattaaatagggaatcctttccccatttcttgtttttgtcaggtttgtcaaagatctgatggttgtagatgtgtggtattatttctgagggttctgttctgttccattggtctatatctctgttttagtaccagtaccatgctgtttttggttactgtaataatggtttacattattagctactggttatttttgctatatgtaggaagagaatgttttcaatccctacatgtcagagaaatggaaaccagactccccttaaaaactgtctggatgctcaaaccgtgggtgttcataagaaacttctgagttgattcacaaagtgagttcattttaaccttgtaaatgtttgatactatttttataagtaacaagaacaaatggccacttcctgtaacataacatagaaataatattccggttgagagtgttcgagtaaacaatgcagtacccaaatctatacccttcccccacacacacaggcacacacacacacatacacacacacacacacacacacacacacacacacacacacacaccaatcgccatggctaatatcaagattaggttcaaagacaccagaactcggacagttgatccttttgaggcaacataaatatggtcagcctgagagtcagtccagtcaaggttcctgggaaaactccagaatcatgtctgagggatgtactaacacagggcaaaaggttaggagcaagactgaaattaggttgtcagtggagagctcaggctcatgtggggtgggatggaatgagaccaactctggccaaggtaggagggtcctggctgattcccctcaaccatctgcagtggttttgtggctttgctcgcatgccagaggcagaacagacagacagccgacagcagctctggtcattcctgatattttatttgtgttcttcattggactggaatgctctgctactatgcgtgtctacttgtgtctgtgaagtgtgtgcatgggcacgtgtatctgagtctgtgtctgtgtgactgggtgtgtctttgggcatgcgacatttccttttcccaagttagtgtgctttgtgctgaaagccacatgaagcgtcagtaacacagacctcctaagagatgacagagtggctgttctcacccataaatggtgttgctagaggatgtggggagacttctcacttaaggtgctttggttaggaacatgtaaattcactgtttttgaaatgtaagtttcagacagggactggtaaaataatgtccagcctctctcacactgtcacttccccacctaggtgcacaaggatgtgaataaagctcccactgtgcactgctttgccatctggaatcccttaagcgagaactgtatcttttccagcgcagctcatccctgctcattcgcctcattccttggtgtcaatttcaccttctgccgccattaaggtccaaatgggcggcagggcacctctgcacactctaattatgctaataacggctcgctgactgcactaatggggtcattatcgcccctcatgaccatggggtgcaaatcgccactttaacatcatcattcctgtcctaatccatcactatccttcacactagccattcttagaacccaaaaaactctccctaaaaaggatgctttgtgcctgtgcttccaggaagcattcagagatgaaagcatgggggactgagggcaacatgcctggcagagattacagcaagttacggaagagagaaggccctctggcaaggttttgagatgcagggaatgaaactaattcatgggtaaaggattctgacatgaaattggaggtgcacactctggcttatctaggtgaccgagggccggcctgggagctagggacctgtcttctgctccagcagctctggttggactacacaaaattaatgggccttcacgtttccatttgcagcatgagaatggtaaaaaaaaacagagtcagtcaggttacgggtcagtgcaaagtcaaacctccaagcggataattcagtagccacaaggggacaaactgcaaagtcccaaatgtgtctagtgttgacaaccttctctcagctcgcactacataaccaaagcttatgaattcagcctccatgttcccaccaccaggctcccatccttattagctccgtggctttgagcaagttgcttaatcttgccaaagcttagtctcctcatctataaaaagaaaaattaaattattgggcccataagactgatgatatgttaagccctattcccaaaccttatacatggtaagggcccatccaatggccattgatattacttttatctacagacttggatctaagtttgaggcatcttgcactatgatatcccagcatcaccatgtatgctaaccagtcagaattttctagtctacaggactacacatgaccatttttaagaactaaatcaacatattatattaaactgagtggatgaaatcaaccacatggcatttatgaatatagtatcaatttctttacagactttagaaaccgatttgactctacttgtctctgggagagagctaaatttcgccttccaaaaaaaagctgaacagccctcagaatgatttatgaataggtctttgatgcataaaatctcattttctttagtgcatttgtcaaaagatttccccatgtgtgtcttgtgcaggacttggttgttgtaaccctctcagcctcccatgcaggaggagtatttttcctgatgctttctcttgataggtcttgggatgatcatatttgactgatgtgttagtgttcttactttaactcgtgcactatgaactttatatcatgttttacttcccagcatattaatgctctggtcttcagtgcagatggagtgaagccctaaaactcagccccgtcagccaattaggattcatctgacaagcgacactttgtcttttgtgtgctagcctgggaatggcaaaaagacagcatcttgtttgccttttcaaaaatacacccccatagaatagaaattacgtacgcttttgctggcttaagcataatatagatttattatgtgggaaagatagatgagagattttttttttttttacaatgctgggaaggctttaaaattatttactgtcctcattatcattaggaagcagacattatctgatctatctctccagttttttatggtaaaactctattttaagattcataatttttaaagactgcctgcccctgaatggaatatgcaggctgcacggggaggagtgatacctgatggggtgtcccactgccatctcaaaagcatacttgaaaagttgagaaaacattttctaacaggatgtgaaaactgagtcttgaacggagtggatactgctcagaagaatatttgcgaaggaatgactgctgaatttatgtagtgtgaacatttaaagtaaaaattcaaatcctcacctttggggtcatggtgattaatttccattccaaatgtaactcttcttataggcaagaaatccagtaaatattcccctgtgaccaacaaccccgtgagctgttggcagaattaataaagctgtcaggatttctttgggatattgcacgtctccctgtatgtcatttaattgtgaagtgtaaatatgcatatggcccatcaggaagactaaatatattagtctttagggcttcagctcctgtttctgtactcatttatcaattttgattaaattaggggagaacattttgatacaaaaatgtataaaatttatgtagctttctaggagaatgacttgcattgtttatacagcataagcatctggggagaaatatatatttttctaatatgcagctttggataatataaaatgttctgtatacaagattatgttcacagcttgggagaatttggggaaaatgctcctggcaagcaaactgtttttaagaagggaaagttgaaaaccaggagcagagggaaaacataatgcaacttctattttctcgaactttaaaatatgcagcttccgaggctgactcacaatccaagtgagacctctgtcagaagagtctgagtatgcagagggaggggtgcagatggagtgagaacacttatggtaatgtcaggatccagctcaatatttcaaagcaatgctttctgtacaagcgaagcacatttgcaaggggattggcctttactgtgtgaactcagggctatctttcgaccaatagataccggccaagctaggaatgagtcagtggtttgtgactgtctgcactggttttgctttgaaacagtcaaagaagagaactgccatttaaaagagtagcaagaaatgtgtgagcattgtaattggacattagtaaaatccaagtgtgagtttgttgttgtgttgttttgttgtgttttcccttccctttgagtgtcgatttgtaaattgatgtactgaccactttgtataagctctgtgttgtacagatattataaatttaaattcaagcaaaagataggtaagaatatcccccttttacagatggaaggatcgtgttcatagacattaagaaatctaccccaaccctacagtgatgtagtgctcttctgaccaagatgggtcctggggccaaatcgtaaatagaggcctacctaccatatgcttacttaggtaaatgttataaatgatgctaccaaacttaaataatttgtgttctctactcctttgttaacaagtatactttcacagcaatgtggaagtctagggtgaaatcagagcaatacatgatacacatcacccctgcccattcaatatctgactccatccttcaagtcactgggggccaagcttacatttccgggttgcccacactgccccagtgtctacaccttggtcccataggtgcccacactggtcttgtggcctggcctattttcactgggagagtccttcacaggcccacaagtgagcttagagccctttggtcaggaaattctgaagtttggatgcatgaaacatggtgtagaccagaatgagagggttgggtggaaaggcagggggagggaaggcttccaagttcgctcatagcctgccaggacccctaagtgctcgtggcatgggaaaacaacagcaacacccaaaggaggaccaaagcaggggccctttaaagcaggaagcccaggagagtaccccctgctccccaccacccatctaagggaaatactaccacctgggcattgtgattgaaaggaattaaattcaaatcaagatcatgggactccaagctgatattttatccactctactttgctgacttcctagtattttaaatgaaaacctaagaaaaaataaaaatgtgaatctggtcatctatttcaggaatccttttcatagtaacaaaataaaatattttaagagtcacatcccagtgcagaacctttgagtaccttgtgcccttgagaagtggccacaggtcccaaaccagggcccccattaagctgagctaggtttctttctttggggtcttgttgaattgagccttaggagcaccccaggactgcttatctgctagtaatgcctgcgataagatattcagggctctgttgatttcccagctgtgcttccagtgagcgacaggagttttgggacactttgtgcctgcaatcgctgggagagaacagccatgataagcaccagggagagggatttttttcgcctgtagtctgaacacggaaagtgataagagaggaaggcctctgcagactgacccgaaaagcaaatgcaggtggaacaaaaggcagccctgactataagaagataaggcagctgcacaattggtagctggctgcaggatctccatccattcaagtcacgaccttatcctacagcatgtgatggagcaaagaagtaaaaaatgtatgttttaaaaaagaagtctcaagattttctgtagtaaaataggtcaaaacatccagtcaaattgaaagaaagcaatgtaaaaatttgagtcaactggaaagctgggcattgtttggtcagatcgatatcccacttactcaaatcatgtctgcggatgttaatgaggacaaactagtgctagagtagcgaaagcataacagttcttatattttttaaaaaatatacaagtataaataagctatcatggggaccgggtgtggtggctcatgcctgtaatcccagcactttgggaggccgaggcgggtggatcacctgaggtcaagagttccagaccagcctggccaacatggtgaaaccccgtctctactaaaatacaaaaattacccgggcacgatggcctgtaatcccagctactcaggaggctgagattggagaatcgcttgaacctgggagacggtggttgcagggagccgagattgcaccactacactccagcctggatggctgagcaagactccatctcaaaaaaaaaaaggactttatgaaataatttttaaataatcagatgtcaaatctctcatagggagcttagcagtgattctgcataaaggccataggcccaggtcccagccacacacctcatttcagagatcacagtgaggatgaaatgacaaaaataaagctcctaggtcaggggctggcaggaggtgagtgtgtaggacagtccaacttcatttcatgcatgtttggagacgggccagggtcacgtctgtttgacaagcagaatatttgagttctctaagtttttaaggttctgtaagtttttaaggaggagagtgagaatgactactgagtatgtaatttggtcattttaagtttgtaaattaaatgccacatgtgcgcgtgcttgcgtgcatgtgtgtgtgtgtgtgttttaggccaagacaaaatgttaccacatcaaaattccttatccaaaaaagtcatgtcaaataatcacattccaaaatacatgtaaatggccatatcaaaatgacagagtcaaaatgtcagatctctttctcttccacctcaatcctcccactgttagaatatgtatgcttatcacactacgtgcccccatgttgggttcctaagttatggtcttcaatcccatcaagcgaagttttctgactgctggactgtggcaaggaataggatttttttatagagagatgtcgattctttcagcccttggagctgctggtctgggcccgtgtagaacccctgtccctgtggtcgtgagcaatctcctactgtgctatacctatataatcaatgaatgtttcgatgtgaaaaaggttggaaaccatggccaggcaactctagaaagggaaaagatgaaaatggtttgaataagtcagaaaaaaatgtatgaataggtagatttttaaatgcacagtcttgagagaagcacagaatttaaaaaaaaaaggaaaataaattccataagaggagaacagcaagagacaaaattaggagtgcaggattagaaggtgtgaaggaaacagtagtgtggctgacattctggaggggcatgtctgggccaggagactgcaaccgaagcccatttcatggtcagagaggcctggagatgggggttggctagaaggcaagagaaaaaggtggcctctgggtaacgatgtaacaggatgaatgtgtggtttgggaaaatgcactattaactgcatgcaggactgatggaaggaaaaggtaatggagtcaacaaaatctgatcagggtctctctgaagttatacttcttaggttttcatcagaaaaactttggcttggaaaagatacagctttaatttccttcatttagtttttttttaatctatctatctatctatctatctatctatctatctatctatcatctatctatctatctatctatctatttattgagacagagtcttgctctgttgcccaggctgtagtgcattggcacgatctcggctcaccgcaacctccacctcccaggttcaagtgattctcctgcctcagcctcttgagtacctgggattacaggagctcgccaccattcccagctaatttttgtgtttttagtagagatagggtttcactatgttggtcaggctggtctccaatacctgacctcaagtgatatgcctgcttcagcctcccaaagtgctgggattacaggcgggagccactgtgcctggcctaatttccttcattttaaatttactttatatatttctaaaacaaataaatacagttttctgcttgagaaattcctcttggtatggtttttaagctttaattgtgtatgcttgtgacataaacttatttttcttgtcctccacatttgagactttgctatagatagctaacatcaaaaattaagcagcaaagaagcttatttctgagatatttttagttttcccaattcctgatctggacttccagttttcatttattttcttaagttctgataagatggattgctttggcttatgaagtaggtactttttctggcaataaactttacttttaaatatgttatgaaagtggattgaaatgctctttaatagaaactagctgtggcatatatataccagacatttttatacagaatgtgcttacagaaagggaatctgaagcctgagaactttgcagaaaccatctgctctctcccccacctcttcagaggagggcagaaaagaaacagagagacaacatgttaaaccctagaattttaaagtcaagataatgtaattctggctttgtcattgcacagaagaggaagaaggagtgggtgaattaaataaatttgaatacagcttcctcaccattcattagctatatgctgatcagattgcttcagtgctctgagcctgtttcctataaaattagataacagtatctgcctgacagcactgttgaaatgattaaatgtgcaacaccagtaatgaggtaaaagttcattaaatcatatctatacaatattatttcattaatatttttatgaaaaataattcaaaacatcgtagaaaagattattaggttctgtttggtaaagtaaagaattcaatgcatgaatcttctaaaaactatgtctaactattggatgaacaaatgcatgaccctgtaggtcatttcctcaagaattctgcttagttcttgaccctcttctccaaaggatagtgctaaaatatagaaggcacggtgacggacttgattctgatactcactagctgtgcagccttaagaaagccattcagattttctggctaagagatctaggagtattaaataagataaagtgtgcaacatacccagtataatgcctgtcacatattaaatgctcaataagcattggtcctgtattcttagcacctcatctgtagtgctagaatgctaccagacttgcctatttctcaggttattttgagttcaaaagatatagtgggtgatatagtgagagacattatacatatgcaagctaaaattaaaagcaattatccaagatcagtgttctgatatggaacaatagatgagaaatggaaatcctgatagcttgaagagaaagatggacatccaggttccccttattgagtatctgctctcgtcctcatttaatttgtcagcttctggagctgacttaatgagtttttctcagctgctgtcattgtttccttctccatcttccccttacaattagagtttcagaccagaatccctacaatttccatttcccaaagacagaacatatacacggtgtgctttcaggatggatgccatgttgacctaccaaccctggaaaggaacaaagggagtgtcccccttaaccccgacctgctaagctgtaaaccctggttcacctgaatgtgattggagcatggtattgtggtctccccaacaaagtccagaaggagtcaagtgggggcacaacttgtaaaatttccttcataatgaaaatgtgtgttctttataaatgacttctctttgcagtaattctcttccctataactttatttataacaatatttttaatgttgaccttgaagctcaaaaactttaaataacttgaccaactacatatgtccagttagcaaaattgctggagaagaggtacaaatttgtgtgagtccacatttgtaggctggcattggcctggagaaatatctagcaagctgcatattcagcattaaatgttcaaatcacctcattaaaaaagctcaaagagttgacatcaacttagcaatatatttaagcaaatgtaccccagatattattatttcaatatatgataattcaaaattatcagttagcttgctgtttttgttttgctttgtttttgtattaagatctttaaaactcagtgtgtatgttataccaagagcacaccttaatttgcactagccataggtcaggtgctgaatagccacatactggacagccacctcactagccacctcccatttttaacatctttcacagacagcatctaagttataaggtacactttaattttctaacacttgtggaggcttgaaagtgaccaacagtgaaagaacaaaaagtcctatgtttattttcaccgctttttccctccctcaatattgtcactggtaaactgagatcttttcccattttgtgtggattgcacagaagaacctccagctggaaaagacaatcaggtttttttttccgctggccagggaatggagaaggcactctcttgctctaaatgcacctctccccaaacattagaaagcatagggtttttaaggactgggtacatggccagagaggaatgtttgcatgtgcagagtgggactccagacgtgcagacttaattcataagtatgtcttcatacaacccacgtaaacaaaatagcagaagttttcttttagaggtggaatttttgcattataataatatgttaatgatctaaaggccactagggattgtctgctccagtgttgctggtttggggttcttatctccctctggtaatctggacagaggtcaagaagctctggcaccatcccaggccatctgacttctttaagcagctgtgcccataaataaagggactgtattaacccattttcatgctactgataaagacataccagagactgggaagaaaaagaggtttaatggacctacagttccatatggctggggtggcctcacaatcatggtggaaggcaaggaggagcaagtcacattttacatggacagtgtcaggcaaagagagagaacttgtgcagggaaactcctctttataaaaccattagatctcatgagacatattcactatcatgagaacagcatgagaaagacccacccccatgattcaattacctgacactgggtccctcccatgacatgtgtcaattgtgagagttacaattcaagatgagatttgaggggagacatggacagaccatatcagggaataaagaaaaacagtaagaaaaagaacttttccagttgtttaatcagggctgtcctggtaatgaggttgagtttctaaatctcagtatcagaccattcattctaattccattaccctaaacctaaaccactctgtccaatcagctacagtcacgtgcctgcttatgaaccacaaatcccaggatgatcacctcattgcctaaatccatattttcaaatccagcacaaaaaaaatctactgcatgggcccaggtcctgacacattacctcattatctatgtgtctgcaccatcttctggctgttgatgcctcatattgacatctctgtgtctatttcaatttctgacccaatgttttatcctaatctctaatcccccttccaatggctgccttgcttcttgacccatggtttttcttacattctgccaagagtacctctttaccatggtttttctcacatggcataagacttgcttgagtaggatgactttttagttttgtctacaatctccagtattcttggcatttactgcatgcttactcaatttcagacttccacaaactacatgatctgaatttcattagatgcctcccaagtgacccaatgagaacaacagacttgtacctggtcatcagactttctcctgacttggattcctcatgtgacttttagttgccctgccaagtttgctgccaatggaactgtctaatgtctgccaagtgaaagggttttttgttgttgttttctttatttgtttgtttttttcccttaatttcaagtactatgagatttctcagaaataaacctagcatccttattcagcaaacttcacactgaaacactctgtactcctgggaaatattttaagagccacaaaagccaaaagtatatggaacagcttcttaaataagattttccccatgaacttagatttaccttgtgtgatataatacaagtctaaagttaacaatttcagaggaaataagaaataaagaggaaagaaaactaatatcccatgcctaagggcatatcaggcacacttcaaatatgaaatgatgtaaaaacaaaataccttaataggcaagattatatccctgcttttaacataaaggaagtattgacttatctaattaaagactgaatcaagaaaacaactgagtggaacagcttctcctagttggcatttttacaactatgtcccttgatttatttaaatgatacatgcacctagtagatttcaaaatattaattcatcaaaatctgtacatgtttggatgatgagcccaatccaaggagtggacatatttgggcccaacctttcaaacttccaagttcagagtctagatgaaaatgacttcccaagtctaaagctgatattagctaaacatgtgacagggcctttcccccacgattcatctataaatcctttaacactatcattctctgggctggtcagggaaaatcttcatttgggcgttatttttaagtattacacatttaaagactattatagacaaatgagtgtgcacccaggggacaaacaccagcagagtaaacatattaaaacccagtaacatgtaaaaggttggaaaacattacagatgctcagtctgaaggctgttattttggcaggattaagagaggagacatggattccatgacaagaacaagaagccacagaaaaatggggctcagcaaacatcagtgggtgggaccacctcctacctgaagtggtgcagatattagatgggggaggtgaatttaatgaccttgacaggcctctccagccctgagattctatcataaaatattcctttcccacaccacatgtaaaatataaatgttgctccctgaaacccaaccaagaacaggctgcttttaaataagtgagaaaagagaatgcctgctagtgaggactttatactttgacctggggtttgtttctctataaataaccagcaatgcacatcgccatgcaagatgggcttggcctcagcatatcctcctggtctcattttccttatacctgaagggtagaaagctcaggccctttttggccttgggcaagagagcttttattgattgcacttgtcatgagtaatctgcagccaaaggagagaaaccatatgagtcctataaacagcaagtcctggtattgcatttgccatattttcaaaatggatatgatatacaggagtgatgcagaaagctaaacagtctataggtttattcctgtctccatgaaaccccaacatgtatttctttaaaaagtgatggggtaaaattagtctttattaactttcatttccaagaggtttactaaatactaccattttacattaaaataaatattgggccaataattctttttcattatttttataattgccatttcaaccatctgtcaattaccttagcacatcatttgtgaataggttgatctgctagcaagaacagctctaatggaggcagggcatggatttgtcttttgccatcagaaatccaggcaattcaaggctgatagggcaaacatcaagaaactagtaagtgcaggagctatgattttaatctagattcatttgcagtcagggtccatgcattagcaatcaccaccatgcggatatgcagaaggggccagcctcaggaaacaggtcattccataactgcccttgttaccttcccatcaagtgcccctgttctcccagcagaggaaacagccacgtcattgtgttaagctatcagtgccagttcctcctccagtgggtatctgcaacatcttcactgggggagattactgttaaaaacgctgaaagaaattttaagacagagatggcagatttcacaaatacagatgaagcccattcttaagttatatgggataataagctcattggagttgcacaaaaaatccaagatcatcaaggcaatggacccaatgctatatttaaggagagacattaaaaataagttcataataagatataagcagattctactcatttaattaatttctaccaaaagaataacaaattaacttgaagataaaaaaataatgggaaagaagtgataattcgattaaaaagtaaggcatttgctcctatagagaaataacataaacagatttttgaaaacatttacctttgcctaattattcattacgctcagctttatatggaaatgaccaaatcttaatatcccagatggcccatcatgggttcactttctatccacaatcaaaacaaagccctagacagtcagtgagttcaacattttctgcaaattagtagacattttgagcaaacaagcctcatgtggatgatgcagtacttcaactgaatgatcaagagcttaagatgatgtggaatgctgtcatcaaacccaatctgctcattccaagctgtgatttctgactgaaaaacaggtgacctttagcaaatagcttgaactaaggtggaaagatatgcatacatattgagttacattggtttctagcctttgattttaccagtgttttaaattaatctcctcttctttcctccttttccaatccttattcttttctcatattttcttatttgtgtcctaagttcagtatgagtaaacacataccttcttaaagaacatttctaacataatttagtattgatcttgtttatacatcagtttaggatgtatgtagaatttgtttctattcactcatttaattttctgttcgatatttactgaacacttgccaagtgtcaacaggagacctgaacaagacaggttctagaggaccatgggctgccacatatcctagacagagctaacactagggtgacctaatagccaagtatttcctgggacagctctgattgacgccgctgtctgagcatgactatactgactttttcatcttcaagtgttctagtttggaggacaaagtctgtgatttatctatattcttagttaaaactgtaggaagtgtgtgtgtgtgtgtgtgtgtgtctgtgtgtgtgtgtgttttaaattggtgagcttggcagcctgtcttcctatgtgtagtttccactaggttaagaaacctcaagtcatatgattgacaagggagtgacataatttgcatatggaatgaagctctgacacctaccagaaaacagaggaaccacccagaattctgtgtagtatgagctcatataacagaggtaatgataggtaacattcactgactctacactatatgtaccagactctgtgctaaaggccctcaaacttcattcaaacctcaccaatatccatatggtagggaaggacatttatttctattttcttattgaagacacagattctgataagtaaagttagttttacttatcaggggatccaaccataacctctctggaacctaactagggaatgatgcatattgactcactgcatctaaaaagtgctaccaattacacagaatctcttctcacccggctgtaaatagggtagagagaaaggatgtgagaggagtcacaaccattgcatttgatgagcttgtgtggtttcccactttctggtgaaacctgttggattcagggattcatcccttaccacccatactccaatctccttaccttcaccctccccagtccctacatatacatattatacctttgtcacctaaaaaaaataaaaaatgtacatttaacctctgttccatgcctttcgtcctcctaatatttttctttactttatacttaaacatgtaacttaaatatccatccagcatttgcttctagaaatttagtgttctctcaactatatcagaaaattcctactgcatgtgtttcaagacctgattgtcatccttaacctcttatttctgtttaaacatctcagccaccttctctgtgattattttatatatatacatatatatacgtatatatatacatttttttttatttttgagacagagtcttgctctggagtgcagtagcacgatctcagctcactgaaacctctacctccctggttcaagcaattcctctgtctcagcctcctgagtagctgagattacaggcgcccatcaccatgcccagataatttttttgtatttttagtagaaacagggtttcaccatgtaggccagactggtctcgaactcctgacctcaggaaatccacccgccttggcctcccaaagtgctgggattacagtcatgagctaccacacccagtcactgtgattattttttttgccacaagttttctacaccaccagtggcacaaggctgttcgttgtatagagtgagattttgctgacattttggtgacaatggcgagtgatttcagcaccaaagggagacagcaaaacgttgagcattgggtgtcattctacctatggccatcagctattatttagctctagataattaagtggcctctagctttggaggccccagtcccttgcaactattatgtcttcaaatcaagacacttctcttatcccatcttgttacatgaccccagttctctaaaaaaaaaatacatttattttgtctagttattaaacaattctaaaaataacaaaaagtccccatgcagcagaataatcatttcccctgagaaaggaagccaccatttctgttattgtaccttgctttaactactttggtttagaccttcccataaccaaaatattcattaagctgtttctctaaataggataccaagatatttcttctactgccactctagaacaaagaaatactgaaattagcttttaaaccaaaaattttgtcctaatgatgtaaataaaatatatttaattaagcatgaaaaatgtatttattgaactcctgtaacactccagcaatgaggggaagaagattatggggctataaagcagcatagtatatgaatcctcaaagaattgtcaagtcagtttaagagagaaaatttttgaagaataaatacaaaggaaaaagaggataaaaaggctatgcttttcttttacacccccttctcctgcctcattagagaaaattggtatgaagattaaaagaagtctacgaaaataaacatattctttaaactttaagtaaattaattgaaattaattcagtgcttatttatttcccaaactcctatcccttgagaaagtgatggcactcggagattttgcaaaaagagtattctaaattgctgttcagtaaaatatctcattgagcatggtcaaagtagaaaacatagacttatgaaaaacattttaccatggaaagtttcaggtgagtaattcttttctcaaaaaagatattgtcttgttatgtttttacacatgaagatatttaaaagattaccatctttataaagctagtgtcatcctacagttaagcgacaagaagaagccaacaacttgaggaaacttggcaaatgtggttctcctgggaccaattaggtaagaacaggagaaatgagcttttgcttgcttttttctgcagtggtttcacaagcgggcttcagggttgttgctgaccgactacggaagccggatgggaccttttaagccagaaagcgagaggcatcttttagagctctacttcctcaggctcaggccgaacagcaatctctttctgtaactaacccaagctcttccctcacgtaatttctcccaggagcacataatttctcccaggattcccggcggcatttgtctgcaggcacgttacatcttcactctttttcagaaaccaccctccctgtcctttcctctttgcctgggatgaatccccagtcccccatatgttagatgcaaagatccaaggcaatgaggttttcagggtctcaagactagagctgctaaaaagtttagacataggtagagatcccaacaagcataggcacccaaaaagggcaaagcattactgatggtaaaacaaagggctttgaaatctgacacacttgtgtttgaatgccagattattagtatactaacggtgcaccttgtgtctaatgtttagctacaacaaacctcggtatacttatttctgaaatgggaatcatagtgagttttgaggtttagaactgatcagtataaagaactaggtgttcaataagcaaatgtcatgtctttgaaatgaaaatgataaacctacgtggatttattttccctttattcatctttggaattggttgtaacagataatttatgccctacatgccagagagtgttcacagccagtctgttctgactgatgcagatctctccagaatatgctcacagcaccaagcacctctctgtaattgacaacagctgaaagtttctatttattaatgtatgtagtttaaaatgtgttttctaatagactgtaaacttcttcaggtgaaggactttttttttttttgcatgaatgtttccaaggcatacaaagattcctagtgcaaaattagcacacaacagataaatacattaaatcaaattttaaaatgagccttcaaaaatggttttcccatttcacaggtgagaaagctggggctctgaaagaacagtttttctaaagtagcataggtagtacagagggtctgagattcagaccaagaagtgattctctagagtcaatattagtttctattatatatgaaatagataatatatcattactgtcatttttcaatcagtgaataaacagaagtccagagaatgttaaacagatgtttgcagagttggggctcaaacccaggcctccaattagatgtccattgctcttttttttttttttttgacctactttcgggtcaccatgaaaaccattctcaggatattcctaccttaactttgctcttggctggctgtccaggatttgcttgcctaggcaggagcaaatcttttttccactgtatgaatttgtggagtcagtagtcctgccagagtcttggtttggtcttggttgaggaggtagctttcagctatcacctgcttgcttgttctagttttgctggagagcattttcccctcaacatttttggcaggcagccaggcctttttattatgtggaactgctcctcaggacacaccacaatggaatgtcagagtgtgatgctgttgggaggttaagtaaaagaggtcacaagtcttgccagctcaggggcaaagaggtgagctatctgaccctagcatctgctgcagcactgctgtgagtgccacagttggagacatcctggcacatgtgtctttgggactcaggtgtgggctctgtgagttgtggactcttgtaagccaactctggttgcagagaggctggcttcaatcaagcacataggaataaattcaggagacaatggaaacctactctgtcttggcaatattaaatttttgctgagaagacttgccttgatcatggagaatgaaagagggactattagtctgtttgggctgctgtaataaaatactacatacgaggtgacttataagcaatatatttatttgcttctcacagttctagagatctggaagtctaagatcaaggtgctggcacagtttatatctggtgcgggctttctgtttcatagatggcacctcctagctgtgtcttcacatggtctctggagattttttataagggcactaatctcatttatgagagcctcaccctcatgaactagtcacattccaaattgtgcacctcccagtgttactgcattgttgattatgtttcaacatgtcagtactggggtagggaagacacaattattgagaccatagcaggggcttttcctcttagcccagtacttgtactttacctatgttctcattgttcagctcccacttataagtgagaatatgcggtgtttggttttctgttactggaacacaggatgttctaaatgccatgctgagggtgaggcctacaagagtaagccaagcagagctcttgcccttcagaagcttatagtttagcagaggaaccagataaatcaaaacaatgtataagttttgttaatagttccaaaaggaggaatggtggtttttcaaatataaaacaagtctttttccacaaggctactgcctggggaaccatttctagatgggtcagggaggcccccagatgtactttttagatgctcaatcatgagaagagttggggtttcctagggaggggctaggttggccagaagctatttggaagctatttgttcccaggaagggaacaacacacactgacacctctcaggaggatgggggaagggagagcatcaggataaatagctaatgcgtgtggggcttaattcctaggcgatgggttgataggtacagcaaaccaccatggctcacatttacctatgtaacaaacctgcacatcctgcacatgtatcctggaacttaagattaaattaaaattttaaaaaagaaaaaagaaccaaaaagagagcatcttgtgttctcaagaaactaaaaggcccgggcaggtcttaatagagactaaactcacagcattcagtgatgtactggaaaagaatgaatgtttgaaacagtgtcatcaagctttacacacctataaaattgttatgcctgcttctaaggtggagtgtgtgctgggcagaagcagtaggctatccccaagaacacatgagtcagtggggaatgagagaaatgacactcccaagggaaaggcctgtgtgaaccagggagttcacccagggtattctgagacagggtcttgctttgtcacccaggctggagtgcaatggcatgatcatagctcactgcagcctcaatctcctcggctcaagcagtcctcccacctcagccttctcagtacagtttgtgaatttgaaacaggttagttcttggagtgtgaatatgcattcaatagtttggatgtgtttctgttttccaccgggcaacttgagtagctttagtttgtaagatcccagatagcgttctcttcactgatagttattatccgaatacctttgtaatgcctgagtcagtgcagttttgcatgagttccctggagaataactttcatgagctaacaccactttgatagctttccctccctttctactcttgggaatatctgggacataggctgagctcccttttcatagagttatcttaagaagcgagattaactatatactatgtaatgcatacattaaacaggaggaaactagattatatggagtcatttaaattgctagccaattttatgtgttggctctcatctcatctacagttttagactttctgtctttctacgtgctcataaagaaaaccctggatgtggcctggtgtggtggctcacgcccgtaatctcaacaatttgggaagccgaagaggttggctagcttgaggctaagggttcaagaccagcctgggcaacatggaaaaaccccatcctctgcaagaaaaaaaaaaaaattagccaggtttggtggcgtgtacctgtagtcagagttacttgagaggctgaggtgggaggatcacttgagcccaggaggtagaggtgcagtgggctaggattgtgccactgcactccaatgtgggtgacagaatgagaccttgtcttgaaaaacaaacaaacaaacaaacgaaaaacaagaagaagaaaagagaagagagaaaaccctgggtatgtaaatcttgttgacactgtctcaaacattcattcttttcaaggacattattggatgatgtgagtttagtctctattaagatctcatttgggtacccttttattcaggtgataaaatattttgttattaataatattttcattgagtcaatacttattatttactgatctctcattatacagcatgtgttttaaataaatcacattttattttgataacagaacactaaactaggtatttgaatcctgatttttaactatgaagaaaccaaaagccggaaaggtaaaatgatctccagcaggccatagagctactgattggtggttctgggactcaattcgaatctgcctggctctggctcacaaaggcctttcccttgggaatgccatctctctcattccctgctgactcatgccttctcggcgacggcctacttcttctgcccagcatgaactgccccttggaagcaggcataacttctttacagttacattccagagcagcaatgctcaaatttggtggcaccttagaattacctggggagctctaggtcccacttctagctatcctaatttcgttgttctggactgggactgagcatctggatttatgaaagttttctgtcaatgtggatatgcagcaaagttacaacaattgttttagagcagtggccctcaagtagaatgtgaacacaaacctcctggggatgtgttacagaaaatcctgattcagcagaattgaggttggacctgagatactgaatttccaaaaagcccccagtgatgctattctgttggcctacagaccaagacattgctggcaaggccccagaatctccccattttctctgcatagcccgcccatctcctcttttccaggtcacccttctcctgggagaaattctccagttcagggtttgcactgtgttttcaatgtagctgttctctttcagcagctcccgttaatcattggaaagttccatctcaactaaaactctctgttagctgagtagaatagggggtggcatgtaaagaagtcgaggtcacaagatcaatacccaagtttaatacccacagggaccagttagcttttctgtgccctgaacccaagtctccaggccagccatggctcagatgtatgggattgtccctgagagatgaatgcttcatgtccatcacacatgcaatacttaccagaacagcagccacagtctgactcccactcgctcaaaggtcaatagcatatcttgataggaaataaagacacagcaatgttagctacaatcgggtgcttacctgtgccaggcactgcggtaaacattttagaatccttgcaacattctttgaggtaggtggtctcattatctccattggataaatgaggaaatggggttcatggttttcaccttctgacagcatgcaacctgtagataacccaaaatccaaggacttaggccagtatgccgggtgctaaccaatgtaaattagggttgataaaggatttgcagctctttggcgttggaaacttcaaaatatgtttttctaccatgtccctgtcaagcttcgttaatctcggcattgtcccctctctcaatttatactgatgatgactgccttgtttatttattgtgtttttagagaagctcaaattagaccatccgtatgtttaaaaagaaaaattgaagaactgcgtaatattgggagcattttagcttcatcgaatctgtgcagcaaatgtatccacagatttacctaccataatatgagtctggtccttccaatctacccctcttttgatttgtcatcagtgtacaaggtcataattctcatctaagagcctagagatttccccagtcaactttgttttattctaatgtacctgactagtggagtctgcaatatttctataggttaaagaaacactaatgttttatttttaagtgaaaaattcaaggaaagctacatcttttttgctttagtgttcagaaacacaaatttttgatatttataatgaatactgactaataaagactacggattgtataattttgatgtttgatgttagtttgtttatttgagacagggccttgcttgctctgttgcccaggctggagtgcaataacgcaaccttggctcactgcagccatgacctccctggctcaagtgatgctcccacctcagcctctcaagtagctggaactacaggcttctgtcaccatgcctggctaatttattcttttttcatatagacaaggactcaccatgtttcccagactagtcttgcatgcctaggctcaagtgatcctctagccttggtctcccaaaatgctgagattacagacatgagccactgcacctggccaggacagtatcttttagtactaaagacaaactgctaaaaattaagtaccagatagcaaaactttttagaagtattcaccattagctttctctgctcaattcaccaattatactctcactgtaaatcaagtcaatcaattagtcaacagatttttattgaaaactctatacatggggcactgtgttgagacccaggaattgaaagagcccaatctaaggcctcctcacaaggagatgtgaccctttcttgtaaatagaattttaaaaatttaattgtttgcttcctctataaattattttctcttggtgtcatggaagatctataaattctgataaatacttttattttgagttaacttccttcagcatgctttggataataataaaaaatggaactcatgattcttgctattttaattaaattaaacccttgaaacccccgtctctcaagtgattttccactcccttctatgggtttatttcctaataggcactttattactcttgaaagtcatttatttattcctttagatacactgcccgtttttcctgcaatgaatgtttaagttctatgctgctaaaagtttcttcctggtttggtgttcaaagccaagaacagtgactggaaagtcagagaaactcaaccaactttccttgaatgattgtgtgaataaatgaaaattggctatgaatgtagtagaagtgaattctagccctagatgacaagttaaacaaagatgcctttttaagtcctctgtcaaaccataagactttagaattttacaattcagttttctaattaacaatgataaccactacttgagcagaccaatatataatcagaggggttaggtggccagtgacccaaagatgctagtcatcaaaacagcactcagtattgacattttctctgttgtattgtgctgtgtttcagtcttcaaaggtgtctggtatatatattttactttttaatcttctaaagaccgtttcactaattagacacctatcatttttggcaaagagccaaagttaaccttcactgtattgctctaataaagattgtttttaatgaaataggtgactaagctattgttaacaatctagagtaataaatgtatggaggattttcagctgtctaaagaaagagttaagtgatatagatataaaatttgtttcacatggcttaaaagtgtagacaattacagaagaatgtttaagggatatgaaaatgtataaggttgtgaatacaaatttgtcatcagtctccataatattaaaataaaagtctatttcttgaagcataagaaaattgtttcagcattagaagaaacgtaataaaatgaaatctatacatttataaccaattaccacttacgaacattcattgcatagccagacagaggaccaggccttcaatgtatattttttaaatgttactgtaatcctgtgaaatagatatattgccatcattttacagctgaagaaaccgagagctggacagattaaagaattaatgtgaagctaaatctgggatttgaaccaggtatccttcctgtgccatgctctttgcctctacagcattgcctcttgtgggtctggctgaaattacacacagtataaacttgatatttgaagatgcttaggtgtgtgtacacttttacccagtagtgtggcttttgagaaactctacttgtgggattatgagtactttttaaattttctagtttatatttattattccaaatttattcaagaaatatgtcacattttaaaatgtgcatctaaaaatattcattgggttttggggagggtgtttataaatctttgaagacattgcaaagggtactatctgtgcttccctcgacttccccttggaactgctgtgagaaacaagctattaggccgggtagatcgctggtctgactcagcatggcatatctgaagatgaactattcactaagtcatattgaatgtgccttccagtcttatagccgttcctgaaactcgatagctaatagaatgccatattcaaaaggcattgagcactgttttccccagtgctttgagtttggaaatcatgatataagttattactacaattattttccaccttcatctgccaaagaaagtgaaatcaattcatccacatcttgactgcaacgctgttgtaaaagatcctctacctactctgaacatggatctttaaaattgaacctactgatgcaacataaattttagaaaagtcatcttcaactgccaggctggccgcagtactatttaaaacatgatttggggacctctatttcaatttccattactcacaggtcacaagtcttcacctttgtttaggcaagtcctagactaatgctctcaccgaacagaatagttctgctgtcatccacaggttacttgacctctctctactatagtttgttttcgtgtaaattgggaactgttccatctgcaattcactcagtaggcattttgtgatgctgtttgtcatggtggtcctatgaggaacccatgagtgtttcatggtcctgaactttattgaagttacagaatgggccctccttctgatttcaactcttactcaccacaggcattgcagaggccctgagccatgccaagtctcatcttccttcctttatttatttatttatttatttatttatttatttatttattttaagcagggataattgtagatgttcctcatagagttgttgtgaataggaaatgaaatagtatgtgtgaaaacttgccacagtgacagtcacagagtgagatcctcatgggcagtagatgcaactgagcagagatataaatgccaatcattttgaatgtgataatcttgtatttattttgtaattaataatcttgtagtaattattgtttgttttttgttgattcatataatttgatttgcgtatatagtcattgttgaaaaattggcaaagagaaaacggaggcagagatatctccacagatagattctatcactgctacctacaaccattttaaattactgttaaaattttggtgttttttgctttcatttttattaacacaatcaatattttcactgatataattatatatacttatacaagttttatgataccttcttcattctataatgaaagataaacacttaatattgctattacaaatactggcaactattaattaatattttcagtctgtatgtaattatttttatctatttagaaactatagatagtaaattaagaaaaaatcagtatttgtaattctgtacaccagagagagccacattttaagatattttcttctgtttttttttttatatgcgtagacctatgatttaatctaagttgccagtgattgtcagacctacaattatttcctaaggagaaaaaaatgctgccaaataaacactgacacactgctttgtacctcttagaacttctgttttgtatgccttgaaatggccttcaaattatataggcagaggtatttattgtagtatcagtctcggtcatacattaaaaatagatgcaaaattaattgggtaacatattcctcggacaaaaccacattcacagtctgtctctcttgactcctgtttggcttattcacatctgtgtccaacatggtgtggtcttctgtgctgctgtttctcccaagtaaacaatcttttttcaatgttgaatcacagcataatattttaaagccattttaaatagcaattaaacttaaaattgactcataaaataatgaagctgtgcccagctttgcccaagtctacacagttttcatgtggccaagcacaatcatatgaggaccaacagtgacctattgacaggagggtgcaccccagttttaggcatgctacagtgcaaaaaatatacacagctagaacaacttgaaaaattacatattttttcctttagggtgctttatttagttttatctctcttttttttattcccattcaatattgagaacatttcccagtatctttaagacccttagaaaaaatctctttcaaagagatttcaaatgctcttcaattaatgtagcaccaaaagccttcagcttttgaggcttttagaaaattacgattattgaaaacaaaccttacaaacaggaatatattgaagattattcctacaaaagcaaaggaggaacggagcaaattaaatgatggacactcagatatgtacaaaatttaattttaaaaacccataattacatgttggaatctcttgacttctgggaagaatattttgatagagctcctatttttaaatagataaattcatatcttatatcagaaagaaataaaattgagaaagtctatgatttcacataaacctcaatctgatcatagattgaagagaagcatagaggcttatttgacaagttttattgtataatatttttattaaagaaagatattataaaaggaggagaaaacacttcgcatataaaatatttgactgaaatatgttaaaaaccttatgcaaaaatattagaattaagaatatcctccacttatcaatgtttttctgaattttgcagagatctcagcatctaaagacagaataaataatatcgtggtctacaaagaagccgcaggtagttatgtcaacaatttccaacatataaattttaaactataattctgaagaaaactgtaagcagttttctataaaaattaccatattgaaagatatgtttttcagaaaaatgcaataatgaggtagtagagacagagctaaagtataaagtatatgaataagcaaaaagaataattgttattttagtttttaaaaataattttattggtgaaaattgttttatttcttaagtttaaaaatcccaccaatataataaagtcagtttgtgattcagcaaataaatatttttaaaaatttttaaatttttttatacttgaaaatcatctctcatatggtgtttaatatgatatttaaccctttccttactgtagatcatttaggatagttctacttcctctactgtactcaacagaaatgggtatctctccctttgcaattctgatcattttgttaggatagattccaagtactggaatttctaaatcttacaaaaatttcaaaactgaattgcattgaatagtattctctgaatatcaagaaataaaaatattaaaattccaatgcataatttaattctatgcataatccaatgtagttaataacaatccaatgcataattgaaacaaaaatattttgaaataggttttaaataactaaaagaatatcaatagcactttgtagtaacataatgttcagcaaattatatgaatagaacttgtgaaaattatttttaaatagttataattttcaatcaattatatttttaaatcaaaggcatttactaggtattggccgtgttctatgcattatgcatacttctctctgaaaggaaaagaaagaaaagatcttgttcttaagagattcttctggtagtgactgaaatgcatacaccgagataatcaccataatcctctacaattgtcctagtaaaacacccgaggacagcaaacacagagactgaccaatctcacctgcaggaaagtaggactgggaccaagcatgcttggggtagatttcaaaggaagcagtgagagtggagctgagtctggggggctgagaagtttgatagcagagatgagaaagaatgtagatatatagggacaacatggatgtagtcctcaaatagggaaaagcatggtgtatttgaggaacagagaccactgtgaagttgatcccaggatgcatggggctgggagaaagggtagggtggaaggaggctgggtgtcttgtattaaattgggatgtgtcttatttgtcccgacatggaagctctgattgcattaaattgcacttttctctggaggctggtaattatgctactatcccacatagcatatttattcaagaaatatttagtgataccttgttttctgcgtactagacactcttctgatcccaggaaaagagtcttgggcacaacagataaatgcaatagcaatacatgaaaaaaaataaggtaatattttaagtaatgagaagtattataaaataagtaaaacaggaattttttttttttaatcctcaggctggagttcaatgtaaacatattctgaattaacacagcaggggtctctcttaaaagatgatatgtggtctatagagtccagccatctttagtaccagaggagaagaaatctaggcagtggaaaccacaaaatgacaagtgcaaaagccctggggcaggatcaagcttggcagtttgaagaactggaggaaggccagtacctgaagttccagaacagaataaggatgagatgggtacaagaagggaatgtagaggtatttggaggcttataggtctttgtgaggagctcgaatttgatgctaaatgctatgcgcagctactggaagtttttagactaaagtaacattttccggcaacaaaaaattcgcactttcactttaatgtggaagtgagtacatgccacatatattactcagtataatgcatccatggctttatataatatttaaaaatatagctttgtataaaactagagaggagatggctgggagcgccgaggcgggcggatcacaaggtcaggagtttgaaaacagcctgaccaacttggtgaaaccccatctgtactaaaaatacaaaaactagctgggtgtggtggcgggattacaggcacccagctactccggaggctgaggcatgggaattgcttgaacctgggaggcggaggttgtagtgagcggagatcctgccactgcactccagcctgggagacagagcaagacttcatctcaaaaacaaaacaacaaccaccaccaaacaaacaaacaaacaaacaaacagacaaactagagaagaggagagcttgcacatggttctcaggttgatttctttttttttttttttctttttttgcataactgtgaagatcaatttggatcgctactaactctagttttgatcatttgggctcatgtttggcagaggtgggagagtcgtttatatggaatggattatgtggtgtacagaggcctaccaggtagatacctcagtttcagccttgtatgctcgaatatatagagaagactttctgacttttctttcagtacaatattatttgagaaatgagttaattttccttctgattgtccttatggcagtggttactgaggacagcgaaaatcacctggtgaccattgaataggtctgggagacaaaattgagtgtggatcttcttctgtctgtgtatttatagatgttgtttctgtgtgatacaaatgagttttcattaattgacttaaaaataattagtgcttacaacaaatattttgtcaggaaagtaaaggaacaaaagaacggctactccataggcaaagaagccccaagacctgctgtttgcctattttatgtttatttctaaacaaaaggtggattattcatgagttttccaggaatgaggtggacaattccagaactgagggttcctcccaattttagaccatatagggtaacttcctgacattgccatggcagttaccatcattctgactttgattgattttcactcaacctttttccaagaggtaatcatctgcaagaaataagtgattaaaggaattctttaggaaattaataataacaaaaagttttagataatcctcccctgagcagtatattatgtttgcatattcaatgaagaaagtcctaaaacctattatgtacatttatatagtacctttcccttctattcatattttggcctattcttttttatatgtatatcttactagatccattcatatcatgcaggctgctattcacttgattatagtgatagtgcacttttttttcatgcaatgtgtcaaggtaattaatattagctgctcacaacagaaaatcacccttgaaattccagtggtttaatgccacaaagatttatttctcaggtctgtgattgggtggccattcaccatcttgtagcatgctgcttagaacaagcaccctgcaaagttgcaaaggcaagtgaaacaaaacagaagatgcagagcggctcttaactgcccgcaaatggcccacagcacacacccttacagagtactgggcagatctggtttcatggctaagtgtaatggaggacatgaaatggatggtgaacactgtctttgtcaccaccagcctttctgtcaccaaatatctgctaccctcttatacatgtacactcccatcttttcctgtccctccactcattggtggtcatgatacaccacacttttgtcattcatgcttttgaaagtcattccaaagtgccatccaattaccttgtctacttccaagaccacgtgtgtggtagtgttttcataaagtcggcatgtggcctctcttagtatagagaccttgacttaaaaaagaaataaaattaaaaaaatgaatatcatcccttctcctcaataccccctctccccataaatgtatacacatatatatccaatgtgcaaaaatagaacaggaaaaggatagctgcagtaggcactgctattcattcagagggtgagactggagaagggctctctgccactcaacagtccccagcctgcagccgttctgcaatcctgttcagcaaacgttgcaacatcctcctgccttggaaaatggaagcttgatttgctctctggggcagctcctttgtctatcactatccaggctgttagactcctctctggaaggttattcttttcctattactttctctggcatcagcaaaaatggaaattaggggatatgccttttggggttatactttctcctctcacttcctatccacagaaagttagagccacaaggaatattttaagcaccaaatattaaaaagtccttttggtccaaactcatggtatgtttgataaaatatttgcctcaaaaactaagtgaactactggtcaatatgcctggttctccgtgccggtaaccacacccacagttctttcggaagttttgacttccgtcgcagcaccccctccctgagcctgtctctctcaatttgatttcaaataatctttctgggaaaatgcacaggaatgatacaccctttggatctttacactgaattgctttatctaactgagagattgtactgggtctttgctgctgaaaatctttataaaatcctatcatttcttttggttatctagaagcaccgttttttccaatcaaaaagttcccacatttctgcaatcttccaatgtctcctgctccctcatatatacaatcttttttctcttttttctaaatcttaccacacacagctgatatactcttctgatttgcagcttcttcccttaagacttaagtcctctgtgcatatagtctgccttcaaaggtcatgatttcaataaaggtttcaccatcaccagacgtagtctccatctttccaacttccattatcaggctccttgccacccatcggagaactactaagccaggcaatccacatccaattatttattattattattattattattattattattattattattattattattttgaaatggagtctcactctgttgcccaggctggagtgcagtggcgcaatcttggctcactgcaacctccgcctcccgggttcaagcgattctcctgcctcagcctcctgagtagctgagattacaggtgctcaccaccacgcctggctaatttttgttcttttagtagagatggggttttaccatgttggtcaggctgatctctaactcctgaccttgtgatctgcccatctcagcctcccacatatccaattatttactggcactcccttcttccttttttcttatttgtttcttttttaaaacttttattttaagttcagggatgtaaatgcttgtttgttacataggtaaacttgtgtcatggaggtttgttatacagattatttcatcacccagttattaagcctagcactgttcccagaccgaactgagggtcgggctgcttattttcatggcccaaaaatgagatgaagatgagctgggaaagaagggagtttatgtctgtaactgggtacagggagaaggcttggaaaatatcaccagaccaactcaaaattacgaagttttccagagcttatataccttctaagctatatatctatgtgtaagtgttcattcatcaaaagtcataagtgattaacttcctctaaactataactaaggtctgagtcctgaagaccttcctctggagcctcagtaaatttacttaatctaaatgggtccaagagctggggtgattgaccttatcttgtctcctgctaaatcatgaaggtttggggagttttttcagacccccaataaacttgttgtggaggccttgggagttccttcagaccccccaataaaacttgtttaatcctaagtgggtcctgttaagaattccttcattatcttgtcatacttcaagacccagggatggcctaggcaaaactcttggtgggcttttgttaccttccagcctttttgtaaggacactggctctatcagcttttaatgtttaacttaaccacttagtgctgaaacaattgttctagaggcctgactgctgactgttcagccattaggaagacctggcctgccacagtgtcataggactatctccttagtttagctaaacatgggggatccttgtcacacagccatgaaaaataagtctcgcagacaatttgaaggggaagaaaaatggaatttattggacaaaaaggaaagaaaagggaaacagggacacgtcacaaacccagagagagaatcctgctagtatatgcttcccacatcacagattaaatcccaggttccacgcaggaagaggaggggccaggctcttccccactgcaattggtgcatatttttgtggctcccccacagtgtgcattcctcccagtgcacaggctggttggagtttctcaggggacccctttttacccggctgtctcaacagtactcattagttatttttcctgatcctctccctcctcccaccctccaccctccaaaaggcctcagtgcatttttcccttctatgtatccatgtgttctcattgtttagctccctcttataagtgagaatatgctgtatttggttttctgttcctgcgttagtttgctaaggataatggcctccagctccatccatgtctctgcaaaggacatgatctcattcttttttatggctgcattgtattccatggtgtatatataccacattttctttatcgagtctatcattgatgagcatttaggtcgattccatgtctttgctgttgtgaatagtgctgcaatgaacatgtgcgtgcgtgtgtgtagaagcacttgatttcaagctaccaatttccatactagtctaagtaattaatactaactgttcatggaagacaaacttccaaactctcaatgttgaatgcagcaatgtatttctcacattataattggatgtggatgaggcatccttccttcatctaaagcttagccacctggaatgcctggtgtctgaggtcacaaagaccatggtgaagggaaggactaatggatgtgttaccctagcttttaaccatcttgtcccatagttaatacacaccactcttgcttgcgtctacttgctggaactagtctgatggctccaatctcaattcaagtatggctaggaagtttaggagaacacatgtaatatttggtgaggattaaatctctttctcacactattacaaatcagctttcctttgtaaaactgctttcacatccatgatttaatattaatttcaactgtttcttagaggtgagacagcaaagtcatgactcattccagctctgtggatgagaaaatctatgagtatccacctgtctttgattacactgacttccgtagcatttcctcttatcttaggtttactgcacacagaaatctgttttcttattctccaaacactatcactgaacccaaacatttccgtaatcacaaagacacataatcacaaggaaggcaaataagtctgataaactataacaagtgcagagtcacctcactgagtctataggaaggatctgctggaggaagggtggtttaagctgatgcatttgggatggataggaatgagtcacgtgaagataggagaggagtgtagttctaggcatggagcagagaatagagcaggctgggaggaagaagagcgtaagaatccttggtacgatggaggaaggtcatcaggtctgcaatgcctcctgtagaggggacagcagtggggctggaccacaggcgagtggcagggatagaagcactggcaggccacatggaagaggttagtttatgctgaagatggaagatttaagcaaagtagggccaggaactttttcattcccttgccttcctccattgctctgcaggctgcaaggacttagaacaggtttggcctgagggacaacagcagcttttcagcaggcagtttctccagatgattaaacaaaggtaaccagagggccaaagggcatgactctgctgcagctttcaccttgaaacactgaagggaaatctacttgcccacaggaaatacgaaatccaagcattctagatataatgtatttctgctttggagaaaaatatatcctcaaatacttcagtacaaaataccacagtgaaaagttttaaaacatggtatgcttttaaacaaaatgagctccctgaagaagctgcagtatctaagctcacacttgtttcttcttgaatttgtgatttagcagttttgggattaggcatcacgtgctttacaaagatgttgatctgtaattgctagtactgactcttttgctttcatgatggattatataccatttgcaattgatagtctctgaatctttattttctttgcaaaagtagcatgtcatctccaaaaaccggacagcagtgcttgctaaataaagtgtagtatcgatcaacgtgttaaactatcatgcctttcacaatttgcgaactaacattgcactattcgttttgctcttatccatcacacttaactcttgcctgcatttctgctccccaagcagggacataagaaggcaatcactagtgaaggatttatgcataatgtggtattcttggctatcctcatatagttaaatttcattgatgctgttttggaaaatgactttataatgaggtgaaattatgctgctcagcttggcttactacctatagtgctatgtgacactcatgtacattatactccacaaaagaaagcaggacacactcatatcccattcactgtgtacttcctaaaacctcattcccaaaagcttctattcaaaccatgtttcatcctctcccagatcttggcactgtatcaggcctatgatgatactcctgatgcaacagcaactgttgccattttgcctctgatctcttgggtgactaatttctggatccaccttaaaaactccacttcagattattgttggaggacactcaccacaggtgactccttacgggaaaatgtcactgaagtactgttatggactatattttattatccccaaattcatagattgaattcctaacttccaaagtgactatatttagagataggacctttaaggacataattaagattaaatgaggtcataaagtgaagctctaatccaataggactgatgtctttgtaagaagaggaaaagaccctaagatggcatacacagaggaaaggccttgtgagaatgcagtgagaaggcaactgtctgtaagccatgtagtgaggctgcaacagaaactaaaacagctagaactttgatctgagatttccagtctccagaactgagaaaacaaacttctattgtttaagccacatggtctatatttggttatagaaattctagacaactgttacacagactatatactgttaagaataaacaaataaataaataaataagtaaaagcatgctatccctatccctttgctctgtttcacatttatgtgccggtcttagcttagtttattctgctataacagaataacacagactgggtaattttaaataaacagaaatgcatttggcttatgggtctagaggctgggaaatccaagagcatgtctctggcatcttatgagagtctttgtgatgcatcatcccatggcagaatgtgaagggacacggagggtgagggcaagagagtgagagaggaaaagtactaaacctaccattttaccaggaacccactcctggagtaactaactcactccgcaaaatagcagcattgatcccttcatgagggcacagcccttgatgaccttaatcacctcttatcagtccccacctcccaacactcttgcactggggattaggtttccaacatgtgaactttgggagataccagcaagccacagtggtacccatttttgtcatctgtagatttggctctttaccctgaccaaagacttctgggcttgagtaagctgagtgtgttgcaaagagtacttagtttagaaagtagctagtccaatgtgaaactccttttttgcctttggtgaaatgaatcttgtcaccagattctggcctggatcttgcatgtttactgctcagagcttcttcctaggaattaaatcctttgttgctctttgttttttgtattctgactacgtagatttgctctttgcctacataaagggacaaacccaccttcctgttgttcctttcttagctgatctagctttttgtatttgactgcagtccccccttaaattgtgttttccaccagcttccactgtgttgtggaaacaccctcactccttctcatgaacatttgggaggtctatttttttcattttttctaagccctgctgaatcattaccagcatatggggaggagggaggcagaaaccaagtatcactcccctgaagctactcaaacaggacagtgtctgtttggacacatagccagagtgttatggaagaaattcttgtaaactatgtattcagtcatgatacacatttctaaatggtgagtttcaaaaatagatgattccaccttgcaaacttgtgcaaatgtatataacagacagagaagcagcagcctgtccatgtcaacagccatagaaaatgtctgacacttcctctgaggctagaaacagctgttgatggagctcacagcaaccaagacaggtgttcaagttagaatcaaacagttgtcaaaatttctacttctctctgtttctttaaaacatcgacacattgaagtgtaatgtagttttcagctattaatggaattaaatatatagattatctaaaagagtaaaaaaggtttaaaagagcaacttatttgggatcagttatttccacatgatgaggcatgacctaactcaccttctgaatcataatcatcataataataacaataataacagactgggcaccatggctcacatctgtaatctctgcattttgggaggccacagaggggcatcgcttgaggccaggagttcaagaccagcctaagcaacatagaaagaccctgtcattacaaaacattaaagaattagcccagcatgattttgcatgccagtagttccagatactcagaaggctgagagggaggatcacttgagcccaggagtccaaggttacagcaagctatgtttgggacattgcatttcagcctgggcaacagagtgagaccctgtctcaaaaagataaaaagtaaatacaaataatcataaattttattaatgccaggaactatgctaggtcctagggagatatgatgctcaagacaaaggctctaactgtatatattgtatactttagcaactttataagttgtatactttggcaacaaggataattgaataaataactaggcaaatcattagaaacataagtaattataatttctatgctaaggagaagtactttgcaaagggagaatttataaattgagcccttgacctagggctggggaccaagaaacacttctgtgaagcactaacatttgtgctaagatatgaaatatgagaggggataaccacagggagaaatggcaaagtagactctgcaagaaaacagatgatataaaaacactgaaccaagaattgttcattagaattgcagaaggttataggagccagataggaaggggccagatccttcaggtttctgatggcaatgataagtaattagttacttagagttctgaaagcactagacagctgtaaagaattcttaagtagggaataatatgaacagaacctcctttaaaaaaataacattctggctacaatgttgagagtcaattggaaagagacaagaacagtgatgagaaaacgaaggaggaaactagtagccatcaacaaggaacagtggcatctctcagttcatgccatatacaaatggccagaggcttcctaatttgcttcctaattttcaaaagtattctcaggacctaggtgtttctttgaagatgacctcattcattcattcaacctccattgtttgtgcactgaccctatgcgaggcacttgggttcgcggagggaatgcacagccctggcccccaaggagtcctctagggacaggtaattgagttatggtagattgggggttatcccaggagtaaacaaaagaggaatagtcacactgcaggccacatgtggtggcacacacctgtaatctcagcactctgagaggccaaggcaggtgagttgcttgagctcaggagtttaagaccagcctgggcaatatggtgaaactccatctgtacaaaaaatacaaaaaaaaaaaaaaaaaaaaagtggggtgtggtggcacacacttctagttccagctactcaggaggctgaggtgggaggattgcttgtgcccaaagtttgagactgtagtaagctgagattgcaccactgcactctaaccttgatgacagtctaaaaaaaaaaaacagacaaacaaaaaaggtgacactgcaaatggcacctaaccagaagctggggagttaggaagtgtttcacagaggtaatgctggtaatgcacataagcgaaggaagaatgaaaattatccaagtgtttctcatgagtattggctgttacctataagttattagtttgacatttaggaaagttgaaagcaagaccctaaaaactattttgcttagttatgtcattttttttaggagaaaaatagttaccatgtctgctatggcttgattgtgtccttaaagttcaagtgttggaaacttaatcccagtgcaacagtgttgaaaagagaattcctagtaagaggtgattaggtcattaggactttgtccattactgttatttcaagtgtgaccttgttataaaagtgagtttggccacttcttgcccttttgctctttcattctctcttgcctttctgctttacattatgggatgacacagcatgaaggctctcaccatgtgccaacatctttatattgaacttctcagcctccagaattgtgagatataaatttcttttaaaaaataaattacctaatatttttattcttttatagcaatacacaatggaagaagacaatgttgttttgcctgtgtcccttatggcacattttattatttgcctatatatgtctctgctcagttctcaaatattgtttttaatcaggtctcatctttcctactcaaactaatttccagttctttgcactcttcctgcttctggtgtataattccgtctccttagcatcttttattagtcagagatcgtgagattgcatttgacagaaccacaactgaaatggcttagtaaaaacaggaacatggttagtttatctagcttgtaattgaagactacaccagttcaaggcacctctggatacaggaatcaaataagatcccagctatgttgttcctctcttcctccccaaagtgctcccagtcgctcccaccctctcagtctcagccaccctttctgcctctcacttctgcttcactcccaggcagatctttccacctggaagtgagttagacacaagcagtcttaggatgacagcctaacagtgtgtcccaaacagaagaaagcagtctttcccccccaaataagtctatggaaattcagaactgagctccaaatggtcagagagttaatgactctggccaggaatatgacctatgttggttgcccagacatcagcccacacacacactcctgacaaagaagaagtgtggcacctgcttcacacagatggcatgagctaacagtgtgcactgcacaggttctctagagagtgttgaggtgctatcaccagaacgagaatgctatggaacaatctctaccccagaacacacctgcatggtcatcatggtcatgtatttgcaaacttggtttctctctctctctttctttttttttttttttttttttttttgaggtgaagttttgcttttgtcacccaggctggagttcagtggcataatcttggctcactgcaacctccgcctcccaggttccaatgattctcctgcctcagcctcctgagtagctgggattacaggtgcctgccaccacgcctggctaatttttgtatttttagtagagacggggtttcaccatgttggccaggatggtctcaaactcctgacctcaggtgatcctcttgcctcagccttccaaagtgctgggattataggaatgagccactgcagccagcctggtttcccatctaattctctttctcccgtggaggcagggatgaagaagattatcttagtccaggatgctattagcctggatggcttgaataacaaacatttgcctttcatgactctggagcctggaagtccaaaatcagggtgccagaatgattgggtttttgcttactgccttcttactagctatattgtcacatggcccttccttggtgagacagagagaaagagagagagagagatcttgtgtctcttcctctttcataaggacacaatcctatcatggtgctccattctcatgacctaatctgatcctaattagctcccaaggtcccatctccaagtaccattacactggggattagagcttcaacatacgatttggggaaggacgctaacctactgtctacaacaaagctctactcactgaaatcacctacatttgcttctcctagaactcatcttgctgggcattgcttccaccttcaatttttgttaccaaactggagcactgtatccaggacctgaaatctgtgaactcaagggtttttggctttagcctcagccattatttttctattggttgtattctgatataatgtgaccccagattcagaaagtaggaagacaagttcttgctttgggggctgaaatgcaaactgaaggtgaaggaaggacaatgaatgctcagttggcatttcttaggtttcaagcaaagaagaagagatacaggtggggaagcaagtgatgatgtagcaaccagattatgtagttgttgatactcactgctttatttcccccactggccctccatagctttaccagagtcttccctaaacctggctggcagctgattagaaatgccaaatttctaatgccactccaggcctgctggatcagaacctacaatatatgacaaagctggcgggtcattcacaacaactttacagttagagaaacaccgctctgaaagtctgagtgccaggtactctgtggttcagggtgtggggagagatttgagatcctacacttggctataatgttaatgggacataattatttactaagctcctcccacaagcaaagtgaatttcaaggaagaaatgttgggcttacatgaacgtctcttctctttatggaaagttacttttcattgctaatattggaagactttttttttgtaagaaagttatattttctttcctgtagaccaaggttagttgtgacctcacatacctaaactgccagtcttggtcattaattcacaccccaactctgcttacaaaccgtttatccatcccctgccctggtttctaacatgattctttattacctgctcagctagcagactaaatttattcaattttcttttcctttggcacaatcagccaatcccaatgttgcaaactaaaatcaaaccagatgtgctaagaattttattgactattttatgtaacaagctgaatgaccagaaggctcaaaccaaattaattgaaaattaaagcagagaagatttaagccagacactatttaaacaggcttaaaaggttagcaaaggaaaagcacataatcagtttgtttgagtgataaaataagaagttaagctgaattggggagagaaaacttgcctcttgaactgtagatttatcttctaaatgaagtatcaggtgttttaatgtttttgcaattaaaaatgaacaaatatataaataaatataaaagcactaactgggccaacttcttgcatgttacactgaaaaattatctggtagatttgtaaaattgaaaacagaagctttgggaagtagtaaaagaatctgtgtctgtgaaccagagtgcactggcttcaaattcccacagaccctgtgcgtgttacaactcaccagtcaagctgcacaaccctgagttatgctccttacctgtgaatggaaatagtccagtgccccaacttatccaaggggaatatgtgccaagacccccatggatgcatgaaaactcagatgagaccaaaccctatatatgtttttttcctagacatacacacctataataatgtttaacttctaaattaagcacatcaaaatattaacaataataactaataataaaataggacggttatgacaatatactgtaataaaagttatgcaatgtgttctctctctcttaaaacgtcttgctgtactgtactaacctatctttggactgcagatactgggggcaaactaaaacctaggaaaggaaaactggatgggagggatgactgtgacagcaactctaaaggaccattgtacagattaaatgtgagtattgatttacagagcctgacatatactacagatattcagtaaaggagaataagtaatattgagggtaaaattgatagaggaggcatgtcaggagtgagattgtttgatgccagtgaacatttatttgacaaatccacttaaactgaaaaaataaagtcacctctctattttcatatttgatcttcaaagccagcagttacagtaggataggtagataatttcccaacttaataaatatggagggaatacaaacagcaatggggtccaatgatgatgtaaggtccccagccattctgaggcagagctagggctgaatcccagcttcccaatgacaaaagtctggggcctttagccagagcggtgcctcccctgaggatatgctactacgcatgtgatgtcccttgcagctgtgtcccaaggcccctgctgatgaccatgtttcccatcaagatagttgagacatgaaagagaagggctctgcatagaatcaacaaaatatcgtctccacaaggcaggcgatcttttctattccacggatttatctgaaatacatatttatcctaagggcataacaggaacagtgtcttgcctgtactaggcatcgggaatatttgttgggttaatcagcaagcatgtgcttccgtatagcaatggaaggtggctagcttacacagtctgtctgctctgggcaattttcatcttcacgaggcctgaatctcttaccttttttttttttttatgagcattaagttcagggagatggagtggttctcaaatgttagtttatgcataagaatctcccagggtgtttattgtaactgcagatttctattcctagcatcagaaactaagtcagctgattgaggtggttcctggaaccctgtgttgacattaatgctggcatattggggcaatgcattgcggtccctgatgtagattgtaggtggaagtgtgggctgtgtgtctgtgtttttgtgagtggaaaaggagggaggaggaaggtgttaagtgagaaagaaaagatttgaatgagtggaacttcctacttagtgggttggtaaactctttcccctctattaataataacttttatctccacctcccttctgaaggaaaggtcgggattggctagaatcgtaacttcccattacagtttaatttccttccttcctctaatgccccctttcccgtgcccaagccctcccttaacaaaccctcggagagagcaagaaaagaaaacaggcctcctcaatttccctaatgattcttttgaaaagcctttttttttttaaatttgtatttttagatctcttcaaacaatgttcctattagaaggttgtcaaaggccccgtgggatttatggaaattttcattaagaaaaatagggaataatttcaaggacagtgtctaatgtcataaaaatggctatttttaaagttatggataagtagaagaagcttccttacctcatgaaccgcacttgcagtgggagcttgaggctggcaggtggcagagggagacccacataggtttaagcccagcgctcagcagccccagggccttgtgcaagtgcctaaccatgctgagtttaatgccagtcctcgacactttcatgactgtttttctttaaatttagatgaaaatgagacagtctctgtaaataaaactcagtatatattcctggtagtgagagaagcactccagtactattgggttccttactctgatactgcaagacaacttcaagtcttctcacgtcttcctaagaatcccttcagatgagcttctttgcttcatttttttcttagattgtatcttttttctagactatttctaataacctatcatttttttccctgcctgtattaatccactaggattgccataacagaataccatagactgggtggcttaaacaatagaaatttatattcttacaattctggaagctggaatgtccaagatcaaggtgatggctggtttggtttcgagtgaggcctctctttctagcttgcagacggccgccttctcatggagtcctcacatagcctttcctcagtgcatgtccttggatggaggaaggaaagaaaagaatagggggaaagagagggagagaggagtgtggggagaaagcgagaaagaaggaaagaaagattttttgtctttttacaaggacaccaatcctactaggtctccacccttaattacttcctaaaagtcctttctccaaatatgttcacattgggggctaaggtttccattcaatttgaagctcaaatttcctatgaattttgggtacacatgattcagtccatagcactgcctaactgcagtccttaggttctctaattttctaatgctcccataggaggaagtaaatcatttgtacaagtcacctgacggtcacgtgtattcactcagtgaaactttgctaatagctgtctatatgatgaactctatactaggctctggtttgcccaaattagtaaaacatgatctctgcccttctggaatctaactgggagaggcagacacttaaaaaaattagagcaatagcatattacagatatgatcatacaaactggctcatggtactgcagggtacaaaggaagggatcatcacttatgactggaaatgaagattccagggaatcgtgaaataatggtagaatgtgatgtggaaaggaaacagaaggcaagaaacagcctggaacagcaaaggtaataaacaaactccagacaactcaaaggctctagaagctgaatggaagtaggtgacccagtgtgagccataaaaccagcatttcatatgggggctccttagtggaagaactgatagcttgctgaagagcaaattctttgtccttcaaggcattaagtgtattttaacaataaagtaaagtgtttgaaataaatattaggttagagatatatgggattgagtcaaaagtgagttttgcaagtgagtaagtctttagcagaattcttagtgatgagttatttctttttttatttttattttttatttttctgagatggagtttcactcttgttgcccaggctggagtgcaatggcgtgatctcggctcactgcaacctccgcaccactccccacccgccccccggcttcaagtgattctcctgcctcagcctctagagtagctgggattacaggtgcatgccaccacacccaactaatttttgtgggggtttttttgtttgtttatttgtttgtttgtttgtttgtttgtttttgagacggagtctcgctctttcgcccaggccggactgcagtggcactacctcggctcactgcaagctccgcctcctgggttcgcaccattctcctgcctcagcctcccgagtagctgggactacaggcgctcgccacagcacccggctaattttttgtatttttagtagagacggggtttcaccatgttagccaggatggtctccatctcctgacctcgtgatccacccacctcggcctcccaaagtgctgggattacaggcgtgagccaccaggctcggccaatttttgtattcttagtagagacggggttttgccatattggccaggctggtctcgaactcctgacctcaggtaatctgcccgccttggcttcccaaaatgttgggattacaggcgtgagccaccacgcctggccagtgatcagttctttcatcggggctattgaatgaataggattcagctctgggctctgaatagactggaaattactgtgtgtgcattttaacaatgtatcgagaacatttatcatgtttctcacttaaccctgtgccatcatcgatatgtaacagtcactcaggcttgcacattcaattcgtaccaaaaatagtctatgaggtaactactctcgattattatacgattaatcaccagtcaggagtggttagatttgttttgttttgtttcgttttgttttgttttttctgttacatttaggcatccaatcattaaatgtatttgtaacagaaaaggcaaaacttctagaatctctgttactgcaataggaacttgttcaaggcatagtccctaaattttaggatcatttgacactgaactgttacatcagacccacccaagaaaggtgtgaacagtagccaacagaaaatcaagctgcaggcactatttttgttcacagaattgcctagaaactcaaaattcagcttctgctctcacatacctctttctttttctgtcttaacatacatttctatttgtctcttgacctaaaaacaagaaaggaaaaaaaatctagctgtggctgtgtcctcacaccccttccacccgtggtaactgtctagaatttagattgtgccattgtctggatcatgccatcatgtctttgtggctaattgaggatacagcatacaccctaggcaggccagcccatggagagtaatgtggaatccaataaaaccacagggcaggcagggggagtgatggtgcgagggataccagaaacctttaatccagatcattcctgttttccattcaattggtggtggtttgcctaggaccccaaaactgtacttgcagatgaacttactacttttcttcctaatggcatcttcagacttagaactaaatctcagacttcagttgcttcccttaataactgaaaatatactgcattatattccttgtccttcaaagtagcttttgatgtgttggcccaacgggtcttttcagaaataccgtgcgtggatgatttgtagtaaaactgagatgctgtatattttccaagtaccagattcacaaggaataatgcgataatgatgccttgttttctcaagctttcagacgtgccggcctagagctggcaacatgcaatctcgtactacttcatctgaattactgaaatgggagacttctgtctgcattctattactgatttccgtgtttcacaacctgcagtttcctagtcttcaggggtaaaggaaacatagctcaaattcaaaagtgccttgccaaagccagtaagaaaagctatttctccttgatttgcagcgactcatttgaatctccgtagtgggccctgagagacccatattttgtctttgggagcaggcgcaacacagagttgattcatgattttagctgaggggacacattgaggcaccaattgactaaattattttcatgtggataatggatttagggccttcacttgattatgtctgacttctcccagtctaagctcaggattcccatcttgattattttaaattaataatatttatgagtttgtttgttttcgtttagaaatataatgcatgcttattttatacaatacaaaatatatgaaaaagaaaataaaaatctctaataatctcatcatttttacccaggcatttcaaaagccacctatgtatgtatttatccaactatcagttcatctattcatccatccatccactcctgcatatcctactttacgaatgtatttgacagcttattttatattatgagcatgttcttatctaataaaatatcattaattacatggtcttagtgtcggttgcaatttttgtttcaaaatttcttttaatattaagggaaatttaactgaatgtgtatatagtatatgcataagtatataatgcatacatcaaacaaacaagccttttttttttttgatggggtgttgctctgttgctcaggctagagtgcagtggtataatcacagctcactgcacccttgaagtcctgggctcaagcctccctagtagctgagactccaggcacatgccaccatgcctggctaatctttttaactgttgtagagacagtctttctatgttactcagactggttctgaactcctagcctcaagtggtcctcctgtcaaggccttccaaagtgctgaggttacagggcatgagccaccacgctgagcccctaatacgcctttctgtctggtcagtcagttttggatactacttagcctatgctatccttcctccatcagaggaaaacttgattatataatatgtaaaatttgaaggctaaaagggagctcagagaccatctggccctgtggttttcaaatctcaagggttccaaggaggtgcctcagggtttgctttgggccaaggtagaagcaagcagaacaaggcttctgctcggctatcactggagctgctccacttctctgttttataaatagtgtcaggtttcataagatgatgtatttttaatgtaatttaatttaatgtttagtataaacgttttgctgcttttaaaaaaatacttgaaagctgttgatcttgttcaacttctttctcaaggtggtcgcccctcctacagcaagcctgacaggtggctctgagaagctactttatctcccccagggattcttggctccgcatgaaagtacaaaccctgagctgcaaggggatcctgcatagcttgaaaaaaatctacccctcatggcagtgattaccactttaggaatttaggtatatagtctcttttgggtctaatgcatatgcagcatgagaaaaaaaatttctaggagtttctgggaaagaaagttcttcattctcatcttgaacagaaaagatggctctccttcctacctgctgatgtaagtcctgatataactactgcaactcccgataccagcctgaggatggaccatatacagaggaagccagagctaagagaactacagagacatagatgcagactccaacagaacctcaactacttaccgcccttgaccccaccttcaactctcaactgagttggttttattgccataattatttgggccagcaggagttggggattctgctgtacatccactaatgaatgtaagatgtgatcttcaccatgcctgcagaccacactttcctggaaagggttagtagccctggagtgggttagtaacctgctgggtgttacaaaagagaactagcctggggtcggaggacctgaatatgattccaagcgaaaccagataaattttcttcctgtgaagttgcctaatatctctttaactcaattagcacatgagtgaattggtgataaatatctataatacataagtcacaggactgttaaaaggttcacactgaagcatgttatgtattatacaaaatgtaaggaggctgtctcatatttgtgatatctgcagtgtgctaagaatggctctcacagccgggcacggtggctcactcctgtaatcccagcactttgggaggccaaggcaggcagatcatgaggtcaggagattgagactatcctggctaacactgtgaaaacccgtctctactaaaaatacaaaaaattagccgggagtggtggcaggtgcctgtagtcccagctactctggacgctgaggcagaagaatggcaggaacccaggaggcagagcttgcagtgagcccagatcatgccactgcactccagcctgggtgacagagcgagactccatctcaaaaaaaaaaaaaaaaaaaaaaaagaaaaagaaaaaaaagaaaagaaaagaaagaatggatctcatagtgaaccttcctgtatgccaaggtctacactaaaaacttgactttcatggtcacacacaaaaaaaactgtatgaggtaggtacagctactcaattttatatctgaaactcagatgttctttagaatcccgaatgatctgggttttagaaaggttatgttgagcatgcagtgggtgctatgcagcaacatctgcttagtctgggcagcacgccattattcacacataaatatttctgctgaagaatatgtggctatttacaccgggtggcttcaactaagaccataaaaacctcacatgacttcagggcagacttacctttagattaagttcaggtcagatttgacaacccaatgaattaataataatactaatagtaatgatgataacagtaataattttcaaacatttttgaaaattggaactataaactgtgctgttttatccaatgttaccaatacaaaaactaaagcatgcaaagtttaagcaaattttcacgtcactcagcttttaagtagaaaagctaagactgaatgcaagctgtctcaggagcctgagacagaccactttgcttgccactttgctcgccagtgctcacaaaggctgcctgcccatctaggccctgtccaacccaacagttaatggagccatctacattatctttctcaaagggcatttagaacatcaaaccatgtattccaaatctcagaatttttttttttctggagggaaaacaaatacactttttctgctttaataattctgtataacatattatttggtctaaagagaagttactaataggcaattattaaagtctaagagccagttgagatatccaagtacagttgcccaattgcagatcactgaggacactgatttaaaatacacatacacatatattcaaattcacaaacagacacacaccatacacacgtaggtgcacccttaaagtaatggaacatgtgtgtgtgtgtgtgatacacattattatattccagaacttttgctagagatgtgaagccagcagtatgctagacacagataagcagagacagcacacactccttttttgtttctttaaaaattgcagtgtgagtgataagatctggggttgaagtgtttgtgaggcttcataggggaaatgtaaaggaagtaagtgcttcccaaaagatgcaaaagtgcagcaagactgggacgatgagctgagactgcactggaggcagtggaggagaggaaaggagttgcagtcagcggccacagcacacaccagtgggtcctggttcagtattgcttggccccaaaactacaggcagagcatttgacagggatgagatcacagggcgaagcaaacaggggcaagtcacgcaggcctcttttgctatgtagaagagctgaattttttaaaaacattaacatctaaaccttaagtagtgttaagctagaaactgctgttaaaatataccttcaattcaaacagaatatatattttaaccactcatttttataaggcctagtgttaaattatggcttgaataatcagtaattcttcaaagtatggatgaatctgtctcacatttcaggtacagtgcagagacttgtgatcaggaaataatgagataattatattactttttgctccacagtcaggctttatcatttttaaggaatgtctaaaattctattaagtgtaattgttgaagctattaataaaccaagggaagagtttgaaaaacagcacttagagtttccctttagtttcagatcatgtctgagaatagaaaaagaatctgtataaaatcctggggcagaatattttgcaatattttagctcaatccaatgttaatcctggctacacagcctctctgttccctaagccagaaaccccaaaatctccttccccctcctctcctacctcccacttccaatcagtcttccatctctatctcctaaatatgcctccctctatttctctccagtccccctgcccacaccatcattacagcacctactgggtccttgtgttgtcatcaaagctcaactctccaggcagtcttcctacatcctctcctctagttgggtagaactggtaactcccctcttttgcgaaatacccaaacctcctgggatagtttttagccttttccactgggtatctgtctcccttcctgctctagctctggcctaccctacctgttgagaggaaggatggtgctacactccgttttcctctctgcacttggcatgctgccaacacattcacttgttgagtgaatgacaagatacctataaaggttctcttgcccagttatttcattccttcatttctgtaagtggcttttcctattaattaacatgctcattaatacataagtccaaagcagatggcagttcttcacttttgggattttcagcacattgatatgataagtggcaaaaaaaaaatgtatgtaaacaactcattctccatgatattaatgaagggtctctcattccctgttaaaggtatcaaagactattttgtatcaggattctgccttctggtcacatgaagaaaagctaaacctcaaactggcacagttgaaaataagtacctgattttgtatttcagtgtagactggggtatatttgactcttttccagactaatgttattgattttgatcatgtgtttggtgtgtgtttgtgttgtcatagactccttttagaaattatgcagtcatttttattttccacattactcatctccattctcgaggtcagggtttctcagcctcagcatggttgacattttgagccagataattcttcgtgggggcaagctggtatattgcaggacatttcacagcatcactagcctctacccactagatgccagtagcacctttcccctatactgtgacaatcaaaaatattcagaaaggaagggggttgggaaggtggcaaaattgcctcaagtgaaaaccactgctctaggtggccagtgcaacgtgatggctatgtttttataactccttccacagctttataactatatattaaaaggcatgcatagaattttttgttattctttgtttataaattaagattgtatcccttctctacttcctccaagtcaatagatatgataccaactgattctgttttaatgtccacaaaatcttccacggtacaggtatgttacagtctttttagccaacgctccctgtgtgaacacccactctgattccatttacgtcgtaacatacaattccacaacaagcacctttacagttatatccatttatgctgcctcatttatttctatagcctaccttccctgcagtgagatttctacactgttaagcatgtggatatttaatggaaacagatgttgatagattgctttcctcaaaggctgtcacaatagaaattttctccagcaatgtatgagagcacctgcccaccagcactcattgtcaaggttctactttttaatagatctggagtgatatcccattgtcactgtaatttgcatttccctgactaatagtaatattgaagaacttgttgaataaagtgtctaactgaaatagtgtgacctcagacatctgcaaggccccaagtcccgcatttactgcccacttctgatttctggagcagctgccacagccactgacatgcaagctcagactcacctgacctcacatgctctaaaattacgctgtatgttgtaaacctttaaccccttcatcaaacaagctttctgtgcaccaaaagaaggaaaaaagcataaagattcaagaaccttatttggcagcattcaaggaaaaaaaaaatactttcctcataattaaattgtctgtatttaattatttaaagtattttcacattttatgtgaagtatttctcacattttatgtgtgtgggtatttgtgtgttgagcctgtgtgtgtgtgtgtgacccctccaaacagaaaatgtgagacatgttcactggtggaccgtgcatttctgatgccaaattaagtattctctgtttttaggaatgcgtcacaatgggaaaagagatcaattgtaaaatgaatagctgctgggttgagtttaagggaagatggaatgctctgtgagggagaatggagtcgctatgttccagggctatgataagcagtcattctggagatcttgtaaagtctttcaagcagcaactgcagcatagctccacagaggatgagctgaaggaaacaagcttaccccattgtaaggatgcagaggaaattcagtgctggagctaaaaataaagaaaaggattagaatggctgggcgcggtggcctgtaatcccagcactttgagaggccgaggcaggcggatcgcctgaggttgggagttcaagaccagcctgaccaaggtggagaaagcccccgtctctactaaaaatacaaaattagtcgggtgtggtggcacatatctgtaatcccacctactagggaggctgaggtaggagaatcacttgaacctgggaggcagaggttgcagtgagccaagattgtgccattgcattccagcctgggcaacaagagcgaaactctatctcaaaaaaaaaaaaagaaaaagaaaaagaaaaaaagaaaaggattagaatttcttttgccttgtgttttcatcatctaaaaaaggggaaaagtataaattccactatgaatttttttgaaaaataaatttcagcataaaggagtacctgctcattagagtaaattcaaaacaaaagcaaaaacaaaaatgttttaatagacatcttgcagtggtggtctagaaaatgtatttttcaaggaagtgtggttagaaattaatagaatgtctccaaggttgtagtattgggttgatagtcccaatttccattctgagtttttatgtactctggatcttttaaaatataaaaaaattaggaagttaaggcaggttctgttaagaggattctaattttaaggctctaaatttaaatttaaaatgcttatatcggccaggtgaggtggctcacgcctgtaatcccaacactttgggaagccaaggtgggtggatcacctgaggtcaggagttcgagaccagcctgaccaacatggtgaaaccctgtctctactaaaaaggcaaaaattagcagagcatattggcacccgcctataatcccagctacttgggagactgaggcaggagaatcgcttgaacttgggaggcggaggttgcagtgagccaagattgcaccactgcactccagcctgggtgacagagtgagactccatctccaaaataataataataaaataaaataaaataaaataaaataaaataaaataaaatgcttatattgcttttataaaccattttcttatagacttagttttcaaaacaaatctgtaaagaaaatatattattctcattcgacagatgacaaacaaaatttgtcagggcttggcacctgcagcacaggttagagattgcattcattcccagctctgccagaaaccaggcaagtcatttaccaccaagtgttagtttgttacatgtttgagagggcttatcatctgtagatactcaagttaacctaagaaattttactacagtcaaataccaggtaggacaggcatgtaatataaagggggtaagaggataaatgagtaaaagggtaaaaatggtatttgagaatctatattgcagcaaaatgaataatgaaaatcatgataataaatcagggtcatcggtatgtgtgcaaagtaattatttagtagagctgttctgtccttgttcgtatagtctcagctgaaaattgactaacagatatggcatattattagctgctttgcaatgactccttgggcagttagagttttctgaggaatacttgtccatggagcaggtcctcaggtgatgaaaccatcacttccttctggatcccacaacctcaccaggcagaactactgtctacttgcagtcctcatgctgcctctctaaaattcaaagaattcaaaattatcttttcaataaacattagctgagcatctaacatgtaactagcaatgtgctctgttctgtaatatagaaatattaagaaggattagactatgcttcttcagtgcatagtcttctaaagtagttggcttataaacaaaaaacatttatttctcacagttttggaggctggaaactccgagattaaggcaccagcaggtttgataacagatatggcatattataatcttataagtaatttggtaagtttatgatgttatagaagttaatgtgcaaggcatacaggagacccatgtgtgcccaagcgggtcaggaacactttcccagaggaggaatttgatcaggtgacagaagttctcatgcaactcagaaacttacaaaacagagatctcagatccttatctcatagcatctccagttgcctgacttgatcctaaggctgtaataggggagcaccaaaacagaatcccatagactcaagtcaagacctactcttataaacaaatggaaataaagcttagtacaagtgagagaatcttgtgtgccctatgagtcatacccttcagcaatgtgtctcttgcatcactgaagctgtgcaagggaatcaagtgcagcaaataagtcaggggcagaggttccatctacaggagaggacgacacctgtggacccgactctgggaggcagaagcacctagcctgaggtggagattcaagcctcatctatgtatagccctgacacagcttccacagcaccctcatatcacatgcaaaggacaggtgtgtcttccatttagcctgctaaatcaggcctgccaacccctgcctcctgaggaggctttcagaattaactagaccatgttggcagctaactagacagctaaggaaagaaagcattacctcatctttgcactggctcatttgatattccaccttcaattactccaactgaaagttgaaataaaaataaaaagttatggcctttgtgtgtgtgtatgtgggtgtgtgtggatgtgtttttgtgtgtgaaaggagaaatagagaaagagagcaatagagatttgaggttttagagacagagagaaaagaaggagaaagtatttgtgttaggttctgggagtgcaatttgggaaaagtagagagcattacgaaaaaaagagccaaaaatacattcattaatattcattaatttgcttgtctttttaaagacttgactatctattatgggttaagtactatgatggacagtgaggatgtagcgtgaaccagacagaaatagcccaattccatcacacctttagttcctagggaaccactgaattggtaaaaagttcatgtattcttggaattctggtggcagttctatttcaccctgaagacctgaaccaactttctaggcagcctgggagtccaggacacagacacagaaggagttcccagagccagagtgaatatgaggttgtactgacattgactgttgggcacagagcccttgtaatgaaatgtctaggccatagatgtatatgtcagatttaaataggtctgagagacatcaaagaaagtggaacttggagaatgataacgaaagggagtgagatttgcggtaaatggaatatgggactcaagaagaatgcctggagtgcttgagcctaacagccagctaattgggtcccttgagtttggagggacgggtaaaaagtgggaagccaaattagatgtgccaaccaaaggaagttcaaaggtgaatgggtttctttccttaaggactttgatagccttgtaaactgacaatgctgaaacaatgtggttagtgcaaggaggaggagacagcctgcatgctgtattactgatcagacagagaaggcaagcaggaggactttctgtaggactttctggaggagaactcagggaagagaaagaggaagttagcttttcgacaatggaaaaggggcattttataagacaagctttcatgaatctaaggtttttgtagttctatgagtttcaaggcaatcttgattgaagtattatgagtaggaaagacataagcacacggtttgtgaaatgctcttttattctagctctaagtagaagagtttcacacttaatgaaaataaaggagacagagttattcattcaggaacaggatgctatggcttgaatatttgtgttaccacaacattcatatgttgaaattctaacccataatgtgatggttttaagaggtagggcctttggaaggtgagggtgaagccttcatgaatgggattagtgcccttatgaaagaaacctcggagagctgcctaacgttttcagccatgaaagaacatagtcagaaggcaccaaccatgaacagggaagacagttctcactagatatcaaacctgctggtgtcttaatctcggagtttccagcctccaaaattgtgagaaatacatgtgttttgtttataagccaactactttacaatattttattatataaacttgaacagactaagacacagcgttttcatgatgaggtagtgaggaattaaactggtatcattaccactaatgtgaaagggagaagacaattcacaatcacatcacggaattctgtaaaagctttatctcatcaatgatgtttctctaatacagagtgtctccatgaagtgatttgtttttttatttcatttttggcataagataaactggtagaaaggcattcatcttggggtaaaaaaactttggctgtgagctccaactctggaactcattaacataatttaagacattgatcaagtcactttggctccctgagcctctatttctctacctctcaaatatgaaagggaggtgaggccatttcgaagcttccttcccagtagaatactgtacatttaactatatattgcaaatgagagtgaggattgataaataggaatctgtttgccttaactcatattcatttaaagaaattgaagaaattatgactatagacctccactagggggatgagccatgcttgctgggccccattctacttgcagccctctaaaatgagtgagatggctcagggctttgtacagggagtatgagcatgaaccacaccagctaaaggcttaagatttcagctcagccatgctggctgcaacaatgaagacatgaaatgagtataaggaggataaatgaagataacaaataagtaatacataggattaaatgtttgcaaaatgtgccagagtggagtgcagccacgggagacagccaaagtacattaagtggagacagaggagggaaggtgaggatgatgtttctttgtggaaggctcatcatcaagactgtatccccagggagcctgtgcatggggattaccattactcataagccatgtgcatggcctgtgcaaaataagcctccacaaagttgtgctgtaattatgaggatttcagcatgatttttaaagcactaaacttgtttttcagccaagatcttctggtgtgcatttgtgtgtgtgcctgtgccaacatgtgatagtcgtgggcagaaactccaaaagtaaagcataaagcttttctcatatgtacccccaactatgattaaaaagcctgtgcttgacagagaaaaaaacaaaataatattttattagaaagtaagtttattaaagcagctaagaacatgggctctggaggcagattccttcagagaggaaatctctgctgtcaaatttattagtagatgtgtgacctaaggcctacttcagtttcttcattcttaaaatgagcattataggccaggcatgatggcctatgcctgtaatctcagcactttgggaggccgaggcagcctgatcacttgagcccacgtgttcaagactagcctgggcaacatggcgaacccccatcttgacaaaataaataaatatacaactataaaaataaataaataaatacatacatacatacaaatattagttggggatggatgcacacccatagtcccagctacttgagaggctgaggtgaggagatcacttgatcctgggaagtagaggttacagtgagccaagattgagattgtaccactgcactacagcctgggcgacgaggttagatcctgacttttttttttttttttttttttttttgagatagagtctcactctgtcgcccaggctgcagtgcagtggtgcgatctcagctcactgcaagctccgcctcctgggttcaagcgattctcctgcctcagcctcccaagtagcggggactacaggagcctgccaccacacctggctaattttttgtatttttagtagagacagggtttcactgtgttagccaggatggtctcgatctcctgaccttgtgatctgcctgcctcggcctcccaaagtgctgggattacaggcatgagccactgcgcccggcagatcctgttttaaaaacaaaaactaaaactaaaaaactgaaaagaaacaagcattatacaaatacttgtaaacaaaattctaaccctctccccctacagccatctgaaaggacccctcttttcagctgagtgcattccaaggtcaacctgaaaaactagttcaggccatgatggaagtggggttttgacattataccctcctcagttttgtaattcaggaaaagccaaccagcattaacatcaacacagaccttaaatctgatgaaaagcatttactatctattctctctgaagtctgctagctggaggcttcatctgcataataaaaccttggtctccacaactccttattgtaacccagacattcctttctattgatgataactctttcaaccaattgccaatcagaaaattttaaaatctatctaagaactggaaggccccttcccctttgagttgtcctgcccttccagatcaaaccaatgtaaattttacatgtatttattgatgtctcatgtctccctcagctgtacaaaagcaagctgtaccccaaccacttgggcccatgtcttcaggaactcttcagactgtgttaaggacctatccttaaccttggcaaaataaactttccaaattggttgagaactgtctcagatacttttatgtcataagattgtcgtgaaaattaaatgagtatttttacgttacaaaagaaatagagcagggattgccatatagaatgtgctcaaaattgaaggcttttctgaaaagaatgttttaagaaaaaataaaaaaaagcagagctacagaaagaagaaaagttttttaaaaaagttatgtttaattcaggtcctacaacacatttttttttttgaaggacaatgtattgttcccatttttcatttatcatatataagataaatgagttctagcaagttggtactttagagtaaaaattccacaggggaaaagatggtttctacattgcagattttacattgatgttctctgttcttcaaaccagtagttttgtttttatccttagcttccatgcatgaggcagtgggttcgtagctaaccttgctcacattataggcatgatttaaagtatcttgcttcttactcagaattatttaagctcattcaattcttgaactcatcccagagctcaatccaaaatctccattttttgtcccctaaattagttccttctcccttctcacaccccaggagatggattaaagtttccttctttttatcactctatttaagtgcttataagcgttgtcttttagcaaggcttctcctcaaagaaatgcaaatgataaaggcgcctgtttgttcctgcagaggataaaaagaagagtgaagtatgcgatgtctctgggagaataagtttttttctgaacagttctaataggatggggtgagataagtagttctttaacagatatacaaaagaaaggcttgggaggtctaaagggggtagttttttatcctgatcaggtgaaaattaaaatctttagaaagaagatggttgtagaaactgctggggaaaagggtaagcttcctctttaccgccagaaggttcactgaaataaactgacaatagacaggttaaaaggagaaaaggcatccatgcttatgaacctgcataaccatgggagccatatgaaataggagactgaaagaagggccagatggctgaagcttaaataggacttcgtaggcaagaaggagacagggaatgtaggcaactttgaagggtaataaatgattgctaggggaagtaaatcggcccaaagagcaacattttgtaactggttctctgaaaactgaatagaaccaaagacaagacagtagcttgggataaagttcgtctgagctctggaggaagtgggaagtgaaacttcattgtgaacaaagattattttattacatagataaagtctcccaggtaatttatggaaaaaaaaatgtgtggtgtggtgacaacttttagttctttcttttctcaggtggttaatctttccaggttatttgataagactcttacgaagcaattttaagacttgcatttcttttgaaagacctttcctcagtcagataggggaacttccagagatagcccctcagagaaacaggtgaaggtgggggttgagaaataagagaaggttagaaagtccttggttctgaggctgcttctacagtcttccaactgcctttaattcaaaggtgctcagcatgccaaagctccataccttggtatattgtgctctgagccctaacatttccctgctcaaatatttctaaaagtttcatacatcaaaaactaagttggtggccgtgaagaaaaaaaacatatattttagtagctcggtggcaaaggataccattaaaccactctcctatctccgggtatttgtcagtccaattaaacagttggtttgtatttcagaaggtagtgtttggaggcttcccattaaagttaagcctctatatggctcaagcaaacaggtctttagcaagaggcatttttgtgggcacagaggaaaaacaatggttaatgtttggtgtagtctacaagctagttttttgtttgtttacagtttagaaggcagtcagttgagaagattcctagatttgggtttgaagtatcttcacttggaaatgaaccaggcagtggcaatctcacagatttttctgaattgtagtttatatcagatgttcctgtgaactcgccccaaaattgtacctgtaagatttgggtggattcttctcttcttgaggctcgaaatagcatgaggctctgggacctgtcaggaagtgacattttttacttataagactagaaactctgtgaggaaatcctttattcaaggtatgaggccaggtttccaggggcttctatagctttataatatcaacctcagttcctcaaagctgtctactcatattggaagatataatattccagtcaaagccttggtaatataatcagtgcttccaattgtcctgttacaaaaagagcagatacttaatgaacttatgcaaataactatattgccataataaaagcatactcacaaatagtgatatggttggtccccactcaaatctcatcttgaattgtaatccccataatccccacatgtcctggaagggaatggtgggaagtaatggagtcatgggggtggtttccccatgctgttcttgtgatagtgtgtgagttctcacgagatctgatggttttataaatggctcttcctgcttcacttagcacttctccttcctgctgccttgtaaaaaaggtgccttgcttcctcttcaccttccaccatgattgtaagtttcctgaggcctcctgagtaatgcaaaactgtgagtcaattaaacctcttctctttataaattacctagtcttagatatttcatcatagtagcatgagaacagaccaatacaaataatttccaaattttagagaaatcatgcaaaaaaaaatgcttcaattatgtttacaaaagtatatattaccaaattgctggaagtcatagaatgcttaaaaaatgtctttttgcatctggaaaacaaaacataaaaagaatcagcaacgtttcaaacaaaattcataaaaattataacctctcattagtttagttccttataattaattttgttctacttgatgttgagttagcaatttcatgagtccagtttttgcattagttttggaaattcttaccaggtccaataatatcagaaattaccagaaactcatacttgtcggagtccttttttttccatatatctttaaagacaacagtttataattaatttttcccatatgtccttaatgacaacactttataattccctataaaaaagcttcagacaaaacatcagaataaaacaattagctttaagcaacaagaattaaaatgaccatggttgaatatctgatggtagttcattataataatgtcgcaaatgacaaggaagtttgcttatatttgtagccgacaataatttaatagccaaaattatgactgataacatataccatgacatatcagatatttaggaaactcataaaatttggaacacatatgaatagtatatctatgcaagtgtaactcaaaagaggtcaaacctaattttttatttggcagtgctctctatgtattaaacatatcaaataaccttaattggtttgttatctctgttttgtacctttaggtgctattctggaacttccaaaactcagtttgaggtcaaaaagacttcatttgtattttggaattttttttttttaaataaaggtttaaaacacttcattaaaaataggatcacagattattacaaaataatagtcattcattccactaaccagaattagaattaaaaggctcaaaagaaaatacaagatgttaaatagatgttaaaaaaaattatttactctttcatagaaagtagactccatttttacagctaatcagaagacttagaaaagagagcacaagctcacagaatgtgtctctctcactcatcctctttttgtaattcactcaaaagattaacaatttttttaattttaatcttttatcaatattacatgaaaatcttaattcaaagaaaacattaatgtttacttttgtatcagtgtacttttgatattaaagctcatcttaagaaaagttcataaataatttccttttaatctttgtcaattgattacacataaaatttttatgattcatcctttataaaatttttataactttttaagacattttacaacttttttaaacagatatatatgttttactcatgtaactttctataaatctctctcttctacttactgatttctttctaccttgtttatttctgtactaaatccatatttttaaagaaccttttaaaaacctctacattggacaaaaattactttttctttaacaaaaatacattttcatgtctatttaaaataatttttctcaccaaaacacacttcttacttctcttgtatatcttgcacacagaattgtttccattaattttagtaattttaattacatatattaattaaaattttaattattagcaattgtaaaccagcattctgtagactaacacaattttatactttctataaatatgtgttacctcatagaataacatttcaatgtggaatagtacatatttactaactggcccaaatatattttgtctttttataaacttaagaaaccaaaaacaaataaacatatgtttaataagtaatgttttaatatttcatcttacttggaaatgacctagatattcaatgaacactcatttaatttaatttagtaaaactctaatgatgtagttaccaaagagatttagaaaaactttaagtaaacgtaatataaagcataattattattttaaaaagttcatttctaaacttttattccagttacatgtatttaattaacttgcatttaggtcaaattcatactgttatgattttaaacatctaatagtgataaaagttgtgtgtctgtattagatttaatgttgacagacatcctatttttaaatcaagtaatgttatttttatttaccaaagattataaatccacataaactttagaagcatttgagcttatttttttatttataaatgctcatttatcactaagtcaattcagtaccatgtagacagaatacaaacccaaagatatacacacgcatacataaaaatataggcagaccaaaataaagaatttatagctctgattttataattttaatcatgaggcaagtaaaactcactagtttaaaaggataattggagcctggcgctttggctcatgtctgtaatcccaacactttgggaggctgaggtgggagaaatgcttgagccttgggaagttgaagctatagtgagccgtgatcgcaccatggcactccaacctcggcaacaaagcaagaccctgtcttgaaaaccaaacaaaaaaatgaaaacacacacacaaacaaaaaaacaaaataaaaggacaattggatacaaactgtgtctttgtaaatggagcaagttaaagactgtctatctcacatggacaaagcccttattgaattttagaaaagacaaggtaggaaatttacatatcatcagcacagagaaagaacataagtttttccaagaaggtgtttgggtttgtcaggtggaacaaagaggaagatttaaaatatatgtcaatgtaatataaaataatagcaatccattacaggattttataagaaagtatacaaatgagagcctataagaaaagtttagaagcctgttttaaataactgattgaatataagaaggttgtagttcaaagaccaattttgttagatagatggtttttcaattcattttttgtttcttaactggattttgatttcaaggcagagcccggtaacaaataggaccaacaaagaatttgtggcttctggggcctaatacttatacatgtaaaagacaggtgtaactggaaggcaaagtactaagatctttaaaaattaaggacctaagcatgcaaagaaacaaaacaaatctgaatttgcccgctgcataatgaccagtactgtaattgctgccaattatctttaaaattgctggtcttgctggtgactcatgagttaataaacacccaaaggtcgagtgtcctcttacagtacaaagtagcccttggtactcctaaaaacccaaaagatcacacagctgactgtaaaacagtgcagagcttcagacctcagtggatgtagtccaggactctcggggctccatgaggaaggctgaggagcccaaaaatgcgttgtgtggtgccttttctgtgttccttaaggggtgtctggattgctaaaggcctatttttgatgtttttatgtaataaccagaagtgtgatgttttctattggtaattttttatccactgaccaccaaatggaggaggtagaagctttaagaaaaatatatcaagggaaccagatggaaggttgaggccatcagaaagaagtggaggcatcagtaaatgaaagaacaaatcatagaagagtcagcttgggagtttttcagaaaggcctatggagttttacactatccctggcaaaaatcatgtccacaagaaagaaagacagaggaaacagtgcatatggttaacaaggattcagaaagaggaagtttcagtccactgtgaagttttcatgggagaaacaggatcctatagagagattagaaagacctaaaaatgtggctgtttttaataaaacagttttttactttaaactgaactgaattggggaaggaaaagtctcagtcaggaatccagacatccaaatgatcttctggtcaaaaggattttacttttgttttaggtcagatttttgcttttcattttattagaagaatttctaaggcttgttgtgacactattatgtgtttttctttcaattcaatcttcccataaatgccaattgtgtaattgcataatatgagagttgtctaattttttttttcaaatatagaagactttccaacttaaagaatatattgtctggttatcgacaattaggatctccgatggtacatttattccaacagagactcaatccaatgaacccctttatggaatgactagatgctaaatctccaagttcagaataaactctttaagcaggaggtttccaaaaagggtgcagaagatgcagttgccattgcccccaaattttcatccacagaaacagactaagacggcaaaaagatatctgctaccacaggtggttaaagatggtgcttacaaatagtgtctctagtctccacccaaaatatggggtgctgctagtcacagacctgtcaatctatgacattgggtaggcacttctggtattagactttctcaacactaaccaggcaaccgaagttgaaataacaaaaggcccttagggatgggacttcttattaagagaaactcccctgagagctttgtacattcagacaaagagagtgctgctgaataacaatttgtgtcttgggtttccagtcttctcagactggccacttggcaggacccaaaaattgggctcccagctagcaaagaccaaaggaggaagattcccacctggtcacaaagccaggctgtcaggatataagatgaaaagagaactttatacaccaaagttctttttatgatgaatgacacaaaaagacagggacagagcaaaatgaagaccaattctgggaggaaaaggatgagacgacatgaatattcatactagatataaaccagagttgtaaagaccagtccatacaaatgtttttctcctattaatctaaatttgaaaaggaaggaaagacaggaagtgatgtttaccactcactcaactggattttgtagacagaaattaaggaggctgactggtaaaggtctcttacctttttgccagcttgtcagtcctaggttttctcaactgtagtttcaagtggatcacgatgattgtggtatactgccaactatgccggatttgcaggggtgaaaaacaaaacaaaacaaaacaccttctacctcaccctctgaagtttgctgaaataaacggataacataatgattaatacaagaaaggacatacatatttatttatgtggacaagcttaggagccgtacaaaacacgagacttcatgaatgactaggtggctgaagcttaaataactccctccttatagggatgagggagataaaaaaaaaacctaggcaattctgaagcgtagtaaatgttttttatgagaaatgaatgggcaaagagcagataacagattttaaatgatattctttggaaatgaaatgggaccatagtacagataatagcttggaccaaggaaggtgaggtacagaactctgctataaacaaaggttgccatattatacaaaaaaagtcttccctccctaaaggggtccaatttttgggtcctgccaagtggccagtctgaaaagactggaaactgaacacacaaattgttattcagtagcactctgtttgtccaaatgtataaagcagaggttttctttttttttcattatactttaagttttagggtacatgtgcataacgtgcaggtttgttacatatatatacatgtgccatgttggtgtgctgcacccattgactcgtcatttaacattaggtatatctcctaatgctatccctcccccctccccccaccccacaacagtctccggtgtgtgatgttccccttcctgtgtccatgtgctctcattgctcagttcccgcctatgagtgagaacacgcagtgtttggttttttgtccttgcgatagtttgctgagaatgatggtttccagcttcatccatgtccctgcaaaggacatgaactcatcattttttatggctgcatagtattccatggtatatatgtgccacattttcttaatccagtctatcattgttagacatttgggttggttccaagtctttgctattgtgaatagtgccgcaataaacatactggtgtgtgtgtctttacagcagcatgatttataatcctttgggtatatacccagtaatgggatggctgggtcaaatggtatttctagttctagttccctgaggaatcgccacactgatttccacagtggttgaagtagtttacagtcccaccaacagtgtaaaagtgttcctatttctccacatcctctctagcacctgttgtttcctgactttttaatgatggccattttaactggtgtgagatggtatctcattgtggttttgatttgcatttctctgatggccagtgatgatgagcattttttcatgtgtcttttggctgcataaatgtcttttgagaagtgtctgttcatatccttcgcccacttgttgatggggttgtttgttttttccttgtaaatttgtttgagttctttgtagattctagatattagccctttgtcagatgagtagattgcaaaaattttctcccatttttgtaggttgcctgttcactctgatggtactttcttttgctgcgcagaagctctttagtttaattagatcccatttgtcaattttggcttttgttgccattgcttttggtgttttagacatgaagtccttgcccatacctatgtccagaatggtattccctaggttttcttctagggtttttatggttttaggtctaacatttaagtctttaatccatcttgaattaatttttgtataaggtgtaaggaagggatccagtttcagctttgtacatgtggctagccagttttcccatcaccgtttattaaatagggaatcatttccccatttcctgtttttgtcaggcttgtcaaagatcagatagttgtagatatgcggcattatttctgagggttctgttctgttccattggtctatatctctgttttggtaccagtaccatgctgttttggttactgtagccttgtagtatagtttgaagtcaggtagtgtgatgcctccagctttgttcttttggcttaggattgacttggtgatgcgggctcttttttggttccatatgaactttaaagtagttttttccaattctgtgaagaaagtcattggtgggaatggccctgaatctacaaattaccttgggcagtgtggccattttcatgatattgattcttcctacccatgagcatgaagtgttcttccatttgtttgtatcctcttttatttcattcagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgcacattgattttgtatcctgagactttgctgaagttgcttatcagcttaaggagattttgggctgagacgatggcattttctagataaacaatcatgtcatctgcaaagagggacaatttgatttcctcttttcctaatcgaataccctttatttctttctcctgcctgattgccctggccagaacttccaacactatgttgaataggagtggtgagagagggcatccctgtcttataaggagttcttctataagggccttttgttattttaacctcagttgcctggttagtgttgagaaagtctaatgccaggagctggcctcaaaaaatagataaaaagtctgaatgtgtgtggtgataatttttagtcttttctcctctctggtggttcatctctgctgattagtgagattcctagggagagggttttaatacaattgcaattttctttagaaaaaatttcctcagtcagataagggaacttcagagagagcccttctctgccattggaggttgcggaaaaaacaagaaaaagttaaaaagtccttagttctgaggcagcttctgagaccttcctgttccctttatttcaaagtgctccaaataccaaagtgccatactttgggatatttttcactgaggtccaacaaaaccaaaggttatggttgctcatttgaaaataaacattcaggtatggtgaatagtgaggtgaaatgtcatgaataatgtcaaaagaagagcagatggtcttatggattatattcacagaagagctgtaacataatctatctgagacttggggtagtcatggaggaaaaaagttagatgggcttagagagaaaaggaagaggactattcttgctgagtgccttatgttttctcagtttcattcaatcacactgtaactttgagaggtaaattttatacccacctttacataaagaaagttcttggacttttaaaaactttgacaagcattgcttagctagaaagttctagaaccctctctctcccattccaacctgaacagtaaaaacacattctttaactttattcaataacgagtcaaggtaggtctcttgtcagggagacaaatgaaaggctcatattttatatgtctccagtgcacttggcataatcaagagtgtagtataattaaaattgtagacaaaggaatgaagaggattaatgtgttacaagtttgttgactaggctggagaaaagaaaaagagacagctgactagtgtggagtgtaatatcacagaataatgatatggtaaactgggccttgtaagggcaaagggaattgtttccttcccctctgaagttttgagtttgcaggaggaaatagacaatagattaactggagaaaaggaatacaaatttttaacatacaaatatgtgtaattgcctgatgggtttttcgtgctcactgtacagacaaaaccaattcactgagaccatgacattgtattaaagagtttaattgatgtgcgggcaacccacatggggaaactggagtcatctctcaaatctgtttccccaaaggcttggaaggttaggtttttgtagacattttggtgggcaggggtgagggaatgggtgatgccgattggttggagatgaaatcacaggggtgtggaaagtggttttcttcccctgagtctgcctctgtgtggggccatagaatcagttgagttatgagtcacaagtcttgctggcgtcagtctgaaaaacatcttaaaaaaaaaacttagaatttgcaatagagatgttatctacaggaacattgggaaggtcacaaatcttatgacctctgtccacattactcctgagcagtaaaggattataggaagtatgtccacaatttcagcagagttctgtcctctctcatattcataatcttgtagcctttcattatttttacaaagggagattagtctggggaagggctattatcagccttgttttaaggttaaactgtcaattaaattcctcccaaatttagcttggcctatgccaggaatgactaaggacagcttagaagtcagaagcaagatggagtcaactctatcagatttctcttactgttataattttgtgaagatggtttcatgtgcactggaaacatacaaaggataagactcaaaagaaagtgtcagatagctgagactcaaatattctctttatgggttggggagcggggtaggaaaatgggatatgtaggcagttttgaggagtaatcagtgattttcagggaaattgaatgtgcccaaataatataccatactctgaaacaaagcacctctgagctctggagttgtggcaacaagttgtgggaaggtaaagggtagaacttcactgtgaataaagattgtactattattcaaacaaagtcccagtaatctcttggaaataccctaagaagaacagataaagtccaggctcacaggtataatcccaagctgtttgggagcctgagatgggacgaccccttgagaccaagagttcaagatcatccagggcaacatagtgataatctgtctctaccaaaaacaaacaaacaactatatatatacacatacatatatatatgtatacatgtatatatatatatatatatgcgtgtgcgtgtgtatatatgtacacacacactatatgtatatacacatatatatatacatatatatatatagacacacacacatatatatatatatattaggtgggaagggtggtgtgcacctgtagtcccacctactcaggaggctaagatgggaagactgcttcagtccattgcagttccaggctgcagtgagctatgactgtgccactgcactccagtttaggtgacacggtgagaccctgtctcacacacacacaaaaagaatccataaaaagtctgtctggtgtgtctcacacacacacaaaaagaatccataaaaagtctgtctggttatttaaataaaacttctatggaggagttttaagacacttgcatttcttccaaaagaagtttgcccagtcagacaggggagcttacagagacaacccctccctgagttgggtggagtactcagaaacaagacatggttagaaagtcattggttctgaagctgctactaagtctctttcattttctttagttcaaagcaataggcaagccaaagtaccatactttggggtatgattttctgagccccaacatttgcctctctgaaatttccttagaagttttacacattaagagctgagttggtggctatggagagaaaaatgttagtaatggaatggcaaagaatctcattaaacaagccttccatttctgggactaggttggtccaattaaacaattgtgtcttatttcaggaagtggtgtttacagagctcccatcacagttaaggtgaacgagtctttaatatgtggcatttctaaatcagaagaaaaacaaaggttgaagtctgcggcaatctatacactagtttctctggattctggagggcagtcagttgagataatttctagatttgagtatgaagcatcttcagttggagcagaagcagtcagtagagatctgacagatttttctggattgtagtttgcgtgttatgagagaatgtctataaataagctgttgtggtgatttccctgaaggttatatcaagctgaccagttttgtcttgtagggcttcagaaaactgataattttaattttagttatctcaagtcagaaaattgggagaaaattggaaatgctgtaatagtttggagactcataaccaggtaccggaggagaccacaaggaatgaatatccagtccaaattacaagcaaaggataaaatctcaaacacgataagcagggttagaaccgaaaaatgggtatattatagttttcttctgaaacatgtgttttctctcttcagtcactctaatttttaccaaagataatcacaggaagtccaatttgtttgcaaaaatgagtttaaccatctaggttcttcttaagactgtgttgctgaaactttgtatgaagaatctcaaattaggcttttaaaaggcctcttacaggtgtgcagccaagccagagacacaacctcaaattctgcccataatacctgtagatttgggttaatcctgctcttctcagtaaagttctcaaactatctccaagttcttgggtttgtcagagagtgacattctttacttaccagcatggcagccccgtgaaccgtgtattcatagtactagaccagtttccagggggctttttattggcttcataaagtcaaattcatttccttaaaatggtcagattatatctgaaagttagactattcagccaaagctttggtaatataacagtgtttccaattgtgccttattagaagaagaataaattcgtattgaacttaggtaactacattgccataaaatgagaatactcaggaataattcacaaattttggagggatcaatcagggagaaaaaaggtaaatgtttcaattctgttcacaaaagtacacattatgaaattgaagcaagctatagaaagtttaaaagaaaaacaaagtcttgctaaatacggaagacaaaatataaaaagaatcagcaatgtttcaaacagaaagttgtaaaaaatcatggtttttcatgagttcagtcccaaataattaattcttgttctgcttaatgttgggttggcaattgtatcagtttagtattctttttcatttgagtcttggaaattatcaaagttttcagaaacctgtacttgtcaaagttctttttatttttcctatatacttccttgaagaaacaacaccttaggattataattgcctacaaaaagctttcagaaaaggcatcaacataaagcagttagttgtggacaacgagacaagacttaaaatggcaatggttaaagatctgagagagttcattataataaaaaagcaattgaaaagaaaatttgattatttctgcagtgtttatacaataattaaatgtaataaccgaaggttataaatgatagcattatcttaagacatatcagagatctagacattgcatacaatctttggacacatattaataacatacccatatgaatgtaacttaaagaaagttaaatattatttcttatttgacaatgttttcatataatttaacatattggataagcctcattggtttaatatctttttagggggaattttagagactttccttaattgtccaaaagttagtttgggggtcgaagtacttttattttgattcttagggggtttgtcaaatatcaaaggtttaaaacatttgatcaaaataaaatcacaggtcaccataatatgatattcatgtagccagagtgacaataaaaagatttcaaaagcaaaaacaggaagttacatagttgtagagaaacttttactctttggtaaagaggagactcagttttcctaagtaatcaaaagacctaacatgacagtataagatacaaagaacgtgtttctctctctcctctctcttttgagagtttttctcagtccattttgtgttgctatatcacaaaatatctaaggctagataatttataaagaatagaggcttatttaactcgcacttctgcaggctgggaagtttagccctggcttctggtgaaagctttcctgctgcatcgtaacatggtagagaatgtaaaagggaaagcagatatgtgcgaagaggccaaacctgtgagcagtctggctttatactaaccggttcttgttgaaactaatctatccccatgagaactcattcagttgtaccagaacaagaacccataaattattgacagaatggctccaagccaccacaagggcagagccctcatggtccaagcaccacccattagtccccacctcccaatgcaaacacattgaagatcgaatttcaaaaagagttttgattaagagaaataaaccatatgcagaccatagcaatttcacccctgccccccaaaactcatgtccttctcaaacaaaaaatgcaatcatatcatcccaatatttccaaaagttttaacttggtccagcaccaactcaaaagtccaaagtctaaagtctcacctgagactgaaggcaagtttcttccagttgtgagcctgtaaaatttaaaaaaaaaaagttatttatttccaagatacactgctggaacagacatttggtagacatcctccttccaaaaaagagaaataggccaaaagagaggaatgataggccccatgtaagtccaaaacctaggtcaggtgcagtggctcacccttgtaatcccaacactgtgggaggccgaggcaggaggatcagttcaggacaggaatttaagaccagcctgggcaacataattaacattatttaaaagttagctggatgtgatgatgtgcacttgtagttccagctcctcaggaggctaaggcaggaggatctcttgggcccagaagttggaggttacagtgagccatgatagcaccacttcactgcagcacgggtgacagagtgagaccctgcctcaaaacaaacaaacaaacaaaaatgtctaaaatccagcagagcagatgtaaatggtaaaacacaagaataatcttctttgatttcatgtctcacatgctgggcaaactggcatgactgttgggctcccaagcccttggaaacccctgaatccatggcttctctggatgcaacctacatggctaccagtctctgtacttggaagtggggagaagcaggaaaatgttacaaagttatcagttcggtgactgcttgtaagaccttttaattttctttgcttaagtgctcagcatgagaaagtgccaggtttagggtattagtttctgagctccagtggcatgaactagcttaatacacgtgggagaagaaagtagacaatgattgtgaaaaacatttcagtgttacagagtcctttgtatggaaagcaatccagtccttagactttaagccatagaacattttgtagaacgttccatggagtagtgttggaatgcacttttcttctaaggtattctaactatatcagaatattcatttttcatcacctctgtgatgggctaggcagtgcttcctagagcttctgaggcctagtttcctctcactcatattttcctctattactgtgacccaaataaaaactcagtggaaacaaatccaacatcacagcaagctcattatcagttgtgtggaggtggagacctgctgtcattagtatgggggaggaattacacagcaacttggagaagcagtttagaattaaatagaaatggaaagaagtgcttatgaaaatctcagctttcataaataaaataatgttgtgggtgggttaaagaggtagatataactctttcatatgtctgtctttatattttcatagtatccattatttttcaaaaaagttttaatcttggctgccaaatttgctcatcacaactaattggaatagagaagaagagaaaataaggacagagttgaagtgacattgccacaatgctgctaaatctctcatgatctcattttcttcccatattcagcaaaattatccgttcctctattattcccacccttctttccctccctcttgcttacatttacccaaagcaccaatcagcttgaactagttactaaaactgagaaataacaaaaagaaaaattccaagttgtttgaacttgcagttttctgaaaattacttaccataagacaagttacaaacatgtgaatctaatgctgttttttaatcaacagttggcaagaccagtgaggtgagattctaaaatgtgctgcagatattttgctatcataataaagtgttgaagtttgtgaatggtttactttaaaaaaataaactaaggtgtacttaagatgatcccagtggtattcctaaaataccacactcacttgcttacttaaattccaagacgttttctgggcagcagaaaaaaagcatgatttgagagtgagcaaaagggtaactgcataacactgcagcactggagaggtaactgtcagtgatgaaataagactagtattcgttcaaggtcattagcaacattgagttgtgactgttatggcttactctggtttattttttattttaactatagatagagatttagtctgaagaaaagcaagatagataaagtaaaatagtgcaccttttttcaaatgagtaagaacacaatgaacataccagttagcaacagcccagcacttagaacttctaaatgaaatgcaagagggtgatgcagatgacaattttaatagtgctatctaattcataacgtgttagaatatataaattctattgattgcaatttaaaaaatcaactaccaatgcttctttttcaatggcacctgcttgctctcctaattaacattaggtaaaatggagagctaggggaaaagaccaagacctgtttttagtagctaaaaatatgtttattaaagaacaaattttgaagttgtttgattaccgattttactactcagatgcttatagataactttgcatacagtattattaaaatccagtactgaccaggcatggtggctcacacctgtaatcccagcactttgtgaggctgaggtgggaggatcacctgaggtcaagagttcgagaccatcctggccaacatggtgaaacctcgtctctattaaaaatacaaaaaaaaaaaaaaaaaatagctgggcatggtcatggtggtgcgtgcctgtagtcccagctactcaggatgctctggtaggagaacccttgaaccccagagggagaggttgcagtgagccaagatcatgccactgcactccagcctgggtgacagagggagactccatctcaaaaaataaataattaattaaatccagtactgtaagataataaatttgtgttttctgagccactatgtttatggtaatttagtacagtggcaataggaaactaatagagacaccaaagcttgaatggtttattaactgcctggtcctgaggcagccccctctcatgacggggcatctggagaaagactagctaaggcgttctccagtagtgtttactatttatcttctttcctacctcttcttcactgcagagcgtgacagagtctgggagactgagggggcgggggcacaagccctctttgttgagtggctaacagctcagtgcagacaacaaatttaccaggaaacctctttcccctcctccaccagggcagaaggacacgtctgagagcactaggcgggcagattgagcagaagaaagctgggaaactgctccacatggggtgattcccctgaggttttatttccaaaattaaatttgtgttgctttccagggtgcgctcctatgatcctatgatccctgtctattgacacacgttttgtgcttatggttgcctacctgactgatatttctatttaatatgacactttagcagctaattcacaacaagcattgcagacatagctctttgtggccgtcaacttagatgattaaaaaggtgaatatgtaagtgtgtatgtgtttacatatacacccacacaaatgtagacatatacacatgtagtgtgtctccttgacaattttttttttttttgagacggagtcttgctctgtcacccaggctggagtgcagtggcacgaactccgctcatttcaagctccgcctcccaggttcacgccattcttctgcctcagcctcccgagtagctgggactactacaggcacctgccaccacgcccggctaatttttttggtattttttagtggagacggggtttcactgtgttagccaggatggtctcgatctcctgacctagtgagccgcccgcgtcggcctccctgataatttttacccacaatagtactcatactatctccacaatttttcagtgtacaagtcttatctttattttgttaaaacgcattttaattttttaaattacctctgataatgttataaattattttcttaattttttcaggttggtcattgctaatacatataagaaaacagaattttcaaatagatttttacttattccttttaatttagattaattttatttcatttcttgcttaattgctctggcttaaacctccagtataatgttgaataaaagtgacaaccgagggcatcctcgttttgtttctaaacttagggaaaaaactttctgtctctcactattaagtatgttgttagttatgggcattttgtagatgctgtttatcaatttgaggaagttgagaaacttttaaagaaatgttctaataataaaccttagtttgctaattactaaaactgtataattattatattaaatttagaaaatgcagacatgtagaaagaagagtatttttaaccaaccctaaatagactaccaaaataaaaccatcagtaacatccaatttggcacataaccgaaggaagatatccgagttcatggtttatctactatttttcattttggacataatattgtatttaacatatttgtatttgtaatttttccaatattatattttatgtctccccaaatttctagaaatagtgttatagaatcacaggatataaacattgtgtgtacatgagtgcatatgtgtgtgtgcatgtgtgtgtcaagctgtttcttatctattatctatgtataattctctctatatgtctatgtatataaatacatatataacattaatatttattttcaagaattcttgttaaattgatgcccttcccagaggtgtgtgttcttgccaatttttggcatctttaaaaaatgtttgtgaacttaactagtagagattgtgtagaagtgttgctttgattggacatgtctggcttaaaatatagtcatgtcactcacaacggaaatacattctgagaaatgtgtcattaggcaatttcattgttgcgtgaacatcatagagtgtactttcacaaaacctggatagcacagcctactacacgcctaggctgtacgatgtagcctgttgttcctagactatacacctgtacagcctggtacagtgctaaatactatagacaattgcaacataatggtgtttgcatatctaaacctaggaaaggtagaataaaaaatgttgtattataattttatgagaccaccatcacatatgccatctgtcttggaccaaaacgtcattatgtagtgcatgactgtattagtttgagcttcttattttcccgtttgtgtaagttatttaattttcttcctttgtgaactgatgttcacatccctcatgtttgttagttttccagtgctttcttttacattgcttgagtcccgtatatagtaaaagcactaactctttgtctaacacacctataagaagactgattctttcaacataatagaaactatacttccaattcagtggcatttccttcaacatagtcacagtgggaaattacacttacttcaatgatggtcccacttattaaaacactgtaagatatttttactctgaaatagtctttagagctctcatgcaaaccataggatcagctcagcccttttttaaatcattgggagcctaatgcagtgtagccatcttgctcattcatctattccctagacttggttttgaaatgacttctggctatttcttttttttttttttttttttttttttttgagacagagtctaactatgtcgcccaggctggagtgcaacggcgcgatcttggctcacttcaacctctgcctcctgggttcaagcgattctcctgcctcagccttccaagtagctaggattacaggcacccacaaccatgcccagctaatttttgtatttttagtagaggcagttttcaccattttgaccaggatggtcttgatctcttaacctcgtgatccgcccgcctttgcctcccaaagtactgggattacaggcgtgagccaccattcccggccgacttctggctatttctaaactcaaattcttcttgaaagatgaaaatttgctgccagtaatagtatgaaaaatatgagacctttgttccaaagtaaatttgttagaaagagagactcttctaagcaagcttagtgttattaggaaaattggatctccttccagctatgactgcttggaatgctaaaatattcattatattttctgatgcatttaaatacatatgtatataaatttaaagtaatttgtgtaaatgcagatggtttgtggcttgttttttttttttaatccttcattttccatggtcagttcttacgccttcacattcgtactattaattctttacacttcttcaataaatttactcaaatataaataacttcagaaaaatttaaaatctacccccgcaaaagcttcaatatctgaagtttatgtggagaatgacttgaggatttttttttaagaatagaaggtataaaatatttttattaggttattttatctataatttctaaatcaaattaacagaaatttattggagatatagtatatgtaaggttatatattttgctaaccaaaaataaatgattaagactaaaattcttggacccagaatgtacatatcatgaagtctttgtgcatcctgagatagtaactcagttaccttatggccctctctttaaagccttttttttcggcatgttgcctcatatttaaaaaatacaggcaagccaagcttttgtgtgtttcctcaaagaggctcctgccctgcacatcattagaaatgtttccctttaaactttctatttttccaaagaacttcgatttacactggcttacactcttctgtatcattctctgatatcaccttatctgtacacgacagatagtgtctttgatagttacatttctctagagaagagaacaagttttgaacatcaaaccaagaaactcattcttttggggaactgggagatgggtttgcagaaatgttgtagaaaagaggcttccagaaaccaaagatattctttgcattctttaacactttgcagacccctgagagtgacctgatttcagggttgatttccttcagggcagccactttctttcatgccaatgccagagttaaagtacggagagaaggccagtcttagagcagtgcttctcattctgtgactatacatcctggctccactggctgtctatcatttgttcagttcaccttctctggcaggaagaccagccagcctggcagtgttcttgttggcataatagaactgtcatgggttcatctgtagccatggacaaggagagctaatggaagctggaaagagtggattccagttggcatattgaagaagcttaactgaatagttttcaaaacaagaagttgtggaataagagttacagggagatagtagcacaaaaggaacgaggaagcagaaagactacaaagagaagcagaagggcaatcatggagaataagaaagaaatgtttccctacatctattgagtgacctggccaagtttagttaaaagacctggggcattgtataacaattggtagtgtcgaagaatattttacttgggaataaaaggagatcagccgccactcattcacacattaatcaaatgtctaccatattacttataacttaatttctgtaattacattactgaagcaaaaatgctgaatacacaacactaagagctggtagttacatggaggagtaaaaaggtaaacaatttaacatattaacataaattatggagctggaagaaacacagaggaaggacttgaacttaattggcagtaggggaaggattccaagaataggtgacagctgagctataatagtggcgtgaagctatttctttagagaaaatttctggggaacacgaatgaccagtgcacttttgcttttgggtacacaaacaggacaggcacacaagataattatctgctacaatgaccttgcctcatttcatcaaatccatctaaaataaacattatttggaagattcgtttttctatgacacattaagttgtatactggtcatcatgttgaccaagtaattttgaagggaataagaagaaaattaatatgaagtgtttattacatgtccagttccaccttacctgtcggaagtctcaatcacactaccgttttataggtgaatattacaaccatttcacacacatagaacagagcctcaagtgagttaagtagtttatggagggcacataaagaaggtgagtgttgggccatcctgtgaaagacaaaacagtgcctggacgcagagaaataccaagtctagatgaagagttttcagagtcctcggtgtctgaacatctgccactttctagctgtgcaattttctggaagttacatgacatttctcagcttctgaagtctgctttggaaagaaaaaacatcatccaaaagtactgtaaatacaaaggaccagagaatgttttgcctcattttttttagcatctgtagtaaaacctgtggtttaataagcacaattctgaatagaagtttagcttccagggcctgaacacaggcaaaactgttctgctcatgagacaggtaaaaataatttggtgttgcttcagactgtgcctagaaacagcaagataactggaagctgaaaatccatgaattgaccccttcttacaatcccatgcatctgtggtaaagttactgaactcataaaatgcttggataaagatgttttgttttcacaatgaagtagtgatgctttgggcctctgtcaaggtgaagcagaactagagaaagatgcacaggctcagatctcaaagagaaaacaattagttctggacccttgacagggccacagaactgggtgagccacattgagcgaggtctccagggaaaggagagccccagctgacatcttgtggaatgacacaaagatcacagtagacaaaggaagcacattttcaatgtaagcgaattcttctatgaatcaatacaatgagcttgaacgagaactccttgctctcagggacttctgaaaatccagcttcagtctttgatccccttgtttcaaatttctcactaaaacaacaaaaacagaccaaaaaaaaaaaaaaaaaaaaaaagatgaaggccattacagcaccataagaagagagtgtgacatttaatctaatggcccaaaactggagattttttttctttgtttttttttcttcagattattaggctggaggagctaaagcatgaagtgaaattctagaatcacacatgctctgcaaacagcaaggttgtctgcctggaagtagcatgctcttgggtcagacaggcaatgcatattttacacagaaaactataagcctgtcccatttcaggtctgctctcaggcaggcggagtgagaatttgtattatcctctctccgtgcatctccatgatacagtgcctcaaattcttatacgaattttctcacttctagagcactatagaacagaagcagtgatatctgtacaagctttaaacaagagaaagaatccagaagtggaacattccatcaggaattaacagtctacaacagttaaaagtgtagacagtactggagacaagaaggtgcataacaaggtttctgggtattgtagtttttcatgggctccattttaattgtgtcacagagagagtcagtgaggacaggtcagatcacatttcagttgaagggagttcatgcatttgataaatgtgctgtagcctggacatttgtccaagagttataagtgacagtatgccacctgtcaggcagatgaaaattatctacttcctgagcaaaaataatgaaccataaaaacttaacaggattccagaagacttgactatgatgaaaccagatacaagtatataaaaagaaaataaagagaaagagacgctatgttgttgagaattaaagaacaaaaacaaaaaacatggattaaattccaaatgaatgaaaagacattaaaatgaccaggtaaaaattattgtctgctttgtttgaggcagtaaaagacacaaataacactgcggatgtttttaaaaaggtgaattaaaacaaacaaaaaaaatctttgagaatctagttcagagcacaagagaactagagagacagtgatttgggatctttagtaatgtctactgacaaatctccaaaaacaacgaaaaacacactttgccaaaggaaaattaaatgtattggacctgccataataaagagaaccttactttgtcagtcctggtagtgtctagaaggcaggggcagatatttttagtagttagggcccaaagtgtattattttaaagctaatcttgccagatgggaaattggctgggactggacagagtttttgacctaagatctttggattgatggccacagaaaatcaggaatcttgacgtgagtctctatgagtaagctgccagtcttgagcaaaagctatttgagccagttctcagttttatcttatgaaacacgtatttcctggggcaaggtctaagccactcttgcttattctgagtattgtttaacacagggacaaaacatgatcttagtttcagctctcaataggtaatctagttttcatttctgactagatttttttatttttctaatttaaaaatatgaccagattttttatatgtagagttttcgtcaataattttgcaagtatatagcccggtttttgataagcataatcagatcaatcttcagtttaggaggtcactcccattgagtctcagagatgactcttgaaccatgagcttggtcttctgtagaaatagctattcttaaatcaggtccatggtctccatgtcccatatcaataatatttttccttttcatttaaaaaaattttctaatactctatttataatataatatatttaatatttctaattacatatgctttgtataagaaatgaatgatactttcaaaaattaaatatagatatttaagtagatgtctacaaaaaataattaggggataaatgttccacagtgtttattaagtatatttttctgcaaaatggaccaagtaggtggattttaaaagtctgcttttttcatttttcacatttctttaaggaacagaaataatgtttgccattggtagaaatctcattttaattttacagaaatacaataaaactagcttttagatcctcttttcttaccctaaactttcacaagggtttgatcagtgtgtgagggatggtgttgtggaatggagcagagctggtcaatgtgttagcaaacagcctcccaagcagcaggcaccctaccctcccactgaaccaacttttccatgtcagccctgtatgctgcatgatttgtctttggtagaaatcctgggaaaatcaagtgactttcctttacttcattttgcaggtgagcccagaggttcaactttcatcacctttttgggaagtaagattctcctacttctactttcaggagtgagctcaaagtcccagcaggcaaaaagcctgcaacattgtgtgggttttacagccaggatccattattatttttttctgagttaagggatctaaacatagaaaggaaagttggacatttgtaatttgcatttactgaaaatgataaaaagtcatggatattgaagaggaaggaggccatttctatggttagaaagactgaccctgtgagctctgcttagcctttggaatatctagtgtctaaaagaatagaggcaatgctaagatgttgtaacacgtctgcaaatgaaatggaaatgattctacttttctcatatattttataaatctgtgagtgttaagagtaggtaagaaaaacaatgcttacagataaaatatagttaaaaacattttcctctttctaagccttggtagtcatatagtttgaccaaatgacagaataaagattgtcccatgatttgaaaactgtcttcagtacaaatcttataaaaatatgataaaattataacaaatattttagaaggtataaaaataaaagataatatcctgcttctactaaaatatggacatactcaattatcttaacactttactttagaaatatgctttgacagatgtggatccatagaacctcaacatcttttttttttttttttatactttaggttttagggtacatgtgcacattgtgcaggttagttacatatgtatacatgtgccatgctggtgcgctgcacccactaaatcgtcatctagcattaggtatatctcccaatgctatccctcccccctccccccaccccaccacagtccccagagtgtgatattccccttcctgtgtccatgtgatctcattgttcaattcccacctatgagtgagaatatgcggtgtttggttttttgttcttgcgatagtttactgagaatcatgatttccaattcatccatgtccctacaaaggacatgagctcatcattttttatggctgcatagtattccatggtgtatatgtgccacattttcttaatccagcctatcattgttagacatttgggttggttccaagtctttgctattgtgaataatgccacaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttcttcacatcctctccagcacctgttgtttcctgactttttaatgattgccattctaactggtgtgagatggtatctcattgtggttttgctttgcatttctctgatggccagtgatgatgagcattttttcatgtgcttttggctgcataaatgtcttcttttgagaagtgtctgttcatgtccttcgcccactttttgatggggttgtttgtttttttcttgtaaatttgtttgagttcattgtagattctggatattaaccctttgccagacgagtaggttacgaaaattttctcccactttttaggttgcctgttcactctgatggtagtttattttgctgtgcagaagctctttactttaattagatcccatttgtcaattttgtcttttgttgccattgcttttggtgttgtggacatgaagtccttgcccatgcctatgtcctgaatggtaatgcctaggttttcttctagggtttttatggttttaggtctaacatttaagtctttaatccatcttgaattgatttttgtataaggtgtacggaagggatccagtttcagctttctacatatggctagccagttttcccagcaccgtttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgccttggcgatgcgggctcttttttggttccatatgaactttaaagtagttttttccaattctgtgaagaaagtcattggtagcttgatggggatggcattgaatctgtaaattaccttgggcagtatggcaattttcatgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaactgtgaatgggagttcactcatggtttggctctctgtctgttgttggtgtataagaatgcttgtgatttttgtacattgattttgtatcgtgagactctgctgaagttacttatcagcttaaggagattttgggctgagacaatggggttttctagatatacaatcatgtcatctgcaaacagggacaatttgacttcctcttttcctaattgaataccctttatttccttctcctgcctaattgccctggccagaacttccaacactacgttgaataggagtggtgagagagggcatccctgtcttgtgccagttttcaaagggaatgcttccagtttttgcccattcagtatgatgttggctgtgggtgtgtcatagatagctcttattattttgtaatatgtcccatcaatacctaatttattgagagtttttagcatgaagggttgttgaattttgtcaaaggctttttctgcatctattgagataatcatgtggtttttgtctttggctctgtttatatgatggattacatttactgatttgcatatattgaaccagccttgcatcccagggatgaagcccacttgatcatggtggataagctttttgatgtgctgctggattcattttcccagtattttattgaggatttttgcatcaatgttcatcaagtatattggtctaaaattctcttttttggttgtgtctctgccaggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagctcctgttattggtctattcagagattcaacttcttcctggtttagtcttgggagagtgtatgtgtccaggaatttatccatttcttctagattttctagtttatttgcatagaggtgtttgtagtattctctgatggtagtttgcatttctgtgggatcggcggtgatatcccctttatcattttttattgtgtctatttgatccttctctctttttttctttattagtcttgctagcggtctatcaattttgttgatcctttcaaaaaaccagctcctggattcattgattttttgaagggttttttgtgtctctatttccttcagttctgccctgattttagttatttcttgccttctgctagcttttgaatgtgtttgctcttgcttttctcgttcttttaattgtgatgttagggtgtcaattttggatctttcctgctttctcttgtgggcatttagtgctataaatttccctctacacacggctttgaatgcgtcacagagattctggtatgttgtgtctttgttctcgttggtttcaaagaacatctttatttctgccttcatttcgttatgtacccagtagtcattcaggagcaggttgttcagtttccatgtagttgagcggttttgagtgagattcttaatcctgagttctagtttgattgcactgtggtctgagagatagtttgttataatctctgttcttttacatttgctgaggagagctttacttccaagtatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggttcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgtacgtgagatgggtttcctgaatacagcacactgaatacagctcttgactctttatccaatttgccagtctgtgtcttttaattggagcatttagtccatttacatttaaagttaatattgttatgtgtgaatttgatcctgtcattatgatgttagccggttattatgctcgttagttgatgcagtttcttcctagtcttgatggtctttacattttggcttgattttgcagcggctggtaccggttgttcctttccatgtttagcacttccttcaggagctcttttagggcaggcctggtggtgacaaaatctctcagcatttgcttgtctgtaaaggattttatttctccttcacttatgaagcttagtttggctggatatgaaattctgggttgaaaattcttttctttaagaatgttgaatattggccccctctctcttctggcttgtagggtttctgccgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttcccttctccccatcactttcaggtacaccaatcagatgtagatttggtcttttcacatagtcccatatttcttggaggctttgctcatttctttttattcttttttctctaaacttcccttctcgcttcatttcattcgtttcatcttccattgctgataccctttcttccagttgatcgcatcggctcctgaggcttctgcattcttcatgtagttctcgagccttgggtttcagctccatcagctcctttaagcacttctctgtattggttattctagttatacattcttctaaatttttttcaaagttttcaacttctttgcctttggtttgaatgtcctcccatagctcagagtaatttgatcatctgaagcctccttctctcagctcatcaaagtcattctccatccagctttgttccgttgctggtgaggaactgcattcctttggaggaggagaggagctctgcattttagagtttccagattttctgttctgttttttccccatctttgtggttttatctacttttggtctttgatgatggtgatgtacagatgggttttcggtgtggatgtcctttctgtttgttagttttccttctaacagacaggaccctcagctgcaggtctgttggaataccctgccttgtgaggtgtcagtgtgcccctgctgggggatgcctcccagttaggctgctcgggggtcaggggtcagggacccacttgaggaggcagtctgccggttctcagatctccagctgcgtgctgggagaaccactgctctcttcaaagctgtcagacagggacatttaagtctgcagaggttactactgtctttttgtttgtctgtgccctgcccccagaggtggagcctacagaggcaggcaggcctccttgagctgtggtgagctccacccagttcgagcttcccagctgctttgtttacctaagcaagcctgggcaatggcgggcgcccctcccccagcctcgctgccgccttgcagtttgatctcagactgctgtgctagcaatcagcgagacttcgtgggcgtaggaccctctgagccaggtgcgggatataatcttgtggtgcgccgttttttaagccggtccgaaaagcgcaatattcgggtgggagtgacccgattttcccggtgctgtccgtcacccctttctttgactcggaaagggaactccctgaccccttgcgcttcccaagtgaggcaatgcctcgccctgcttcggctggcgcatggtgcgcgaacccgctgacctgcgcccactgtctggcactccctagtgagatgaacccggtacgtcacatggaaatgcagaaatcacccgtcttctgcgtcgctcacgctgggagctgtagaccggagctattcctattcgaccatcttggctcctcccagaatctcaacatcttaaatatcattaacaagatagtcctgaaagcgataaagaggatatatcgactaagtattgttgactttcagaatcctatctcactgtctagcatcttatcatacattagacaaatggttctacttatttttatattactatcattttaaaacctagactcctacctttattttttaaatcactgtttacctcagtaacttcgagcatgtctttcagcttctctatcatggatgtcagtacataaagttagaaaaagaaaactgttatttatggggctgtgaaggaataatcattgtagtactgcctggataactctccctgtacctttctgtcaattttaattattctcagtttgcaaggctcagcctcagatttgaccttcttgagattgccatctgtacctttgaagagttcagttcccttagctcaacgtacacccaactgcttaacaatggattttacgcctcatgagcacacaccacactctcaataagtaatcgactacattctatttttttgttcagtgttctatcactgctcaataaatattcaattactgctcaataaatatgcagtcattgttctttaaatatttttgaccatacctactatgagtcagtctcctttggcaactcaagatacagcaaaaaagcatcaatggatgtggcttataataaggtggagaaaacatattaagcaagcaacacacaagtaagtttcacttgtgacagttgtggtgagtgatatgaaggcactatgatgtttgtaatgcctcatattaattgccctgttgctggctgttaattagcacatatccaaccccaattccactgaaaatcttatttgatcacttcttcagttacttcttggacacttcattgtttggattttccttccactttggtgatagtctgctgtcaaatttgtttgtaggaccagattcttttccctgacttgatttcatctattctcatgttcccaaatgtgagtctccaaacagactcccctcctgaactctacacctgcagaccagccctccttcttaacatctccctgtgtcaaactcaacacacccaaaataacatcactttttctccatacttgcctttgaaatcccagtggattgcacttccattcttccaatagttcccaaatcttagaaatattacttttttctctttttctcatatctcacaataatttatcagctctatctccaaaaaatataaacagaattatttatgcaagatgagtgagttttatagatctgttgtacagcatagttcctatatctaataatactgtattgtgcacttacatttttgttaaaaggatagatctcatgttaagtattcttaccacatacacacaaaaggggcaagaacaaaaccttcggaagtaggtggatatgtctattaccttgactgtggtgatactttctagatgtacgcatatgtccaaactcattaaactgtaaacattaaatatgtgtagttctgtgtgtagcaattatatcttaataaagatatatgcatatacagaatcccattaatttttgccactgtgtcccctgctccaagccagtgttgcctttcccatgacaatgtcctgcttctaccacgtatctccttggagactattgtcacttcagaagccagaggcatgcttttaaattttgaatcagatgatggctctcctctactcagtcttgaagagtagctcccatttcaactcagagtagtaagaggcaaaatccttactgtggctacaaagttatacaggatgcatgaaacttcctgagacctcacacttctcctttcttgttgctctttcactctctccagccacattggctgacttgttttttctctaacacactagggtctttgctctagctacttcctaattctggatggctccagggataactacatggctcactctttactcctttaaccccccttttatttccagacctcacactctgcaaatgcgtttgcaatgaacctctttaacgttgcaacctgcctcacttctgtcacctcagcaattgagctttcctaaccctgctcacctttttattttttccacatcacccaaacccttctatcacacgatatcattatcttacttattttgtctctgcctaaacttctgctagtcatataagctccaggagggcataaatcttttcccaatgtatacactgaggttttccaagtgtctcaaagaatgtctggcacagattaggtactcaaggaaccctcagtaaataaataaatagatgaaagaatgaacacatttagtgattctttatttctaaagcaagaaagagatatcatgatgccagttaatttcctgagatagaattccttacaatacattggattcagacattaactgcattaagtataataccagaaagaaaataaaaagtaccagaggagaaaaaggaaattaatggaggataatacagtagagctttacttctaagagttgtgagacagagcagagcagtgtgcttatcttcctagggcattcctcattatgccctaacttcttgcttggcacatagcacatagctggcacaccatcaatgtgtgctgaactaaactgaaattctaagagacataagttaatcactaaaaaactattggccatagagttgatagaactcttcttcatggttcttgaatgaatttttccaagaaatattagaaatcctaatagccgataagaaaaggagggatgaggcatttgagaccaacctggaaagggtagtaagacctcatctctacaaaaataaaatgaaataaattagccgagcatggtgatgtgcaattgtggtcgcagctactcatgggactgagatgggaggtccgcttgagcctagcaggttaaggctgcagtgaaccatgattatgccactgcacctcagcctttgcaagagagcaagactctgtcccaaaaaaaggaaaaaaaaaaaaaaaggatggatgtcaatggggaagaatacttgcgggaatctttgcatatactttgccatttctcagaaatgcacaattcacattaacatgttaggatttggggagatatttctttcttgaaataaggaaacaaatttaacaaagttcagcttagaatttccaaatacttcacaaactattggtgctacagagaacatggcattggaaacactgaaacagttggccctgcatgtccctttccaatagtaacaccattgggaagcagagcaaaagatttgctgtaattccttagacctgaatttgagatccagctttactacctcttataaaagtttcctgggaaagttcttcctactttgtgaaactcccctttatgcattcctaatatgagactgacaattaacttaaagattatataggtcaatgcacatgaaagatctaaaagacacccgtttcataacagtatgttaataagtgtatgctgaatctgaagatcccattcttaaatcttagatctttcatctttaccaggagctcttgcatcaaatagtcaattatgagtaagtactggagctaagtgattatatttcttatattcttaatttacaagtggtgcctgggatgcatttttaaggtcatgtaacttttttcttattcaattgcttgtttatcctataacccctgttacattacaggtatttttaacattggtttttctttggagagatagtctatacagtggggactagcacaggtagggtgagaccacacattcaaatcctggttcttctctttactaagtacttgatttcagtccaattaattagcattagtcatctcagtctcttaatgtaaaaccagaatcacagggctcattccaggaggttactgcaagactcaaatgcagcactgcatataaagcacataccagggtacccagcaccttatgaagcacaaaataacggtacgtactttcttttttactgatattgatagtctttctcttcttccttcttgtttttaatcttcattttctgtagtcaaaatataacacattaaaaaatacaatgaaaaataattatacccaattccaattgacattgaaattcctagcccaagactagcagtggccaccaaggggcttccataagagaaagaatggcattccaagtgcagtgtcctttaaactaccaagtctgtgtcctcaggaaaagaaaatcaacctcaggctgaagccctggatctgaagggaactttctttaaagagaagcagtagcgtgacttttgcccaattctacccctccaggtgttattttaatgacaaaccacagcaacatatttccaaccatttcttcctctgattgacttgtaattggagtcatacctaagacctcaatcatctcatgggaagctttggggctgggagagcccttcaaatttgtccaaattgagaaaagagggctgagtcttatcccagcctcgctcctacacatgggccagtcttaggtaggccccaggaaggaggcataacattggccaaagaggttctcttctgctgagagagcaatgtccagagagaggctcagcagaaggctggtagctgataagacacccctcagctgagcctcagtctggaggggaatctgggccacacaatatggcaccaccccaggggacattgtaactgggtttatgtcatgtctatgtacatgtttgatgcaaagtcagagaaaagaaaaaaggtaactataagttcagagtgacccttagtctgcagttaatgctgaaggataattattagtttcagtttgggactgttgcttgacgaacagagacaagcatttgaaatggtaaaaacagagagaacagtaaccattggactggtggcaggaggcctattagtccattctcatggtgctgtgaagaatacttgagtctgggtaattaataaaggaaagacgtttaattgactcaaagttctgcagggctggggaggcctcaggaaacttacaattatggtggaaggggaagcaaacatttccttcttcacatggaagcagtaaggagaagtgcaaactgtcagatctcatgagaactcactcactatcacgagagcaacatgtaggtaaccacccccatgattcaattacctcccactgggtccctcccatgacacatgggattatgggaaatacaattcaagatgagatttgggtggggacacagccaaaccatatcacctggtttttgctcctattgggctacctccagtgtgacaccatgtaagttactagcccctctggcttccatttcacatctgaatgcagtctgttggcataaattaatctttgagggccttgaggtttaaagtgtactccatctgaaccttagaaaggacctggctccctgacgtgaaggaaaattacaaaattcacaaaaccttctaaaatgctaactcttttattatggctgcttaatgacctttgttcaaggtacaattacttatagaaagaaatcagttcttggaagaggactagcaggtaatttctgaatgtacttgctgttcagtactatgctgtgaatctgaacagatatttacttcccatcaaatatgttgcacatgtgtgatgtggagcacagagagtgtcacgctggacatcgcatgcctttcaaatgtgtctataattcagttatatggaactataggtgatttttttcccatataagtaaggttgcaaatgctggttagattcccacactagcccatgcgttagcctcgtaagcttaggttgaaacaaacaattgcaataataaatagcaagtttgattagtgcaatcctgatattatgtaataaaatatagtataagaaaaacacaggagaaaatggttttagaaattagtttgtaaagcttgattctgtaaggagatacacaaaaatgaaactatgctgaaatgccatttccattcatctgattgacatacagatcaaaacttctgtaatacgcagcgtttttgaggctatgaggagagtcagatattcagatgtgctgctcggaataaaaatcagtacaactgctacagaagccattttggcaatatctaccaaaattacaaatatgacccaggaagttcatttacagaaatctatcttagaaatatacttcacatggacaaactcatgaaatacattagtttagaagttagtctataataataaaataattgggaaaaaaccaaatacctatcagtagaagggtggaatatcattgaacaaggacataagaaagaatgaggaggcacctatatactggtatggaaaactattcaaaattcattaatccatgaaaaaacaagatgtaaaacagatctgaactggtgaacacagagagtggtaaactttgtgctgggggtgggaggcctggtttgcattcctactgcatatactgtgttattatttgtagaaaataagaacaaaaaatatttatttatataggcataagatatctctgaaaagacacagaagacactggacttaggcagctctgacgagagaagctaagtggctgggaactcaaggttggaagagaaatctactgaatacccattttatcttttacaatgtttagccatataaaattgtggcttgtttaaaacaaataattttttaaaaaatagttggatagctgagagtatcaagacaagccaatttaattagaaaaggggaagagagagacaagagaaatggggttgtggaaagcttggtggacccctggctgtcttacagctctgggtagtgttaccagagatgattcttggggcaagggaacaagagagctatctctacccatccaattgtttcaggagagccaggggcttataattgcagagtctttgaatgcctttgtatattttcatagaaagaaaccttggaggccactgagcctaatggaaagagaacttgggtagcaaccaggagactatagatctaattacaaacagtcaattatgtggttttagctgaatcatctaatctcgtggttctcgattctggctacatgttagatttaacaaagaagcgttaaaaaactatagtcaaagttggttttgatggtgggggtgggatcttactcagaccaattaaaacagaatctgtaaggaagagacataggcattggtatgttctagaagttcctgcggtgattctaaatcagagatagggttgaaaaccttttctttccttttgtagttttattttagtgttataacctgtcaaattgtgatttataagcatcaaatgacacaatttaaccttataaagtgttcttaaaataaagacaaggtttgtaagagcttgctacggtgttcactacatgaaaatcactcaaaaaatggtatgtatgcatatgtcacatgtctgttcaaaaatcttcatcggacaaatgcaaggaggtcttgactatatctattgtgcacatcaaaacccaggaaaggcagttccctcaggcttatcagaaagagcacagaaatttataatcagagcaatctggggtcagtttcactagtaccctgctgtgtggtcatggagcagtttcactcagcatgcttcctctggtacaaagtggtcataacaatacttggtaaggttgttggaaaaaaacagacaatgcaattaccacacaatatttttacataatcactactgtatccactataattaaagacaatgtataacaaatatgtagattattctagagatgcaaaataaattctctgatgagaaaacagcatctcaagaattgagaggaaaagggattcaaacaattatcaagtgagaaaatacttcacaaagaaaaactgcaaaactaaagctacgtacgtgaacactgttttgcagagaccacatctagaccctcagcagtaaaggttgtgctttttggaaaacgaagacaaagcagcaggaagaagagaaagggttgcaatggctagagggaagatgagggcttccaggtaggttgtgtgatgctctgaggaaaagccggtcatatacttgggtattccaggtcactctgctggaaccctgcttttaggacttctcaaatgaagtgactactagcctcttctcagagtcacatggaagacaaagaatactgatggaagaaacagctctggacagcaactttggagaccatgatgtccttgagagaaaactgaactcttgcagatgcaagatgttttaatctaccttccactccagatcaaggaacggtaaattagggaaataatgaatacgaagtacaaactgctggttattgatttgagatttgatatcacaatttgatttaccagatccactgtttagatgtccatagcactgactcttggctggagattgagtgtgctgcatgggggacataagggaggaaaatatctttccttcttctgatcttaggttcatggttgaagcctctataacaaaagacagattaacaagagaaaaacatgcacatttatttcataaaacttttatgtgacacaagagttgtcagaatgaagacctgaaataacagttaaacctgagttttgttttgttttagagtaagtttgaagagtttatagtcatgcagaaatattacacagcaaaaaaaatgatctgattgtaataaactggaaagcttagcggagactgtttgtgcagaattttccctgtgttcctgcatcttcagagataaggatgctactgtcctccagatataaggagggtacctctcacataagtgtctatgacctgcttcaggggaaggtcagaaaatctttcttaggttttacgacctgcttcagagaagaagggtgagggaaagtgagagtaacccttttgcttttgctgttttctcaaaattgctttagcttaaaatatcgtggggtaatgtgtcccgaacctcattaggtatgggaagagtacacttgctttgacatctgcagtctcatcataggttcttagtctaccaaagtatgtaacaagggatggaaattctgattgaaataattattatatacgatatggtagattttctcaaagtattcccctagaaaaccttgtaagattcaaaaagacaacatgcaacatgggagttccataatccattaggtttggaaaatgaggagttaaatatctcaaaagaaacattttcaactgcaggatttcttatagagtttagtgtgctaataggctttatgagtcttctccaaacagatctaatacatggcacttcctaaattttggggactcttgcaactgaagcactcttagagaaatgttgtagtagctggtaagataaagctgggtaacagtaaatgtggagggagatatggaaagatacaggaaatcatacatgtaatcttaacatactatacataaattcttagccaatgggtagggaaggaagagaatgtttgtctacaccacttccactttcattgatggatccaacaatacagagactctgctgcactgggtagaactaagtgttctaaattttcaaatcaactgcaaagaagatgtaatagttaatattagatgtcatcttgactcgattgagggatggctaggcagctggtgaagcattatatctggtgtgtctgtgagggtgtttccagaggagattgacatgtgtgagtcagtagacagggagaggaggaatcaccctaaacctggatgggcatcgtccaattggctgccagcctggctaacagaaagcaagtagaagaagggggatattcagttttgcagcgcttcctctctatcttccttccccagtgagatgaattttcatctcctgcccttggacatcagactccaggttctttgatctttggactctgtgacttattccagcagcctatcaggggctcttagtccttcagcctcatactggggactgtgctattggctcccctggcttttaggcatttggacttgggctgagcatgctaccagctttttttgttctccagcttgcagaccgcctatggtgggactttgcttttgtaatcatgtgagccaattctccctaataaactcctttttacatatacatatattgtatttcttctgtatctctagagaaacctgactaatacggaaggatttatatcttactgttgaaggtatataattgtttcctaattcacaagacctaggaaccaacttgccaggcagtgatttgtagccaacttctgacaacgaagtgaatcaaccttaggatgaagctggacctatggatggtagcagagttgcaaagaagttaagttcctgaagctatcatagaattactcaatcaatcagcccttaagctttttttacttctatgcttacgaatgtgtggagtatttaattcctttttatttaaaccaaattgactcagggttcctgttattatagacagaattgtgctaactggtacatgtaccaagaattaataatgcaacacccattaacacaggacgaagcactaactatgtgcaaagcaatgagaatcttgaagaaaaaggaagatagtatcaaatatgcatgtgaggaagatatgctatgacctggaattccttcaacctgatggttgaagcacacttgaggaacttgacatagatataaaagacaaagatgacaaaaattatatccttgagggaatagactaccattcaaactgaagatgagaatttggcagtccaaagacagatatcagaacagccacagatgaaaaataccactgtgatagaggagcagtgccgttcttgacattagcttggagtctcagcagggagaggaacattcgataaattttttatttgccttacaggcaacttcaaactcttggaagacataagaaatgatgacgagaactattatttctaatctaaaagtaggtgttgctgtataaattggaaacaacagaggactcaggaaagcactgattctcatccattgaaaggatcctggcatactcattcaaaattgaccacaatcaggatttccctaaaggggaattataaaagaaacagatcaaggaatggagagacagcccacaaggaaattgtggtttaataaatgaccagcaatgacaaagacaaatgaataaaaaggaactaaagtggtgccacgaggagttcactgataaattgagatttttagcaacatattttccagttttattaaaaaaaagacatgtaacaatagagaaattcaaacggacagcatataattataaaaacactatctagaagactaaggttcagaataattgaggttttcaaaaaagtaaaataaaaataaaacaaaaacccactttcaattatattaaatgtattttcagttatattatgagcaatgtgattaggagggctgggtggtgattataaatgtacacaaaaatttctgtatgaagttatttattacagtgttacttaaaaggatacaatatttgaagaaaagacctgataacaaatacttagttaaaaattttaataggcatatagaatgatgtactaagctattaataaaattatatttatgaataattttacatgtaacattcattttatgatatgttaagtgaagatcacaagacaatatatttgcagtgtgatatcacttttgtgtgtacatgtatatatgtgtgcatgtgtgcatagaagagataatatttatctatggtggtgatattttgagatacttaattctacagtgatcctatattactttgtaataaagagactggtactatatttaagtaaaaataaattcttagattttaagtacaaattaagttaaattcaatacattaaaaacaattatattagagaaatgtcaattatattatggttaattatttctttcactagttacaatatagggttacataaatagaacatgttctgacaaaaaccagatagaaagtcaaagttctgtagttttctatcaaatataatttttgtcaaattggaaagggttgaaccaagttgatcaataggaaaatgaactcccaatagtagggagaacatcaaagattctagttgctctaaatgagttcacatttcctggtcctgctctctagactgttacatctgtgagtactaagagaagaagtcaatcatactctgttcaaaatttgagcagatgctctgaaatactgaaaatagttcaaactaattatcacttttaggaaagtagagaaaacagagttgataaagtattctaggcaaaggtttaagatgacttaatcgatgatctgtgagtgcctagcaggcgacatgctcatcactacaagttagtaagaggacatgtcacataagtcagaccaactctattaggaatgaccacacctagtggcaaaatcttggtttctaaacagcattctccaatgcacacaaccagggattcttggagaagtgattgacagtggagctggggcagggagaatataagatgggcctggaacgtcctatgactcacaaaagtaaggcaatactgaagaaaggttgaaggcctatctcaaggacacagaagtcaagctaataagagctcccaaacttagaacaatgagagagagaaaataaatcatggctatatcaaattataactcataaattacactaaaattctatgaatctaacttgatataaataaatagttgaataaataattaaagggaaaaggagcagctctttcttacagaggaattctaatgaacagaagtagaatgggcaagatagaaaatcaccatgagcacaccacagtaataatggtcgcaatacatggatcatctatgcatggtaaaattagtgggtgaaaatttcaggagagacaagatgtttgcatggcctgaaagtatctctccaaagatatttattaattacaaagaaaaaaaaacagtaaatttcttttatacaattaaagaaacctgctgaccccagcataactggtaagattaacatcaccaatgaaaaagcatacttgcatcatgattctcttaaatgatgctcaaacaaaggcaaaatgtcacttctgtggccttcttgccaagaatgtataacttcaatctaatttgtaaaaataaaaacagacagactcaaactgaggggcattctataaaacaacctgaaagacaaagaaagactgacaagactgtcacagattggaggccacatggtaattaatgcaatatgagattatggattggaagctaaaattgaaaagggacagcaatggagaaactgataaaatgaaaataaagattgtagttgagttaatagtatgacatcagtgtaatttcctggtttgggggactgtgctatgatgatgcaagtttttcacattggcgaaactgaccgagtggcgtacagattctctctgtacagtttttgcagtatttttgtgtgtctaaaattatttccaaaaaaaagttaaaaaactacatcattccagattaatatgttaatggatatctaggcagacaaaatgaagaaatatactacatagtaacactgttaaactcaaaactacttaccacagaatattccaaatgctttgatgagaacatcaccttgaaaagtgtcctcaaaatggaaccaaaggtcattccaggctttggcctgctgttctgcactggaatcaggtttggatgagtaccaaacttgtatatttttcataagaactgaaactggggagaagaaataatatagtagatgaaagcacctagtacccaagttaactggaagaaaaacatattctaagagaaataagcaataattgccttttgtttcaaagcaaccgtctataccaatatagaaaatgaaagatgctgcttatcatgaattcaggcgaaataaaatatgtgagtgacagctgccatttatttaacataattaagctctctttattgaaaatctataatgaggaaaatggaactttttgtattattcccaaaggcagaagcaggagcaagcatagacattactaggaagcaattactggttcagaacaagaaaacccttgcagtggttatttacaaagcacagagtttcatttgggtaagtggaggtattcaggaagaatagaaggtctctgagatcacggaactgagatttgctctgctaagataaaagtttttcatgatctttatgagtgcctctaaactaaaataccaggatgcttgacattactatatgtaccgtgtgtgtgtgagtgtgtgtgtaaaacaaagttgaatgtgctagctattttattatcataagtttatcatttgggaggtggaaatttgtgattgaatagctgtgtgatcatgccattccatgctaatatccaattttgtgtgagcatgtcattccatgctaatatccaatttcttttatttttcaaaagatatttactgtcctgtgagcatccacagagagttcggatggccctacctttttttcttttaagcttaagaaagtaatgagaaatgaattagagttcttccatgagtcaggtttcacgcaccagagaagtactggggaatgcactattgatctattttcttcaactcatttcctgtgtttaaatggaaatattgatacctatgcataggcttcttctgaggttttggggatgtgagcctgtgtcttgtgtttgaatcaaagtaagatttagatttcgtggtattaaaataagaagtgtgagggacaaaataaaagtctccaaggagaaagaagttggaaaaaatctttaatagccttaaggttcctctcacgtagttaccactaaggttttggatgagaatgcagtagacagaactcaggctcaccaaggagttaactaagatggtggttatttacattgggaacactgtcttccactgaatacattatttttgctttaatagaaggatttattcttcaaaaaaggtctcttcccatgtatttaaaggttagctaatgggtcactctttgcctaagagaaagaataaggagtgtaaaaggtgtagaaacaaaacaaaagaaattgtagataaaagttttattaggagctaccagtaatttctgcaatcaaaaatgggcctgtgggtggctgaggtgggcagatcacctgaggtcaggagttcgagaccagacctgaccaatatgatgaaaccctatctctactaaaaatataaaaattagccagtcgtggtggcatgcgcctgtaatcctagctactcaggaggctgagacaggagaatctcttgaacccggaaggtggaggttgcagtgagccaaggtctcgccattgtactccagcctaagcaacaagagcaaaactccatctcaaaaaggaaaaaaaaaagaaaaaaaaataaatgcaccttttttttttatggataataatgcaaatccctgggggaaaaaaaataaattttaggaaatgttatggctaccagagaatgtcgtacctaaaaattaagtttcaaaaaaattctaggaaatacaagagcttttgagctacatatgtgaacaatgaaggaaaaactttcacatccaccctgtaaatcttaagaacaattttgattcaagggggcctcttggctgagtctagacagcctacctttgaattcaagctctttgctacttgtgtttctaggagccaatgctaatttctgggaatgttgtttaagaacttctacttactgtgtactcattttggcaccattgcactccacatactcacaggattttgttaatagggactgatgcttacttaaaagctttattagattatctgagtggattgcactggtccaggtatatatatccatcacaaaacctcttcatcctttaaattaagtacttcatgaggacaacaaaaagactggagaaagtctgaatttactctatggaatcaaccgtatgtaatttacacaattaaaaaaaaaacatgcttttttaaaagcagacattagagaaaaatgtaaggataaaagtaaagttctctatttcttcctccacctaccccactctctctctaactcccactggtaggattatgaaggcgaccatttttagtatttttgcatgtatttttgcagatttttctttaaatataaaagcataattacatattatcaatgtaaaacagtacatattttttaaaactttcctattatcacatgtacatatgtctgatttttttcaacagctgcttaaaattacattgtatggtcttacccgtacttcttcaacaaaagtccttgacttctgtacaattatgttgctgtcagttaggctttcgtgttttaaaaatagtgcagacatggtcgtaaacttatcttgacatacttttatgagaatatttatgggatgtcttcttgggtatgaaactgttgaggttcagagtgtgtatatttatatatctattcttgttggatgatgctcgtatcgaggtattgctgacttcatttattagtgacataggtggatactcgttactctctgtttacatcttgagaaagggaaacaactttctatgtgagaacaacatggaacaagttcactttgcatatgaattaccttacatgtgaggattgctttctccaatgccctatgaaatatggctactgctatctttttttctaatattttctaattttttttctaattattttttagagcagttttaagttcagagcaaaattgagcagaaagtacaaaaatttcccacatacccctggccccacacatgcataacctcctttgttattctctaccagactgaggtacctttttttttgttttttttttacaactgtgcaattgatgaacctgcattgacacatcattatcacgcagagttcacagtttatataagggtgtactcttggtgctgtacatgctagtggtttggacacatgtataatggcatgtgcccaccatgacagtatcagacagtgtatctgcactaccctaaacagcctctatgctctggctattcatctctccctcccctgacccccagcagctgctgacctttttgctgtttccatagttttgtctttttcatacaatatgtatcccattttagtctggcccctttcacttgtcaatatacatttacatttcctccatgtcttttcatggcctgatagcttattccttttaagtgctgagtgatattccattgtctggacataccacagtttatctatttacccactgaaggacatcttggttgtttccaagtttggtcaactaggaataaagcttctataaataactgtgtgcaagttttttgtgtggacatgagttttccactccttgggttgctgctaacattttattaacttgggcatggcctcccttgtgaggtctggcagcgccctcacaagggagttttgtaaccagccctgggattttgctcctgtcagtggtaactgcagctgcctgagaggagtcagtgatgaaattgttgcgcagaggtgtagatggtagcataacctatcttttggaatactgtaagtttattcaaggagaggagagggtgaagagggttacaagttagacccattgttcctgatactttggttgtggaaaccccttgccttacaactacacagaaatcagaattagaattcagatctggattaccatgtttgtttatgttttattatttttcttaaaaatgattctctgtgattctaaacacagtttatttgcatatctaaaactattttcctagttattaatttactgttataattaatcagattttatataaattgtaatagttgaagacattatttcagatatcaatagtttattaagcttattaatagcttaatagtgtattaagattaaccatgtggcaagaaccgcattttgtacaccatcccatttatttttaaaagccatcttatagaataagaaaactgagaatttccatgagagataaggaaaattgccagagctggtacatgactgggctagattcaaagacaggttcctcttcctgcaatgctcgtagtttttcacaataccgaccagtttttattgaatttgtccttggggaaattgtggagcataatgcatttgtactctggtgaagagagagacagataattgctgtaattctctggaaatcacaggagcctagcctaagtccattctgtctccatcaaataagcatattccttacagcacttgccatacatatcatgtactttagcacatatcatgtactttagcagtaaattacagactcttgtactgctcactgttttcctttccatgggtttatatcatctctttcgaaatttgtaataaagtctgtatccaataaatctccctcccctacctccactctcttttgaagcagtttaaagatgacagccagtcagtgaatattctctgggtgtgtgctatgcgcaaggcactgttttagactctggggatagagcagcaatcaaaacagcctgtgccttcagaaaatttacgttccactggaaagaaaacaaggaaacaagcatgctctaaagaaacaattttagataatgatatgtgtcacgcaaaaaagtaagctactagttaatataatagagaatagattggaatatgaaggacctgatatttccctggggaagagagggctggaatctctgagaaggtggcattggagctgaaacttgtcccttcagaacaggacgccatgggtggggacctgggagaagtgagctctgctcagaaggaaaaagaagtgcagggaacttgacgtgggaactagctgggtgtgtttaaggacagatgaaagtctgatgtagctgggtggctgggggcaagtgcacatggcaaagagaatagtggagtaaagtagccacaagtcatgtggacctgagtttgaacttcattcaaatcagaacaggataccaacacaatactttacatgggggagtgatgtgatcttttttattctacctattagaaccagtacaccagttctgggaggatggacagcaggcagaacaagtgcaggagtgacaccagttaagaagtcattgctgtggctcaagaaagaaatgataggtcttagacaagcatgcaacagtaaagaaattaaaagtaatcacattgggatagagacagtgggaaagactgatgggtgatttctgaggcattaggggaaatggtgataggatcacccccccctccaagactgcacactgtgggaagatcctcgtagagaggtgccatttgctgagatgtgtaagtgctgggcaagagctgacttttcagggtcggggtaaagtggggaaatgaaaggctttgcttgactactacaaagtttgagtcacctatgagcctgggagaggtcgagcgggacctacaagtgtatttgctccagggttagacatgtgaatatgggaggtgttgagcctatcagtggtagttacagccatggttttaatgaggccacttagggaaagatcttcctgtggttgatgaagagaatgggacacacgacagagccctggagcctctagcaattaaaaacaagaagggaagaggcgtgaagcaaactgagagagacagtgaaggaggaaggaaatgacaaaagcgtggtgtcagggaagcaacgaaggtaagcaggagcaacaaggggaagtgaaatctaggtcatttttattgtttgcttgctttgtgtttgttatttgatttgtgagatgtattaaggcatacttgcatgcccaaataaataacctagtagaaaaagaacactcatgatagaaggggtaactcaggaagggaagaatgggcaggagggttgagataagccatcaatgtggctaggctggcccttcctgctagaatgagcacttggcttggctctctgcactggaaagaaggtagtctatgcgctcagatgcaggcacagagagaggtggctttgtggatgggtagatgaggtagttctagtctgtttctgttatgttctaaaaatatgaggaagtcatcagctaagtgtgggggtgaggaagaaatattggagatgtgaagagagaagattgcatgaaatcatcttggagagtgggagagtgaattttcctagggaagcatcactgggtggttttaaaaatctgaacaatacatttgagtctcaatgtactcctctttccagcttcatgatgttggaaaaagcagcttaaatactttaaacttgctttcccatcagtacaatcattgtgggtttttgcataacatctatgagatgttgggtaccttcatatacactctccaatttattctgtaaaattgggataatgacacctactagaagagagattatttgcaagaactaaatatctatatgaaaggctttgcaaacagtaaaaaacaaggcacttaaaatattttcctgccgttattcttatccacaaatcctagctcaaactatttagttcttgatcgatttttagaatcccttctagtttgattcctatatctgaagtttggaaattgagcttgtgtttctctaaaggaaaaacaagatgtttaacacagaaaaagatttttttttcttttaaagtgttcttaacattcctcggattctggcattttcttgaaataaaattaggtatgtgttttgaaatgtcaagttttcaaataaactcctacaaacccgctgcgaagttgctccctttgctttgctaccttctgcatatacaccttcagtttcctccaggtgtcccagctccagccccacattcctgtgccaagaatcacaatgacccgtacatttccacatcacctttcttgcaagaagtttaacacatttggcgaacattattgctggagtaataatagttcctcaggtttgtagagctccagctttccctggagcttacaatctgcatgcatattacctgatttagtctcccatcaccgtcttggagcaaacattagtattagacttgcagacgggaaaaccgaggtcttgaaagtttacaggcccagctatatcatttgctttttatgtccttcttcctaactttccagcttctagtagtcttttgaggcccattgcagcctgtctgcaccatgaaacctttcctgttaaccgcagtaataattgattctgctcccaaactacttacatcattgtgcttacagacagccccatacactctggtactgcagtccagtgggaggtaatgtggtactgtagcttggaaagaagacacatcagaacaaaacttgaactacaagtaaactctgccatatgctagctgttatttaaaatctctgaacctctatttctttactagcaaaaattgcaaggctattatgaaggagaaggctgatttatgcaaagtgccttactagcagagttcctaccatgattggcactccatgaatcataactctcgggttacagcaaaagtgtattttatcatttactaattgtttcacatgaatatactttttactctttaataataataaagtcctgcaggaaacaaccaatatcatattatggaatggaattcttaggttttgcttctcttcatgcaattttaatcaatgcagccaagttacacatttttctctaaataattctttagttttgctgtggagtttttcacatttcattcatctttaaatgtattgtcatttcttttatttctcttattattgccccattaatccgtggtttaatatctgtgtgttattgagtttgcagatgtataattttaaacatacattattatattatatattttaattggattagattgtagtcaaacctgtatgtccctatgtggttatctctttgaaagttaaagaggtctctcttgtgacataatgaaggtcagatttttataaatactccaagtgtgctgcagaagcgtgaggatccttggctatgtccagttcacacggtcacattgcacaacatttttcctatgcataaaatgtatcactttgcctttcttctctttcccatatggaaaaatatatacatttatatgttattgtagtaggaaatttggaatttcacctgagtttctttagagaggttttttaaaaaagctcctatgtaggatagagcatagagaaaggaggtgtattttggacataaagaaaggggaagatgcttatcaagtaactattgtatacatggttctttagatatgctccattttaactcccatttggaaaaggcacattaccttcattttaaagataaggaaactgagacttagaaaaagtaagttagatttttgaagccataaatctatttaattagaacactgaaatttcaatccaagttcatcagagttcaaaatctgtatccttcctctgaggaagaagaaaaataactaagtaggcaaacgtgaaataaactgtggatttcttgtccctccgctttgttcttcctctgttatctgatttccccagcgttctaacccgcaaagtgaaaagggccagggatgatctcagagacaggtgccaagccctttcttttgtgatcaccacgctgtgcctacctttcccatccacaattccactcctgacaagtgagagtgcagacaggttgaacaatccagaagaagacagagatgccatatggactcaaaggtgagacaggagcctcactggcttgtgtattcccacagcagcagcaggcacttagcaagtgatgggaggtcactttgcaaatggcaggcacccaacccttgagcaagaggtcctctaccatacctcagtttttgtcataaaagacatttcatttgaacatgaattaaaggtatgaatttggtttgtatgtggatgaggaaagtttagcatgaaaatcagaaagaaaaaaagacattggtgggtaaggatgatggttgtgtttgtttttacggcaggcattaatgggagagaaaacgtatcattattatgaacataatctaatagtgaatatgtgcctattattcactgtgccatccaccctgctaagaattttgcatgcatcatttctctttaccccacttcaatcttatgagatatacatgcctattatctctggcacccatgaccaaactaagtcccctgctcctcccacttatcacaattgtgcaatataagaatttaagtagtttaatctgcaattaataactacctcccccataagactatattctctgggggcaagatccatatcttccttttttataactctatcttcaatgccttgcacaatgcttgctgcataagtaggcacagaaacatattttttggataaatgaatctgcttttacagatgttgaagtagtaagtaagtggcagaatcagtatataattccagacttgcctgagcctcttaagtgctgcaataaataaatgttcacttccttcttgggcaaaaataatcatatatattcttagaggcaagaaaactgtcccatccccaagaagtgccccctgagtactctatccctggaggggttcacattatcctaccaatgtccacttccttttttatcgtgttctgagataatacattcattctttttttgtttgtttgtttgttttcggccgtttggctatggattccttcagagtacatcattcactatgtatctccataatgttgagcacgtagacaacatcgatgtttgttgaatgaattaatgagtgagtgagtaagtgaactgcccaggctcagtgcaccaagagatgtacagtcagttaaccttgttcattgagctgcatttcctgtggagtgatggggggtacctcactgtccttctctttcacatggtctactggaaccaaatgcctgcctttgtatgatagctgcgcagaatcacctaaggctgaagaaacaatgttgtttaaatttcttttccattgtgtgaaggtcattggccagtaaagagatactattcatgcccttaagaagcttgcaatacaggtttcctataaatgaggtactaaccttgtttgaaactcagaatcacagactctacattataagtaaccttggcaatagtttaatctagttctcacccttggccagaatcccctttcctgtaacatacctgcagagacttgaaaatatgcagggatagtgatgttgctacctcatcaagcagtctcttccatagttgaacggcatttctgccaagaaatgttttaattgttttgagctaaatctttcttacaataacttcatccaatttgctgtagtttacagctgtacaaaagaagttgcagccttcttcaataactatctgatggtaattctgaccttccctttcaccttttccccctacacactttgacagtctatttccatatggcacacctcagtgccttcagtgttcctcttgtgattatttcaaatgtctccccagttttgttcacttttctgatcatgctctgtaggttctccccaaaaattgccactcctctgcaatggagtggatgtttgtgtccccccagaatttttatgttgaaaccctaatcccaatgtgattgtatttagaggtggaacctttgaaaggaaggtcattaagtcataagagtggagccctaatcatgggattaatgctcttataatcagaagccagagggctaacttgcttttttcttaccatgtgaggatagagcaagaagatggttatctctaaatggtgaagaggacccttacaaagaaccccaccatattggcaccctgatctcagattgccaatgtccaaaactatgggaaataaatgtgtattgttatgtttaagcaacctaatttatggtatttggttatagcaatcagaggtaagaacccctgcctcccactaaaccctagttgtggcctgataaagatgagtacagagtccgactagaatgtcatcttttctgctggggatagcaaagccatgcttaggctattttggctaagatgccccaccaataattttcttcaaatctattatttctatttctgttttttgtctctgagcttatactctgagatcaaagtttcatgcgcgtccatgtgaagagactaccaaacaggctttgtgtgagcaataaagctgtttatttcacctgggtgtaggtgggctgaatccgaaaagagagtcagcgaagggagatggattatcattagttcttataggttttgggttaggcggtgaagttaagagcaatgttttgcgggcagggtggatctcacaaagtacattctcaagggtggggagaattacaaagaaccttcttaagggtgggggagattacaaagtaccttcttaagggtgggggagattacaaagtacattgatcagttagggtggggcaggaacaaatcacaatggtggaatgtcatcagttaaggctatttttacttcttttgtggatcttcagttacttcaggccatctggatgtatacgtgcaagtcacaggggatgcgatggcttggcttgggctcagaggcctgacacaaagcaagtagaatgaggaccaatttcaagctccttccacagccctcctatcttagccacagtgtcctgaaaaatacactctgagtccaaagcttttgctggggaatgcaatcctagagaatcaggagtgagggaaaatgggatggagacaggaaaacagggaaagtcattctaaaggggtgacatttcaaactagccacctctcctcataggcttcagagtggccttaggaagagattacactttataacagtgtgtctagaggatgaaaagaaaagaatttgtcctccaactctgtcattgatacgttaactccccatgctttcagatgaacatttgtgagcacagactacctcctaaaggcatcatgtctcaggggcaggactccagagatgtgaggcttaggcatgagccaaggtgctgtcagatggtggctaggccagctgaagcctgggggagcagtggcttcagagggactcctggtctgcagtggcagcagtcattgaagctaccaccagaaccctgtgttgcaaagcactgctgatgccactccagaaaggcaagcatgcggttctgcagggatctctgagtgcagcccatctcacctcctgcgggctctagccttcccatatttagcaaaagccttggcttttaagaagcttagggagccagccttaacttatgcatcaattccctgggaaggcattttctgaaccttcattctaggcccagtgccagggttatacactctcagagcatttatatgttcccgctccttgtctttcataatcgtgcgttcacttgtgtgaatatttgctaatgtccatccctggtctgacttcaagcaccaagcacggggccttttttttcttttcttttcttttgtttttgagatggagtcctgctctgtcgcccggagtgagactccactggcttcaatctccgccttccggattcaagtgattctcctgcctctgcctcccgagtagctgggattgtgggtgcccattgtcatgcccggctaatttttgtatttttaggagaggcaacgtttcaccatgttgaccaggctgcacggggtccatttttgtgctcaccgttattcctacagcctcacagaatcctggacacaaagaaagacttaacagggttcattcattcctgaaccaaagcggctgaacgatgtcaacaggaccagagaggctacaggaacgccatattttcttctacatctctttttttaaaaatcttatttcaatggagtcaaactcaataaggtgaattaaaggaaaaagagctgacccaaacaaacaagcaaacagaaaccttttctgtcctgtaatgtttaggcgcagataagaagtgcaaatagagagtttaaaaagctaataaagtgttttgtttgaaaaaaaatatgtgttgctacaacttggagaaaagactgtctgctgcaaatattaatataattcactgtccttttttccaaattctactcgaaataaaatattcagtttttttaaatgattgtcagtaataagaatgtaatgcttagtgtctgtgacattcttttgacatttttcatgtagttcctgctatagctagttagcccataggttttgtcccttgccttctaaaatatgtttttcccttttgtttttcacagttagaccagttttatttttgtcagacaaaaaaattcatctatgtttaacaaatgagttaattattcacatagtggagattctggtctcaattgctttgacacaataaacaaggcatgtctgccttccacaagtagtagagatgcaagtaaataaaagaagaatctgcacacctttttaaaaaataataataataatttaggctgggtgcagtggctcatgcctgtaatcctagcacttagggaggcttagtgggaggattgctttaggctagaagattgagacagtcttggcaatatagcaagaccctgtctctacaaaagaatatgaaaattagctggatgtggttgtacctgcctcttgtcccagctacttgggaggctgaagctggaggttctcttgagcctgagaggtcaaggctgcagcgagccacgattgtacctctgcaatccagcctgggcaacaggagaccacatctccaaaataataatagtaataatagtaataacaataataataataatttaaacagcaacaacaacagaaacttgggatgtttgtcagctcagagtctctttcagctaaaaaatctgaagtatgagtgtccccaaagcacgatcaatgataacaaaagggagatgagcatgaatcaatctttccattgatgatcaaagggctagaccctctccctggctctagataatccaacagctgacagtcaactcctagatctttctctgccttcctttttaaatttttctttgtgattttgatttctcatctgcatcttccgattaacttctcacctgtcaaccaaatagcttagcagctaatcctgatgagtggcttctgactctaaatttagttacatctcttccatgatacagaaagggttaccttccagcacagaattatctactaaaaagccatgacagcccacctgtccctgcttctttcagtgggacgtcactggctagccccaatctgataaatattattatgagaaataacaccacgaggacaaagtaaatagaaacatactggaagcatgtgtagagtacacaaagcagagtgtagtagggtgcagttaatcaagtagactaaaacacctgggaaatacttctttttctagtagctgaggcaaaaatggcaacatgtcagtttgtactaacagaaaatgcccatttagctgtgcagtaaattcattatttttttctataattacactcaaggaaaaattatttggccaaacccttatacaaaaacactgggtgttataatgtacaatattttgaatagtggttttataggtggtgcatacactgtgtgatacaatatataaaaaccaggctcaacaatatttttgtacaacattcaggaagaggtacctactttccataaaggcagaagactggaattgagaaatttctatgaaagtatttctgtaagggagataaaaagtatttgcgttagacatgggttcagagaactgctggttccagtattattctgcatggtccagttagaaaagttaaattctgaagccaaaccagcggcggtttaaatctgcttctgcatattaactaagatgtggccttggacaagtcgtttgaactccatggatctatatcttcatctatgagatgggtataataaaatatacctcacagagactgtctaggaaattaactaaaataatatatttctcgtgtccattttaaaaatacctgttacataacagatacaccatttgttaagaagaatgtataaacagtaggatattttagatctttgagaaattttagattttaatatattaaagtatttagatatgctaattagaatataaaatttagaaaatttaaaatggaaagaagacacaatgtgatcacaaaaatgggtggacatgataaagtcgtctttgtgatgttttgacctgttcatatcactttttacctgatgtaactcaggtaataaaaagaagaaagcagccgcctctcctcatcgtcttctctaaattgccacttgcattgggcaaatggctatttgtcagtccacctcattgcttttctttgcagcctctgagtcttttgttttaactcttgtggaagaaataaaaaacaaaaaggaccagtgacagtcttgtgaatccagagcacttgctgttcttaccgcaaaaaaagaaagggaggccgggcgtgctggctcacgcctgtaatcccagcactttgggaggccgaggcgggcggatcacgaggtcaggagatcgagaccatcctggctaacacggtgagaccccgtctctactaaaaaatacaaaaaattagccgggcgcggtggcgggcgcctgtagtcccagctactcgggaggctgaggcaggagaatggagtgaactcgggaagcggagcttgcagtgagccgagatcgcgccactgcactccagcctgggtgacagagcgagactccgtcccaaaaacaaaaacaacaaaaaagggaaaggtgagagcaggcactgagaatgacaggaaaataaggcaaggagtaagtgatcaaaagtcagggaggttagagaaaagcatgaatctggatgaaggacacagcacaaagtgacttctcccatctctgttctgtgcccagaaaatttaaattgaggcataaaggtatttatcatgggacccttttaaaggaccaattagcatttactatacaccaagattgcttactgtgaagaaatgttagcaggaatgaagaactataaaagctgatgaggaaaaggtcaaataatctaagcaggattactctggtatatgctcaacaactgcccatgatgatggaaagaaatagctttgattgcctttaaaaggaaaactgttaaaagattactaatcttttaaaccagttgtctttacaaatctctaggagtaggtcagttaaatgaaatctctaaatactccgaaagtaagttgacaaaaccaaaatctcttgaatggagacagagctataatgtattgtggcagcttcattgggaattaagactgagattatatcacaaagaagtaaagccatattgaaatttattcatacaccctgtcatctctctcagaaaccctagctcctgctctgaataatttgttcagatatgcttcttaagtatgacatttgaataaatctggtttttgatttgcattttgtttttctttgccaaaaaaaaaaaaaaaaaaaaaaaggaaaagaaggaggggaggaaaaaaaaaagaaaggaagggaaggagaatgaaaaaaagaggagaacaaaaccaaaaccaaaaacacaaaaacaagctttggtcagtttgctttggctatatggttctcaggttaattaaggaattataaagaagcacctttggtttaacactcatcaaaactcttccttaaatatattcaggcatgtacagacaatgaagtctgatgtggaccaatcccaggacaattctcaaagttgtttagctttttaggttactgtgtaaacaatttttaactcttattttattttattttttgttttgttgtctttgcaatcccaaaattttctgttagtttccttatcatgtaatctaaaaagaagaatgggagaacctctttaagtgagcacagttttattagatttgaatccctgccaatttaccactgtagattgtagagtcatatgtggaggctatgtgtaatgtggcatgcggcatcctcagatgtcaaacttctctttaatttccaagtgacaattagccaacccaccgtttcccatgacttctctgactcctaaatatttttgagagtccccagtgattgctcatgtgctcttcaaattcaccttggttgctgctcttcatctcagctgggactcctgccctttttgcagtatcagaatagacttctccagtctgctttcataattctccaaaggctaggtaagacttaactgtaaggcttggagacaagcagaaggtttgcagataggtcaaagcaaattacacacagaaagctttatactgattattatgtgttaaagatgctagacctatgcatggggttcagcccctaatgccaggcaaccctgctggacttctctgcttcacccatagtatgacacttcgttgtatggattcactcagctgtcctcacagggtgctttagaccagatctcctgcaccccaaaaccatgggtgcatacaaacttactgtagggggctaagtaaagcggggcaggatgtagttctgcccagcccaggctcaggctttctctgggacatctcattgtgtcaggctgcacctcacctgaacagggatatggttttactttggtaaaccaaggggcacattgaagttttgtgatttattttctgcaaagtaaattgcaattcttctctatatacgaatgaacaacactgtcagctttaagctagcggtttatcctggcttctagtcaccaatattttaaaatgttttgggtaagttagagaacccagttacattttatataaaatatcagtcatcgtttacacatttctaatatttaactgttatagctattatatgttttctgtagccattaataaaaggtgaataagctgggcacggtggctcgcagttgtaatcccagcactttgggaggccaaggcaggcagaacacctgaggtcaggagttcaagactagcctggccagcatggtaaaaccccatctctactaaaaatacaaaaattagctgggcgtggtggctcacaactgtaatcccagctactcaggaggctgaggcatgagaatcgcttgaacccaggaagcagaactttcagatagctgagatggtgccactgcactccagcctgggtgacagagtgagactctgtctcaaaaaaaaaaaaaaaaagaaaagaaaaaaggtaataaataaatagaaaaaggtgaatgcagagcatgaaaagaggagagacaggaatgaatgaatgagacatccctggacatccctggacaagcactacaaacaatttctgacagagaatggcttagacttccatggacaattcaaccccaaatggcatattaacaagaaggagaagttatatattgaacactcaatgaggatttgctatattcagggacccacaagtaattgacatatgctttgcctttcattcttttaacagctctcttataaacccagtgttgtcattcccatttcacagaggaagaaactaaggcttagaggtagagtagcttgcccaagtctcattgtggtggagacaatattgcagcccatctgcttttccttcacccttccttctcactgcttcgcctctgccgagacacatacattctgctgcccaccagggaatcttgtgaagctccaattcaggcttaatatcccactaaagtatcagagcttcatgtagtggcagtcttttacaaactatatatatttataactcagtaaaatacataataaaattctcttgatcttatcctatgacaaatgctggggtaaaatagtcttccaacaattaaattcacccaagaaacacagaatcttatagaggaagcaaacatgcccattgataaagcaaaggaacaaacaaagttggaatcggggaagggaatctatatataaatatatgagatttctgctctaaaaatacacattcttttataatgaaggtcaaatatgtacacacatagttataatacaaaatagaaagaatcaagtaccatgagagatggagaaataatgtgccatagcagttcagaggaaacagaaagcatgcctcccaagaagcaacagtgttgagcagagagaaagttagtttgcacaggggaacagacctgggttcacatcccgagtccactgcgggcaacttactgacttgtagttctcagtttcctcatttccaaaatgcccagaaacagcataggatgtgacaaaagactgatgtgaaaacatgcagctggatcattttctacatccaataaatattctctctgctctcctgcttggaaaattaggattatttaataaaggagtcagtagttgacatgagcctgaagaataactacaatttaactaaacatgtggaactagcaataacagtagttaacacttatataggtcacatactgtgccaaaacttcatacttcatgctagaactgttctaagcaatatctaaacactatgtccatgtatatggcatgttacttagaataattctggcataaattattagcatacatgttaactaatatgcatgcatatatttatatgtctacacacacacgtgcacgcacatacacatacacactcaccatcctcttgagaaatgcactctggtccctattttaaagttgggcaaatgctagaacagaaaagctaagtgtgtgcctgaattctcacattcagtaagtgggagagcaatgactaaacttaggcaatgtgccccagagtccatcatcaacaccttgctacagtaccatgcaggaatagcaccaagaccctaaaacaagactgcatgtaatgtgtctggccaatgacattgagcagtctaattttttggagtttatagtacattcagggattgtgagaaataagactcaaagcagaacagggccagcttataagaccttgcaagtcaagctaaggaactccatatgcctgtctggcttgattcaaacattgtcaacaatgagatcagaccaagtatagaattaccaagctggatagtctgaaaatcactatttaaacttgggagtgaagcaaagtataaacagggcctgagtgttccttaacacagcaaggtacaaatacgtttatccagcgttaattccctgcattcgatatggggcatacagacctccctggtattggtgcagaggagctgctggaagcatgattaatatcagcagtggaagcactgttgcaaactattggagaaggctaatcaattcacagttctagggggtcccttttttctggatacgaaatgctttaataaatacgttgtaaagaactgaagtgaaatgcaggctacaacaagcattattttgcccccttttctcctttgtaaacaatttatcaaatcaaaaatagcttggtactttaaatacagtgtcagagtcttcttttcaatattataccttttctaatgaatagttggatctagatgctccagaaagccatgaaaataaagaaaaactcactgaatttcttagttgagtaaattcactggtaatgtgaactagggcttgagatagatctttctatatatgaattcaatacctctgctaacctgtcaacaacaacaataataatagcaataacgataacgataacaactgtttaataaacatttggtgttagaatacaggtcccccagtattttgctccaggactttttgtcttgaactatgacaatctgtgcagaaaaaggccagtcttagagtcaaatgcagacagggctactgaccaggagttaacactaagcatcactgcatcttcttgagtctcagtctcctgtcttagcacatcactatattgcaatgatgaaagctttcaggcatttctgtgtggaagaaaaaattaggtgacactcttgtggataggagaggccagagaatttctttgacactgaatttgcatagtgagcaagttttttttctatttagattgtgtgattacttggtgcaggttgacaattctagagcctttctgtcttagaaagttctagctgctataacaaatgtacaatagacttaaacaacagaaatttatttcccacagttctggaggttgggaagtccaagattaaggtgctggaagatccagtgtctggtaagagcacttttcctggtgcgcaggtggctgttttctcattgcctcctcatattagggaaagccaagatagggagggctagttctttttctattcttagaaaggcactaattccatcacagagcattcattctcatgaactaattacctctcaaaatccccacctcctaataatgtgacagtggcattagaatttcaatgtatgaatttgcaggagcgttcagtctatatcatcttctgcaaagtcatctttggaggtcactacaatgatgttatgttactctgaaatacaaataaatgtatgagtgtttaatatatatgattcttttcccacggtattgttatctccatttaatagatgaatagactaagattctgaaagatgatatgaatggcctaaggtgatacacgaaataatggttggaggtgactttcaagggaacattccttcaaagcccagtggtttcaccttgcacatgcagccagcgatccagtgacacttctcaaggggatctagggatagcacgtgaaatgaagaatgaaaaatcgcaactttgtagagccaccagcaaaacattgccatcagacttcacatttatctttagctcaaaggaaataatttcatgataactgatacctgagttaggcaaaatgtttacattttttgtgcttcataatagacaagcagaaatttcctttagtgctgtcctctcctttctttgcactgtgatttacacaaaattccactgagtttctgggaacaaccatatattctctaccttctgtatactatagtttgtgcaggtgccagggatgcaaaatgaatcagggcagtggccctcaaagtacttgttgcctagaagaggagaccaacctaaatacagacattccagctcctttgctgatttccttccatgacagcaaataccattaggatgaacaaggagagtgccaccagcttaaacacagaggttggggaaaaacagagctgagaatatgctttaaggaattagttccctgttgcctttgggggaacatctcgcagtttgatgtaacagaaggagaacacggaaaggagagaaaaagcaggagataatttggaaagcagagggctttatagggaatattaagaaatttttactttatttatttatttatttatttatttatttttgagatgaagttttgctctttttgcccggactggagtacaatggcctgatcttggctcaccacaacctctgcctcccaggttcaagcgattctcctgcctcagcctttggagtagctaggattacaggcatgtgccaccatgcctggctagttttgtattttttctccatgttggttaggctggtcttgaactcccgacctcgggtgatccatctgccttggcttcccaaaatgctgggattacgggcataagccactgcatctggccctactttatcttaaaggtaatgaactcgcttgtcagattgattagatgggagtaacactggaggccaaacaactgtctggaggctattgcagtgatccaggaaggacacgatgaagatgatggtgatgatggagggaggtgggctgtataccaggtatttccttgggtttgtgtttactcaaggccagatctcagagtttacagtaaatatccagtaattctgtctcaatttaccagacaacttggcaagagaaattaattcctttagcttgtaaagatttttcctcctttctctctttcttctttattccattattcttcttgtgttccttttaaaatttgcctcctcaactgctcattttccctaggaagggaaaaatttcattgcttgggctacttacaattcaacagaaaaagttgaaagtcacctaagaaaagaaaaggaacagaggagtgaagaagagaggaggagatcatgataaatgtgggttattatgtggttttgccaaaggctgtcagtgagcttacatcttctccatagagtgctagtttaagatcaaaatctcaataaaatgaatgattaaaaaagacacatgatgtctgccttcatattcctctttcctgcaagaatctgctatctcctcaaagattcccattcagggaggtgaaattatctttggcgaaaattgactataggacaggcaagttggggcttttctgctggtgtagacgttcatccctggaagtgatcctggaaagctctggggaggaaataaggatgagcgagcatcctagatttatttagtcatcatttgtttctcatgaaaccagcaccagccttagcttattctctggtcaattaaatgtaaaggatggcagaaactagagcccacagtctgtgagtagtttgtggggttaacaagctgactttctgcggtatggaatggcatcagggatgaaacacagacttcatatgctgcccattcactccttttgatacttccacctcaaataattttgaatagtctgggtaacatagggcttggtgaaccttgaacactgacactttattatttgcctctctgaagcactctagcctgacacttaagattcctaaatccactgtggtagtagaaggagctctaaactataacgtcataccagtttcctcttaaactaatgacatttcattgagaacattcctcaaaactcctatcctttgttttccatccaaagccatgaccaggaagatctcccattaagacattatattcagattcccgaggagcactattccctcaagatgcaccatgaaaacataacagggcttataatgaaaaaaaaaaaatagggaaaccaatgctacatttatttcttcattcaacaaggatttatgggccacctgttctgcttgagattttaggagaagactctgctctcatgaagcttagagtgtcatcgcagggagataggcaagtaaatgaatatatatgcatatatttagtttgtcaggtggtgataaatgtaggaaggaaaataatgcaagacagagagaaagagaaatcatgctgggaagacaaaaaagatttgtcaagatcacttactaaagctactgccatgcacataagaacataaaggcattatgaagactggcagccttttcatctttgtttctatttttctctttgccccaaggctttaccctgtatacctgagttagcctctccctagctctgggcctggcccttgctgcaatatcactccttaactccaggtgctctaatagaaggttgggctgccctgcctactcccatgctctagttccctacctcattggcaagaaagttgaaaaagatttctatttaatttttgaaaggataaaggcattgtttttttttttttttttttgttttttttctttagtggaatgtgaaaagtgtgattttgctaagagggtatttcagtcttttccaggcatgtgccatatgttggagctgccatacatgttggtgttatctctcagtgcagagacagaaatataaatatatgacactgttgtcaacagtcacttcattaccccctacactttttttttattactttttttttgagaccgagtctcgctctgttgcccaggctggagcgcagttgcatgatcttggctcactgcaacctccgcctcccgggttcaagcgattctcctgcctcagcctcctgagtagctgagattacagacacgtgccaccacgctaatttttgtatttttagtagaaacggggtttcactatgttggccaggctgtctcacactcctgacttcatgtgatccacctgtctcgtcctgccaaattgctgggattacaggtgtgagccatcgtgcccagccaattatctcttacacttaacacagcagaagtcacgcaaaatccagaatttcagaacaaacacagcagtagcaacagaggagtctggtgtcatatacatgccgtcaattacttaacaaacatttatctttacatgcacaacgccttcaagaacaatttctcttctgaatcatacaaaccagtgggcaacaaaggcatgtttctctttgtttctgggttgatgtacataatatcagttgtcatattttatcttctagtactaagtggctcagacacttatcattatcatagggatgctgatagactacttatatacaaaagttcatagtgttctaggaagaattttgagaactttattcagaaacttcattctaaattagtgtttggttgttaaagccataaataggcagaggcccaatggtgatttaggttcttccacatgtaccttaaaataactttatcaatgccctttcttggtgcttgtaactcttgactttcaataaattctatttgtacttacgttattgatggaggagatttaatgcaaataattcacaggcaaggacatttgttcatcaaagtagaagaaggatgagaaaatggaatatagaagtaataactttcatggggcagtgagggtagcgatgcagtagctccatggtcatggggcactgcccctacgggaagctgggcttttctgcctggggccaggtgctggtcactctgacaacactggagtctccagtgggagagtcacttaatggaagacattaccccctgcaaccttcacgggtttactgagtaacttctgctgacaagttctattatatcccctcactaagaataaaaagggatataactgatggtttaggaaggggttccaggagtgtattaggagactctatattgataagatttgcatcagaaataactttcacaggggtaaaagaataacaaagtggtccatgttaggatcccttcatatttcattttctgaagtggccacatcaagcttcaggagaatgaatgacagtgaaggccaggacaaggagactaggaggaaaatgtcaagttgaccactggtggcacgggagcacatgtgtcacagaagatgtgccaaggctgggctgggaatgaggaagcactaatacccactgaagggaatttttactgccagagacagaggcataaacaaatacaccttcagtgtcccaggtacacaactccaacagagtaagagcacagagtcgatagcgactccctgagagaagggagagaacatgagcacgtgattgtcactagcacagctctgagagcctatacccacacaactggtggtgagatcagactggaatgccagcttttctctagtgttggctgaaatccttgtgttgtttctctaatctggaggtcataaccaggcaaagcaagcagggtggcaagtggtgccaatcagtcattcccctcttgccaactgttaagatacaacaggattcttagacagcaatcaaattctgagtggtcttttaagctaatcaaataactgtcgctattaaacgacaagtagatacacacatatgcacttatgatataatagaccctgtgctccaaataaggaagagtgggggaaaaggagagttctattgtttaactctcatttttgtctcctcaaatctatcatttcagagttcctcttagctaccagtagtggccagtgcctaaaacctatttctctcattttcttttctataaacgcctgtctgaaatccatttttgcgctgctctgaatagcagtttggaactttgaaggctgaatgggtttgtcaattttagctttaagtctgtggtttgcatgttaattaccctttgccttattaaatgtatcttcttaaattagaaaagaaaaccaatcatttctaattacctctgtgctgctagttcctccttaactttagtttgtactcttctggggggacatccctttgaaagtcattcagaaaatgtaagtgtcattgacacattccttatatgtagctcgaggtattagcaggtcgttgcttcagcatacactgtcatacaaagatatttttacaagtattttctattggaacccgcctttcttttttttctctctgtctttctttctcttgaagagtattgcatgtattgaagaacctacaaaatgaagtgtcatctgcatatgtattagatgtaagattcacatcttccctggagacttcattttctctattttcttgatgagtaaacagattaagaaaagttttttttatgtttctttgttcattcattcacccagttattcagcaagtctttaataacagtatgtgcagcattaagatgctgtttgtaaattgactgattttgaaaaaagtacacatatttggcttgggttactgaaatccatttcaatatacctttaagaaatactgtgctccatgcactgttctagacaatgcagtttaaaacgagatacaatccagattcaaagaggaattacagtccgggtgccttgctggggatgacagggcaaatcgtattagtccggtctcatgctgctaataaagacatacccgagactgggtaatttataaaagaaggaggtttaattgactcacagttccacatggctagggaggcctcacaattatggaagaaggctaagaaggaccaaacgcacgtcttacatggcagcaggtaagaaagcatgtgcaggggaactgccctttctaaaactatcaggtctcgtgagacttattcactagcacgagaatagcatggaaaaaaacccacccccgtgattcaatcacctcccactgggtccctctcatgacaggtgggggttatgggagcaacatttcaagatgagattttggtggggacacagccaaaccgtatccgcagggatgttaggattagcacccaaagttcatctcttttctttcccactgcttctcttaacatggacccttaggcaaggtggtgtgtttggcagagcaccagacttgcaacagagtctccctgaaaattcccgacatcccctgtcaaggtcactgatgcagaattttgttgttgtacctgtcatttcttgcacagactgtagttaggcaaattaataacatctgcctggtggcaccgggatacttgtaatctcactgccagtcaaagtcaacagtgtaggtcggctggctacagtgaattcacagaatccaaatgagtggctctggtggcagccagctcagacctgtccactctccactgatcagtcccagcaccaatcttgccttagcctcacagtgtctccccataccatgacctgcttaacaaagtcaaggaagagcatcagcacctttgtgtgaccacaggttcttccattcattaaccaaacagtgttgaacacttaggaatgactgagtggcagaagggcagggggtgaatgctgactgatactcttttctttcacttctggcatattcttctgtgtgtcaatcccgagtaagctctccctgtgatctcctttctatgtgcttattttcttttctaatattcaggccaaatatggtggagagttcttggaagaagatgggagattgagattctctttgaagagcaaatttcactctctctgtgaccattacaagaaacttaacttctctaagcctcaagttctttaactccagggaaggaaagacaaactcctaaactgtgtttccgtgtaaggataagatcagtgaacagctttgttaagaatcatatgaatgatatttgagagtaacaaatataataacatttatctcattataactttaaaaggtctatggataaattcagtatattagtacttaaggttgtgggggtggcgggtgggggcggctggggaaaagagaaaaatcaaatttctgagaactagtgcatataatatcattcagaattgtaaatggaaaggacctgcactgattttgcagtgtgttcttgccattaatctctctgagccccagggttttcctcatgaggcggcgagactacattaatgagccacatgtttgtaagatgtactgcaaattcagaaggattaaatacatgtggaggggcgggaacagggtgtctcttttagtgaggaagtgggctgaaaccttctttgatgataagtgggacaaagtgaactaatacatgcaaagagcctagcaagtgcctggcatggaggagacccttgaaaacggtagctatgatgcagccactgcaattacttggttgcagaaaccggactccacttatatatgcaggtgattatgggagtgaagtaaaagggtcactagactctcatcagaatctctataatctagtctcaacttctgataattttttttacttacgacctcggatcacttaacctctccaaaattaagttttctcacctttaaaatgaagataaaacagcctacctacttcacaagaatactgtgatcaaatgaattgatgaatgttctttgtagttattcgtggcctcacactgtcaagaaaagtactgatctggtttccatcctcagagcttaggtctgcctagtttagaattttatatgcatggaatcgtgctgtttgcactctttatggctggcttattttgctcaactagtgtgttgttgcagggatcagcactttgttactttttattgttgagtaatattccaatctactaatattctgtattaaatttcctgtcttgctaggctctagaagtggaaaattagatttttaattttatgttgttcttcttatgtacaaagcactgaagccacaagtttttctctaaggtctgctttaactgtgtcccacaagctttgatacagtgtttttatcaccatgcaattcaaactaatttctaatttccgtttagatttcttctttgacctacgggttacataaaactgtgttgattaacttccaaatatttgaggtttttctagataatttattattgattcctaatttaattcaattgtggttaaaaaacaaactgtacggttttaactaagacctatcttattgtgcaggatatggtctcagtgaaggtactgtgtggactttaaactaatgtataatctgtagttgttgaatggagtgttacatgaatgtaaattaggtcaattttactgataatgttatttgaatctttcatatcctttctgattttttgtcctcttgtataattccattttctgtactttccatcctttttggttttgttcgcatatattttccttctacatgccttgcaaacattacaagatattattttttgaaaaactatgaactgacttttaaaatgtttaagaaagaaaaatagtcttttatatttaaccatgcagttttcatttgatttttaaattgatgggtaatacttgtacatagttatggtgtgcatgtgatattttgatacatacacagaatgtgcaaagatcaagtcagggtatttgggatatccatcagctcaagcatttatcatttatttgtattgggaataattcaaatcacctttcctagctattttaaaatatataatacatgttgttgttaactatagtcactctactgtgctattaaacattagaacatatttcttctatctaactacatgtttgtacccattaaccaatcttttttcatcccaacctcacatatacctttcctggcttctggtaactatcattctactctacctccatgagatcaacttacttttagctctcacatatgagtgcagacatgtgaagcttgtctttctgtagctggcttattttacttaatataataacctccagttccgtccatgttgttgcgaatgacatgatttcatccttttttatggctgaataatacatatactacatttcctctaactattcatctattgatggacacgcattgtttctatatctttgctgttgtaagtagtgctgtgataaacatgggggtgcaggtatccttttgatatactaatttcctttccttttgatacattttcactagagggattgagagctcatcattccttcctatacaccacaaattttacctggcatcaatttcttctacttttgtattagcatttcttagcagctttatagctaataaattatttattttgttcatggaactgtttcttttccttcatatttgaaagctatttttttgagggtgggttgtagaggtcaggggaaagcttcctctcttctttctaaaggttcactgaaaactaacaaatgtaacaaattaacaatggcaggatactagaaagaaaaggcatatcagtgtatttaacatggataagcccaggggagttgctagagactcaataactcaatgaggttcaggtacttcaatacccttcttcacaggggaaagggagatggcagaaatgtggtaattttgaagagcagtaaactattttcagggaaaatggatgtacccagtactcagactatttttaataaataattctttttaggcattgtataggattagagataaagatcatctgggttctaggtgtggtgtttaatttttagttttttcctctctgtaatatgagttgcaatcttccctacttaattacatttcagggaggggattgaagacaattgtgtttctctttggtgggttcagtttccaagtagataaaagaacttcgggaggaggagccaagatggccgaataggaacagctccggtctacagctcccagcgtgagcgacgcagaagatgggtgatttctgcatttccatctgaggtactgggttcatctcactagggagtgccagacagtgggcgcaggtcagtgggtgcgcgcaccgtacgccagccgaagcagggcgaggcattgcctcacttgggaagcgcaaggggtcagggagttccctttccgagtcaaagaaaggggtgacggaaggcacctggaaaatcgggtcactcccacccgaatactgcgcttttccgacgggcttaaaaaacggcacaccacgagattatatctcgcacctggctcggagggtcctacgcccacggagtctcgctgattgctagcacagcagtctgagatcaaactgcaaggccgcagcgaggctgggggaggggcgcccgccattgcccaggcttgcttaggtaaacaaagcagccgggaagctcggactgggtggagcccaccacagctcaaggaggcctgcctgcctctgtaggctccacctctgggggcagggcacagacaaacaaaaagacagcagtaacctctgcagacttaaatgtctctgtctgacagctttgaagagagcagtggttctcccagcacgcagctggagatctgagaacgggcagactgcctcctcaagtgggtccctgacccctgacccccgagcagcctaactgggaggcaccccccagcaggggggcacactgacacctcacaaggcagggtattccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagaacagaaaatctggaaactctaaaatgcagagctcctctcctcctccaaaggaatgcagttcctcaccagcaacggaacaaagctggatggagaatgactttgacgagctgagagaaggaggcttcagacgatcaaattactctgagctatgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaagcgagaagggaagtttagagaaaaaagaataaaaagaaatgagcaaagcctccaagaaatatgggactatgtgaaaagaccaaatctacgtctgattggtgtacctgaaagtgatggggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagcggatctctcggaagaaaccctacaagccagaagagagtgggggccaatattcaacattcttaaagaaaagaattttcaacccagaatttcatatccagccaaactaagcttcataagtgaaggagaaataaaatcctttacagacaagcaaatgctgagagattttgtcaccaccaggcctgccctaaaagagctcctgaaggaagcgctaaacatggaaaggaacaaccggtaccagccgctgcaaaatcaagccaaaatgtaaagaccatcaagactaggcagaaactgcatcaactaacgagcaaactcaccagctaacataataatgacaggatcaaattcacacataacaatattaactttaaatgtaaatggactaaatgctccaattaaaagacacagactggcaaattggataaagagtcaagagctgtattcagtgtgctgtattcagggaacccatctcacgtgcagagacacacataggctcaaaataaaaggatggaggaagatctaccaagcaaatggaaaacaaaaaaaggcaggggttgccatcctagtctctgataaaatactttaaaccaacaaagatcaaaagagacaaaggaggccattacataatggtaaagggatcaattcaacaagaagagctaactatcctaaatatatatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaagaattgaactcagctctgcaccaagcggacctaatagacatgtacagaactctccaccccaaatcaacagaatatacatttttttcagcaccacaccacacctattccaaaattgaccacatacttggaagtaaagctctcctcagcaaatgtaaaagaacagagattataacaaactatctctcagaccacagtgcaatcaaactagaactcaggattaagaatctcactcaaaaccgctcaactacatggaaactgaacaacctgctcctgaatgactactggatacataacgaaatgaaggcagaaataaagctgttctttgaaaccagcgagaacaaagacacaacataccagaatctctgggacgcattcagagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaactcttcaaaaaattaatgaatccaggagctggttttttgaaaggatcaacaaaattgatagaccgctagcaggactaataaagaaaaaaagagagaagaatcaaatagatgcaataaaaaaagataaaggggatatcactgccgatcccacagaaatacaaactaccatcagagaatactacaaacacctctatgcaaataaactagaaaatctagaagaaatggataaattcctggacacatacactctcccaagtctaaaccaggaagaagttgaatctgaatagaccaataacaggagctgaaattgtggcaataatcaatagtttaccaaccaaaaagagtccaggaccagatggattcacagccaaattctatcagaggtacaaggaggaactggtaccattccttctgaaactattccaatcaatagaaaaagagggtatcctccctaactcattttatgaggccagcatcattctgataccaaagccaggcagagacacaaccaaaaaagagaattttagaccaatatccttgatgagcattgattcaaaaatcctcaataaaatactgggaaaatgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaacaggcacaagacagggatgccctctctcaccactcctattcaacatagtgttggaagttctggccagggcaattaggcaggagaaggaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcctcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatgtcatgaaaatggccatactgcccaaggtaatttacagattcaatgccatccccataaagctacctatgactttcttcgcagaattggaaaaaactactttaaagttcatatggaaccaaaaaagagcccgcattgccaaggcaatcctaagccaaaagaacaaagctggaggcatcacactacctgacttcaaactatactacaaggctacagtaaccaaaatagcatggtactggtaccaaaacagagatatagatcaatggaacagagcagagccctcagaaataacgctgcatatctacaactatctgatctttgacaaacctgagaaaaacaagcaatggggaaaggattccctatttaataaacggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcatgggcaaggacttcatgtccaaaacaccaaaagcaatggcaacaaaagccaaaattgacaaatgggatctaattaaactaaagagcttctgcacagcaaaagaaactactatcagagtgaacagacaacctaaaaaatgggagaaaattttcgcaacctactcatctgacaaagggctaatatccagaatctacaatgaactcaaacaaatttacaaggaaaaaacaaacaaccccatcaaaaagtgggcaaaggacatgaacagacacttctcaaaagaagacatttatgcagccaaaaaacacatgaaaaaatgctcatcatcactggccatcagagaaatgcaaatcaaaaccacaatgagataccatctcacaccagttagaatggcgttcattaaaaagtcaggaaacaacaggtgctggagaggatgtggagaaatagcaacacttttacactgttggtgggactgtaaaccagttcaaccattgtggaagtcattgtggcgattcctcagggatctagaactagaaatatcatttgacgcagccatcccattactgggtatatacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaatactaggcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaatatcccactctggggactgtggtggggtggggggaggcgggagggatagaattgggagatatacctaatgctagatgacgagttagtgggtgcagtgcaccagcatggcacatgtatacatatgtaactaacctgcacaatgtgcacatgtaccctaaaacttaaagtataataaaataaataaataaataaattaaaaaaaaagaacttcggagaatagccttaacctgtgctttggaacagacaaagtattgagagatggagtgaggaggggaaggtaagagagatttgaggctatttctttagttgtatgtcaaagtgccatattttggggtaccatttcctgagttccagcattggatatagaatgctagattgatagtgttttactttcagtatttttggatttccttttttttttttttttctgatgagtagtttgttgtcattcttgttgttcacatgttacattcaacaactgagatggctttgaataggttggtggctttaatacatctaacaggaagatcttttcttgctattcatccggcacataacttccggcattgataagtgattgattgactttgatccactggtgaacttggggaggggctgattgtagctttgtttagattcaatctgcctctactgttaatgctttctaggtgaccttaagctgctagcaccaggaagtccctgggaccatgcattgaaaacttccagatctcagaactgtgagaccttggatctgcttgaccatgagcctctaagactatgaaactgcaaatgatatggctctgggatagtaggactttgagactgtgagattgcaatactaaggctgcctcttctcagaatgagagtccaagattccttctcattggagcacaccatacattagtcacgggattaactcctataaagcattgccaggtcatgaaacaaatctttaatctggagcatgcgatcaaattttaaacattgttttaagatgtgtgtatgtgtgtgtgcgtgtgtgtgtgtgtgtgtgatattcaatctacaaattatgccaaactcagaaggggcagccagtcatttgaaggtggataagtttctactgcacatttggattagataaataatgctacagacctacggactcacatgcctggggaggtgggatatggtgcacacaatcagtagggaattgagagtgctgaagagaaggttccacagttaggctgtagaaaaacatgacacacttttactctacccaaaacagtaagaaaccaccagaacccatctcccttccttccctcatacatatcaaagtggtatggacgcaaggacattttaaaagaactaaactccacagggaggcgtcctttccaggtgagcagggaaggaggacagcttcatacctgtgccagatgctagtgctgggagcaggggatgtggaagagcatttctgtcaaataaagccattctccatctggataaagagaaaatgttcaaagtttgacaaacctgggagctgaaatgttgaatttgaacctcaagaaattcctcaccactaagtcattcttttatatgagagttttgctgcagaaggggctgcaaaatagaaagtgagccaattccttctttataagccactttgtgatacatgatagtaattacatcaatcgcctaatttcagagctattagctagcgggtgttttgtgcgtagtagaaatgtcaaagattatgcaagataacctaaatccacaggtgctattaaaatataatcaaggttaaggttaaggtctttgaaaatggatttcattaaatagacaaaattatcttacttggttttcactttggtcatctgcgaaagcaatggatcttcttttcattggttgacattgattgcacaccagcaagtaggttttatctatgaatattagaaggtgaaaagaagaacgttgatgattcataatgaagcaagcaaatcggtatgctagctgacatcccatcttaaagatgaggtatgattgggatgatgaaaacgttctggggaaggatggtggtgatggttatacgacaacgtgaatatgcttaatgccctgaattatttactttaaattggttataatgatacattttttgctacgtatatttactccaattaaaaaaatatattaggtgtgagcctttggatttcatcttcagcaaaaaaaaccccccaataattttcagggaaaatgaatgagcccaatgctcagagtatttttaataattcttttttggcattgaataggattagagataaagatcatctggattctaggtgtggtgtttaatttttagtttttttttctctctaatatgagttgtaatcttccctaattaattacatttcagggaggggattgaagacaattgtttctctttggtgggttcagtttccaagtagataaaagaacttcagagaatagccttaacctgtgctttggaacaaagtattgagagttggagtgaggaggggaaggtaagagagaattgaggctacttctttagttgtatgtcaaagtgtcatgttttggggtatcattttctgagttccagcgttggatatagaatgctgggttgatagcattttactttcagcattttggatttcctcttttttttttttctgatgagtagttcgttgtcattcttattgttcacatgtcattcatgttgttcacatccaaataaaggctatgaagtacaatattagtagaccacatagcttttgtgctgtgtattcttttgcttaaacttcacaaggaaatatgtaaaagaacaagatataaatctgagttgcattgtctccctcctgtaacaacaatgaaattgttgaagagtagaaagctgtagaaatttcagactaattactagccaattgggtgatttggagatttttttccttccctttttctctttctaggcttctttttttaaaaaatctgtaaaatggtgataatgataatggaaagtgcttagcatagtgactggcctcaattaatggtaacaattacttcaataaaatcctttccttctaaaagcagattgtcagttatcttccattcctcagtgagtatggacattaggaacatgggaatttcattgtattgttacctttgtaaagcttttaggtgtcatgcctcaggacttgctagaattgctttattcataaaatgtttaagagggatttctttttttttttttttttttttgacagagtctccctctgtcgcccaggctggagtgcagtggtatgatcttggctcactgcaacctccgcctcctgggttcaagtgattatcctgcctcagtctctcgggtagctgggattacaggcacacaccaccatgcccagctaatttttttgtatttttagtagagacagtgtttcaccatgctagccagtctggtctcagactcctgacctcatgacccgcttgcctcagcctcccaaagtgctgggattacaggagtgagccacttcacacagcctaaaagggatttcttaaagaataatgtgaagtatttctgaaaacaaacaaacatgatgcaggattttcacccaagtcatatttcaattgaaatacgtgagaaattaggtatgttctcagtacgagttcgtggagtaacaaatatggttttccactgaaattccatgatagcacagacctcactgcctctcctttcttctctgcagacctttgcaggaaacatgaatgctgacagcgtggtgcaccacaagctattgcactcagtgagagcccgatttgttcgctttgtgcccctggaatggaatcccagtgggaagattggcatgagagtcgaggtctacggatgttcctatagtaagtactcacatgtaccctttaccattgctgagtgtgagtggcaccgcctacgtaacatcagtttatctacattgagattgacaatcatcttattttaaagttgtttctagactttcatatgcatatttaaaaatgttcaattcaatcccaaagtagaaaaaacattctacttaggactgtaggaatgtagttgtgatggtgtgataaaggctcaatgaaacattcaaaattaataactcttggggaatcaagtaaccatttgtcctttgcagttaaacaaaattgagtttaattcttccccggaagtggcattaggtattataaagtcttctctgccctgctttcccagagctatgagagaaaagcattcaccttcttgacttgttctagaagacgaggagaaagaacaactaaatgtaattcacaaaatgctttctccttgaaatgatctccttcattcattcatctgtgaattgtttgtattaaatttgaaattagagttctatcttgcacataaagattataaagatgggtagaactagtgatcactctagaataaggttaaaattattcagggaagattcccatccctataattctttcctgcgcgctttatactgaaacctgaaattgcatcataataaatagtttttctgccgtaagcagtgacatattctgcttatatgctaaaattcaatgacccctaatgcataaacacatttgatcactaacactttcatccaaactagttcagtagattcctgttttgggctgtaggaattcttaatgagtacatgtctgtactgttttccatagtgagatcaactgaatgcctgtatcagaatcaataggagtgttgcctagaaaatgcatttccctcaccccatcccatacatactggattataatttctgaaaatggaaatccaaaagcggaatgtttacaaattctccaagtaaactatggatatagagtgtctgctaaaaataaagccctgcacacagggaatttactggtaaaatgactgtatttatcttgaacaagcactttcagaaagaatatggtttagaacagatgcatcaacaaaccattaggcccaggaggaactgccttccactccaaactttgtatgataaagcacagaacacctacaagggtatatgtgtcctatcctgggatgtctggggcatcaagctcctcttgtcacctcctgtttgataacaatttgtcactgctaggttattttaaaatacagtatgggccgggcgcggtggctcacgcctgtaatcccagcactttgggaggccgaggcgggtggatcacgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgccgtccggcctgggcgacagagcgagactccttctcaaaaaaaaaaaaaaaaaaaaaaacagtatgaagcttttatgctacaattaaaagtttgttaatattattatgccagccatctattttgatctaagaatcttattactctttaacatgtccttatccttttgctttttctcagtctgttcagttgtacttatttttcatgccaattgttcacccacagtgtctacttgcacagaaagagtcacagcatcgagttaaatcacaggctgcagggttgaaagatgtctttgagcagcatgtttagcatcttctggtgatgaaccccttggagaatctgataaggaacactctatccagaaaaataataacgataacatgtatcttttctacagtatgagaaggttcagaggtctgctaaagcccagttctaagccaaggaaagaactcctgactttgtgataacagagtctacctttttccatgtaggctccaggtctagtgcatcttccaatgggataaactgccttcaggtcaacctcaccaataatgggaagttaacaaccttggggagttgtcggacacagaatgtctttatgatgtgcctcaagcaggaaccctataatcttcaatcactagtgctgatgctttggtacttttttttatttgggggaaataatttaaaaaacgaatacatttctcagtttgtatctaaaaccaatgggttagcatgccttctgaacctaattctccctttcagcattatcatgttttttatttgactggattggttttctttctttctttctttctttctttctttctttctttctttctttctttctttctttccttttctctctctctctttctttctttctttctttttttttttttttttttttgagatggagcctcgctctcttgcccaggctggagtgcatggcatgatctcagctcactgcaacctccgcctcctgagttcaagtgattctgctgcctcaccctcctaagtagctgggattacaggcgtgcaccaccatgtctggctaattttcgtatctttagtagagatggagtttcaccatgttggccaggctggtctcgaactcctgacctcgtgatacacccagctcggcctcccaaagtgctgggattacaggggtgagctactgtgcccaagtttgactcgattgtttctataaacctaaaatcttactgtaagcaccaccaaacaaaacagcaaaagctcatggccctctttagcaactacctctccttttcctcctctctcctgttcacagaatggcttctctctaaaacttctctttagttgctctccccacctgcttacctcccttcacactgcaactgattccaatcactattgagacatttgatgggcagtttaacatgtcaacttggcctttttatagtcccctgttacccaaccaaacactaatatagttactgctgtgatatgtttggtgtctacaatcatttgactttaagtaaaggagattatcctaagtaatctgaatggacctaattcagtcagttgaaatgcttcaagagcagaacagaaatttccctgagagagacgaaaattcacctgtggactacagtttcagatccttcctgagagtttccagcttccccttcttgatggcccgccctatgtacttcaggcacgtttaaccagacccacaattgtataagccaattccttgcaattagtctcttaatatatataagtatctactggttctgtttctctagggaaactctgactaatacagaatgttctagagaaactacttttctcaagatcaccagtgatttccaagaagcccaattcagtggacacttaatgtttcttaattcacttaagctctcagcagtacttgattcaaaaagctatgtccatatttttaaaacctcgtttttcctcctatctcacttgctaattggctatctcagtttgctaattggctatctcagttcttctactacttttccatctacactgcatgctttgctgaattgacagagttttgtaaacttaaacacatctacatgctggtcaccccacatctgtatctcatggcctgacctcagagatgatgtatgcagcagcctacttgatatttccacttaaagtatagtagatatattaaatagaatatagcaaaatggaactctagattagtggtgccctcagcaacctgctcttctctaacactcctccccatctcagtaaacagcagcactctccatccacttgtctatgcaaaactctgggaagcagcctttgttcttccttctctataacttcaagtcctgcgcaacttatctacagctcacagtaactctatcagttgcttcctccaacaggtatcttaaatccatgtacttctcccacttttgtgagtagaagcctctgtcagttcttacctggagttgttaagtagcctcctgtctggagttcctgcttccacactacactcaccccaaaaccatcttttacacggtcaccaaaatgttctttataaagaaggaatgaaagcatagcattccccttcttgattcatgtgaaataaaattgagatttcttactggcaagtaaaagtccttgttgaacaattgttcccagaatttacagggttgactccttctgccaatgtgattcttaattataatgtcacctcctcagagaagtccccccgactgttcctctaaagtcacctgccttccttcttgtacacccaccattagcccatgattatatgcccatggatatgtgatgtgctgtcatttactttgtggtgtcggccacaacccagaatctcactggctgggtttgcttacttctttcctgtttacctactctagtacctgcacaggaaaaagtaccatgagaccaggcaccttgtctactaacagccagcacttaattggcacaaaaagacagtcagtaagtatttgttgaatgggtacatagatatatcaatccagcctcattctctcagcataggcaacaaggttcatctggaattacttgattttcataatctgttgtagtttctaaggaattacttttgtttctatgggcttaataatttttccaaaagtttagttgagtatgttgctaaagattggtagaattcttacagctctatagtttcttcagacttaactctctacattttggaaatattaacatatttcttccactaatttattcattcagtagataccatttatttagcctttaagataccaggcatcttgcaacactctaggaacatcagaaaataagacctttttctagactttatcagtcttgtatttgtactttgaagcacttttcttgtgattacatgtcatcagttaactgcgtgattgtctaacatctgcttcccctgactcgacaagatagttttgcacagtgccctggattgtcaacattgccaaatgttggaatctgaaattctcttggagataacacatcctaatgaatcttctaatacccagatactttttttattcacaaaatcaaagttagcaacctacgattcctgagcatatgcagctccacgtacaaagtttagctgttgactgggccaagagcttctgggcttgcatgcttccaatcctctatcccttgcctgtgttctcagacctagttctacctgagaatcaccttgggacatatatgcttttaacatacctactctggctgcacttcaattagatcatgatctctgggtagggtctccagtgcttgtataagcattttgttgttgttggttctaggcaagcgtgatgaggaaccagaatttaaagctgttatctcaaacatcacttcattcttagtctgcactatcatttccgtgtctgtgattgctaatcctaaggattttaaatgaaatctgaaaacttgagaagtcagtataatgttaaatatatgggctctgaattcaaaccaacagacatagaaacttgacttcaccacctactagttgggtaatcttgggcaatcttgggtcctctgtggacaccagtttccttttctatgaaaagaaaggtaatactagtgttgcttcaaccaagtaattgtatgaaacagtgctttgcataatgtaagcacccaaaaagtgttagttacaagcatcgttaccttcgtcagatatttaggctgctcaccaaacttccctatatttttttttcccactcttactcaggaccacatctcatctgtatgtccaaggaaggtcagcttttttatataccaggtatccaaggatttcagcaccttcgtcaggccatctggagtctaggctacctgaagttctgtctgggggcttccatttgaatttctttaaatatgggaagctaattaactttatttatttatttattttttgtattttttagtagagacggggtttcaccgtggtctcgatctcctgacctcgtgatccgcccgcctcagcctgccaaagtgctgggattacaggcatgagccactgcgcccggctaattaacttttttttttttttttttttttttttttttgagacggagtctcgctctgtcgcccaggctggagtgcagtggcgcaatcgcggctcactgcaagctccgcctcccaggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggcccggctaattaactttaaaaaacattataaattctgataaagttaatgatctgtcaggcctcccagtctcattatgaattacaaacatcattttgtacttcaggtcgcctctgttccacacaagaccttgctcctatttggttaattactcgcaagtggtatcatccaaaattcatcactctcagagctgaagtcatattctccttcctcagataaatactcttgtaattccagcttcagctgccctctttgttgctgttctcatcatctgggatcatttgtcatacatggtagaggccacacagttgtaaatctcacctctgacatgctaaggcccatacagccctatcacagggaacttcagaaggcacagtttacagctctgtcagccctccaagtggggagggacaggatgacagcagtcagacctggggcattggcagtccaatgtgaactttgattcccactttgtaaatcatagcatttttaagagttggaaaaatctccaagatgccagattcattgcagtcccctcattagatttgagaataaatgaaatttcctacccttctttctcatagttcctataggaatgactgaaaaatctcttctatgaagagacaaatgtacacacatacatggaataacaacactaaaataaaagacactgtgatcttccatcttaaatcaatgacttctttataacttttctgactggttgaggatctgaaggctccttcaacagtcaacaaacattacccagtaggctccctctgctaggcttcagagatacaaaaataaataagacaatccttgccctttaggaactcacagattttcagaagctacaaaaggtagataaacaaatgctcataaatatggaggtttaggaaaccaagtctttggcaaggcttgcaaaggagaaaaaaaatacacagctaacactgtttcctgatgaattaatgccctgctgcccagtatgtgatttgactggcgatattgctattattcctgtgacccatatgctaatggcagtgattttaaaggaaacctgaaaagggaaaaatgaccaagtagttggatcaaccactttatgcaacagtacgtttccacaaaaatgccaaggccttgcctcctacaatttgttttgcatttactccctgttgaagtggtcactggagtgattgaccgtgactcccctctgcctcctagcactaagtggcttagtctgtgcccaggtagaatccttaacaaagactgttcaccttcccttaaacataaaaccatactaaatctttttattaaaaaaacaggtcaactaccgtaagggagaaaaataataactatcgtctctaattttgacattgctatttaaatgactctcattgtatgaacatccttttagtgggcaattgtgtcaacactgtggcttaagactactgatgacggtagaagtcaggaagcagcttgtcattgcaggatgctgctgccacaacacgggttgatcattcctttccttctgtgagtttgtggctaagatttctgaaacctcatccccatagtgaaaccttttgctaacctgtctataccttagtggagtgatcactatcttctcactgcccaccatgcacctcttacttaggtgaccatatgtcccagcttgctccttagagttctattccatttcattatttatagctccccttttcaatcccacaagtcctcattagggtaataagttgtagggatcaccataatgcttccctgtaccgcatcttacagtggcatagtgatgcatttgctatgtcgctgttagggtgttcgagttcctcggtggcatggctcacgtctttgttatctttgtatctcagagctcagtacagtgaccagaaggagtacagaatatgcttaatacctgccaatgaatttaggagtaatgaataaaatgatacctactatggaagttccctaaaatgagtacattatttttgtgtaatctttgtcattattcaacagtccagttgaactacaaattttaagtgcaccccgaaagacatctatgcatctgaaatatctaaaaacaaaacaaaacaaaaaaaaacctaagcattatgagaaggcgagtcttactgttagagctagaatgtatttctgctgaggttacgactggaattcagagttttgatttttttttgtactatgattgttttcatgttttcttcttgaaacgcatcctgttttttcatgtgctatcatgcataggaatgtcagaaattttgaaagaaaagctatgttaggagttgtcacagttagctttggaaactttcctcattttcatagttcatctgaggtaatcagagttactgataaggcctggcagtcacagaattggtggaggaatctgtgcaaatttgagctgctgtggaaaccctggtggtttgtggattgctagccaaagcccttgagtcttcagtgcaagagtatggtctgaataataatcatttttcttatataatgtatcatgacataagcttcaaaatgtaattgtattgaaaatcatgtttactgtgaacaactgaagagtccaagtgggactgattgtctcagggtgaatcgatagcttctcctgtcaatgttgagcttcggctttctggcccgtgaggaagctgactctttgtccctggcccactcaggagcccagctggcccacttggggattcaagcttggaatcttctattcagtgaagccctttttttagctggtttgttgacaagctaccaacatccatcaaatatgccagcatatgcctccagaactctgtctttctcagaaaacaagctgtggcagccaggtcagcaattatgggcccagtgggaagtcggccagtgctggcattctcagtactccaggatgggggagcgcatgctggctctgtcttgacccaaaaggagaggttgtgcactgtagagcctgccttcattctaaggactctggagcatgattggcctctccttcatattctagagaagactgccaatgtatcagcatcttaacaaaccacgaattgaattgaattaagtttgtaataatgggttcttaaaaatcgattttgaaaaaaggggaagaaattgttcactccaggaagtaaatatctaacagctgtgttctgggtcactggcatggcagataaaatagagaactctgaggaacagataacaggtattaatatgaaggaaaacattccacaacgaccacattagggttttactaccttggcaaggcacaataaaattgggtaacgggggtaggtagccaggattatgcaggctgaccatgcaagtaatctgatgcattttctaaaacacaaagagctctttctaaaaacccaaaccaatcatacattttccctactttaaatgatttagtagttatttctccattgatatcagggtcacattgaaacccatattattttattttgtttttttattattatttatttatttattttgagacagagtttccctctgtcacccaggctagagtgcagtgacacaatcttggctcactccaaactctgcctcccgggttcaagcaattctcctgcctcagcctcccgagtagctgggattacaggtgcccacaaggacgcccggctaatttttgtatttttagtagagacggggtttcacaatgctggtcaggctggtttcaaactcctgacctcaggtgatctgcctgcctcagcctcccaaagtgttgggattacaggtgtgagccaccgtgcccggccaaacccatattattttatttttaatttgactctccatcatgagacttcctactctagttccgacctgttgaatccccactgcccttggcaccctacacttgagcacagagctcctcaaacctcatcaagaagagcagctactgagaaggctccttaacacaccacttgctgggtcccacacccaggtttttattccttaggtctgcagtgaggtcttacattctgtatttctaacaagctccttggtgacctcaatgctgctggtccacagggtatggttcccttcagcaagtttgattcctgatagatcctagatgggaccctgcactttgtctctctcctccttgccttgagcttgcagctccttccttctggtgggactgcccttcccacttccactccctccttctattctcctattcccaccacacccccacctcaccagcctgactgcctcttatgtctcaggactctggagaaacattgaccctgcctggacaccctcctaaccctctgcccctccctggagagggttcagcgctccctcagcacacagtgctcacctccttccaatggatgtagaattgcgtgcttgctctctccagcttagtcctcgagagcagggacctctgtagagcttgaacacaagaatgcatgagtgaaggaaaaccacaaaaataaaaaaggatagagggtttgagctttgggaagatggtggggatagagagggcattgtacctctaccataacaaagcctcccacatgtgtacatggtttccctgctctcccagaaagggagcaagtgaaagagcaagtgaagaagagcagggaacccagggaaattcagagcaacatttaaggaaaagaaaacttcttatttaacatcatccttcccttctttaaatcagcaatcagcatttttttttttttgagctttggttttcctactttacaaatggggaaaaatatggacctttcagggctactaagaacattaccttaggtaatgtgtgtatattagttccttttccccctgggaaatggattcagagaaagaaatctccacaagtgtgttagagaagttgtgatagagaatatgggagatatattcagttttatgtttttggtacctttaaatctgaagtgatcacacatttcccatctgccataaagagcccatgtctaccctttttactcctttctacacactttctttttttccttttaaaagagaatctgccaagatgcttgtacaacacaaataaagattttgatttctataaccagaccccatgcagcaaattaagttccaaagagatatccagaaaaagtcgttatgatactacctcatgaggaaaaagcagcatataatagtttatctcttattaacagcaacctataaccatgtgggtctttattattatcattttaaatctgcttttccaagtgaagttgggagtgctgagtattcttcttgaaactcatcctgttttttttcatgtgctatcatgcataggaatatcagaaattttaaaagaaaagctatgttaggagttgtcacagttagctttggaagctgattctaagttaatgtacatgctaaatcctaaagaaagtgttgaaaaaaatcaagcaatagtataaaaagcattaactatattaaataaaatagtacattataaaatactcaatactagtgtctgggaaggagtaggaagtattcagttggggaaacctttaatccttctttgaaagttttgaaaacccttttctctctctgggaaatggctggagcctgttgtgtgcaatgtaattaatattgcagaagtgcagagtgtttggctgaaatctctgagaacagcaaagtgtagctcttatcaggtactggtggtggtcggaggaaagctcccgcaccccaccaggctagttctgtgcttactaaaggccgtgcatcctctctgcaccaataagcatgtgtgagtcacacagggatcacagctccagtggctgagcatggcctgcagaagaaactaactctcccagtgtggatggtaagctggctctgaatggtgaaatagatgatgcgcaggaactcaggggagacttgggcaacatcacacttgggcataggcacctcaatggatcacagctcatttcacaggtggttctggatggcatacccttccgagtccattgcgaggctctgaattaatgtggcaaacagcgtacatctggcccttgtcctcatgagatgcattgacgtgttggacaactggactataaaccactgagaaaacagatgagcatctaatccaattgcgaggtgcattatgaagggaatggcaaggtgcttagagggagactaacagggatggaggaccccttagaaaaagggccaggtgggaaccgacagatgagctgagcatcgtggtccaagtgggcagcgcatgggaaagagctcagtggactcagcgtgggtgggtcagacagggtaggtttgaatcctggccctggcacttgctcactatatacctctttgtctctttgtgccgtgtttgtcttatttgtaaagggggaataataatagtattttcctcaaaggttaattgatgtgtttaaatgagttcctgtgcaaaaaaacatctagagaattgcagggcttatgatgtgggctccacacacattatcctagccccacacatacatgcatatgcacatacactaaaatcacagcatgcctggagcagtgtgagggttgaagaaaggaacagaagatgaggtgggagaggtgaacagagcaggatcatgtggagtcctggagactgaaattaattatcagggcaaaggaagttcaatgaaatactttagcaatgctgaggtatgatgtttcttatgctttttaacgttaaaaactgtgtcaggtgaaggtggcaaaagtgaaatctgggaggcagttctgaaactattaatagaaaacggaaagcaggcaatgatgatgaggacatgagtgcacgcctactcagtgtgatgtgaaggctaccgaatcccaaacccagacagaattttttcacaccaagttcttgatagcatctttatgctgtgcttgaaaatcttcactactgagtactttctttctataaataaggaaatgtggggataaaatgttgttgaatgcctttgtattttcaggtctgagattgtgcaattttcacaatgactttgaaggtaggttcctataagccccatcatacagataggagaactggagctcaaagaaatcaagaaagttgcttcaaccaacacctgcccccaggtagtaaggagtaaaaccagaactgaaacccagctctgttagactcgttctactgattggcttagttttctctaggtctcatgacaacgtggagatgtgttttcttaagagataacctatgtccctttgccatcaacatttgtatcctcagttaagtcactagactagccagacattggagggaatggaatgcagatcatagtaacgatgatgaatggagagggaggtgagtgagtgagtggactggagaaaagaaaacatttggaattcagtacttgacccaagaactcaggcctgcatgaggggtccaggcagccaagtacactggagtatgacattataaaatgaagaggaatgggggaaatagcagcaacataatgaatatttatatttacataaatttctccataaccattgcttggacaaaaaagtgtcaaagatatatatatatatatatataaaatttctttatataaatattatatataatttctttatataaacattatatataatttctttatataaacattatatataatttctttatataaacattatatataatttctttatataaacattatatataatttctttatataaatataaataaattttaataaataaaatttaataaataaatattatatgtaatatttatttatataaatattaatccaaattctctcactgctttcttataatcagttgtaagtgtaattgaatacattgttatgcaccattttacaaggatggaaagtgaggcccttagttttgacataaacttaaccccagtcagacacctggtgagtagtagagctgctctatagagggctcctctccttagtttaatgtctttaccagggaaccaaaggcaaatttcctccatgtggttttagttcaccacacaagggaccccacctgccatgttcaggctctgtgctcagtgctggtgctggctgggagatgaagagtatagtggtggtatgagtgagtggacaggatgtatataatttgtggatggtgattctcacatggcatgtgatagcaaaaacagaggggtgtacccagtgctagggaaacccaaagttcagatgcaatatctgtctatgggggtgggacaaatgcatccatgaataatgatggaattgagttactgcttcaaagacaccatgtgtggtatgtctcagcttgcaagaaatgcctcactgggaactagagatctttctgtcccttctccatcatgctggcctcctgcagtactgagatgcaccaaacattctcacgcctctgttatccctcctggagacactgggtccctcctttccctggggtaactcctacatattgttaaaggccaatataccactcactttctctaagaaaccctgtctgaatctaccccctttgaactgagtcagttcagttagcattactgtgagtattaatgtctgcatttgccattagaaactctatgggacactatgtggtccttccactcactgctgggcactacaggggctacctaggacacaatttctactccacagtctggtacagtggcagagtagaagcaatcagaagagaatattaatattgtgtacattgtgatgtacgcactctgcacacactaatttcagctagaatgtgagaagccaaaacatgacagaaaaagaagcttggggctactttggcatccctgggcagtaaacaactgaatcaaaattgaaaaagcatcatttggggtaagaaggtagagtgccaaccaatagagtggccttgataggaactaaaagattcctgttatttcaattactactaatacctctcctatctattattgatttaacacaaataatgtgccatgcacaatgagttcacattgatgtgtcataactttgtaagtcttagcacatgtacttctcaaagcagttttctctaatggatataattatcttcatcctataaataatacaatcaccttagaccaaggtaacccaactaacaaactatgaccatcacagtttagaatccattatgttatctataccacagtcctcactattccatgagtggtggcagctgttggtctgtggccccactttggtctgggtggaatcctagttgagataacagtcataagtgcattgatgaggtagggaggggaggtgctgagaaaggtggacatttgtgaaagtctctttgtatatggacagtttatttttaaagtcaaggtttccatcagcaacattttggttaggacactttgttccgtataaataaattgtgaaattgggttttaaaactaattacagaaaagtattatttcattttccttttcatttcagatcctcagattcacaaagagtgtttctagatccttggaaaaaaaattatcattgtgtatgctcaggctgaggattttaattacatgctgaataatacaaaaattgagttttcttgggtactcaattttaaatagaaaatcccaccccctccacataatcaccacaatcccacccacagaacatggtatataatgaatcagtttcaatttgtaattaaacagtcttacatgtttttctacaataaaagctcattataaaagtttttgtaattaaaaaaatagaaaaaaaaacccgcaaaaataacctagaacaacacattccaaatagaatctctattagatttttggcataatttgtcagatatgtttacacatacctgttacataagtttatctaaatcatggttacttgaccttcaccttgttttgctttgacaataaggaattaaatgttttgtataaaaacactaaaatgataaatatcaccagcacagataaggcagtgatacatttgccctctttgttcaaataacaagtcttcttttgctgagtatttttttccactgaacccagtagaagcctcagaatccttctcaacacagacttctagggagacagtactatgtggagttggcatcataattatatctatttttcatctctaatgttgtgtctgagataaggagatcaagtggttctgactgtcaggaagacaaatcaagagagattattctaagccatctgacatagtaagccagacataggtacttgcggtattttcaccctgtcccctccagcaaaagctgacatatcactaatgagagtttttacttctaaactaatgatcagttcactttgactcagtgtgtggtgattgcttgtaaacgaataattcccttgagtctaattagggtggttctagtctacatgtttcctgttgagactagacctggcagatctcaagaacatttctgtgaactggacatgaaataagatgggaaacagtaacagcagtcatgagaatatgcactaatttttctttcccgctccttctttgttcccagaatcagatgttgctgactttgatggccgaagctcacttctgtacaggttcaatcagaagttgatgagtactctcaaagatgtgatctccctgaagttcaagagcatgcaaggagatggggtcctgttccatggagaaggtcagcgtggagaccacatcaccttggaactccagaaggggaggctcgccctacacctcaatttgggtaggctcagacttcctcttccaatgccaagggatggagagctcctttactccacagctcacagtgtctgacacttgcagtgtatctggtggaagtcactggagcacaatataagtgatattggtggggatagaaatgtttaaggcatgtatagcattctttgacaccatataatattgacatgtagggagagttgcaaactcattgttatgtatttattgacctaactacgtatttatccatttagttttcttagtaactcaaactctaaaaaaactttcacaagtttaagtatatacacatattataaggaggcttgctcagaatctatgctattaggtacatataagaaagttaagtttcagagggaaaatgacggggaaacattttggttgctccgggttattttgttggggaagaggggatcatatgtgtgaggtgaaaaatctaagtttctaggcattcccatgtctttttaagggaaactcttttctttaggtgccctcactgttccagagtaagccccagactcaccagattccattaaacttagtacagaatgccctcctgactccacacagttaggacatggccttccactgtgggctggcatccatcagggcctgttgcactccaggcaggtcgcgttcattgtcaccaacttcttatcccagagaaggaggagagaggcccagcctcctgtacatgatcaaaggcacttctgaaggaagggtaagctgagtacaaaaggcaggagcacagttcccaaggatgcaaacaaaaaaacactcttctatagaaaaaagaaagaaagaaagagataagctgaaaaaaaaagtaaatggccgtttttcataagaatgactccctgcctcccatctgatatttactaatattaaagggagaggaaaatagttatctttttgtcttcactataaaatagtaaagaaggaaagaaattgcaaaatgtaatttgtaaccctaagttgcatggaagactgacaaaaatccacagttaaatacattttagcaattagctggagagacataaggatgaatattagtgccccaaaactaaacaatataggtttttattttgaggcatttctgaggatcttcttggagccccatggtgactataggcagcggtagcagaaagaatctctagatttcaaagtttaactcaaaattgacacctaatatattagatatacacaccaaaatacctttaaaagtagaatatcacctagaagagagtggtaaaaaaatttgctggtaacctcattggttgtaattaccataactaaagaagcaagcctcagagctttctgaatgttgggcgtccaaatactacacaaacatgcatcaatacatttactggttttcagttttccagaaaggagatcagatgaatgaagttgaacctcccagttacaagtggcttacatagcattgtgtgttgggggtacagttactattacttatcaatagtaaagcgagtgtcttctactgataacattgtgaaatatttcagttactactatttagattcccatttcagatatggcatttcacatccaaaactctgctccaacatacaaaatctaatgttgtaaaccagatacattcatggtgtgaatggtagaaatagcataggtgtggtcatgtaacaatttttcttttgattacagatgtgcaatcaaattgtgttttttattttatttattatgtgatttattatggtggatgtcttctgagcctcagtttctttatttctaatctggggctaatgacttgtcttgcagagtatggacatgaaaaccaagagcactgtaaatacattttctatagcaatgagtaaacatggacaaatgccaaaaaatagaagctccgtattgctcatttattcaaacagtatctgaatacctcacactgtgctatgctggcttttctgaaaataagtggaatattaagataaatagcacctactccttgctatgttacatagatggcaggataagtctttcttcccagtttccatcttctctatatttccaaccatggtggtgattaagtaaaaccttacttgatggaggattaagtagtaagaacatattttatctatattctgcatagttttaagatttcttcatcttttttatctgtctctgcagcttttccctttctatcagtttaccacagttgagtgttttctgtacttacctgttttaagcagtcacctaggatacttcttaaatagcataagtttctaggttcctcttctagagaaacactgccacagattagtactttagtccctcctacctcattacagctagaagatctctggaagcactaagcaaaggggagtggtaatagctttgctttgcccataatgggaaatctataatgtaggtttcataaacaccaggataacaccttgttcacttctgtatctctagcctccaggagaaactcttcctaaagtaggtacttgaggcagattgagtacattaggaacagggttttcatctcaaatttcattattcctgttgggcttgttcaccttcaagcctgcactcctgactcctccatgatccaccactctctctgacaatggggtatatttacagaatattcacagtgtggtaatgtccagtccgatcctcaaggaagacctatggcataagtatacattagcccccatttacagatatgaaatagtagactcaaagaggataaattacttgtcccatttatacagatagtgattagtgtagctactattaccatctccaggtgttttactattaattttagattataaaatatatatcagttttagaaaaccggaaaataatataaaaaaaagaaaaatccaactcttacaacctggttatctcttttattaacattttagtatcttttaagtatttatcttagttatttatatgaattctttaaatattattctaaaatactgttgttttcctgttgtcacacagccttaaaggggaaagggtttataacatccatgatcaggattgttcttttaaaaaaatgaatcagaaaagcaagagaaatacaggagaggtgagagagacagagagaaagagaggcaggattcaagttaatgggttaaagaatagtgctggtcaaataaaggagagagttttggtttttccctctccagtttatatggacatttcagcagtgtctcctttagtgacaattcttcatctgcaatgtttattcattttctaatcagttacttgcaattcagaaattcaggctaagagtgaagaagttcagcaccacggtcagctgctcaggatggcactggggacatacatagtgtactgttgttcttctctagtgatgctctttgatgagtatccaatttacattacatagttaccctaacccttactgtgtctggcttgggtagagacagttctatggcaaaattgaactatgtggttcctctttgcctactttcttaaagtagaacattgatatttttccagaactactagatgggaaagagatttcttctttcaatccataaggggttagatatgtttcctttctcactttttacacatctcattcaaattgcccatggcagtctgccctctgccgaattacaatagtctgaacccattcatgcaggtagagaatcaaagagcagagatattacgtgacaagagaactgttgtaagaataaagaagacaacaatagtacatgcaggtcaatcatccttataagagcccagtgccttttaactgaggcaggatgtttatgcaatccccaatacatacagctgtagcaaagtgagactcaagtgagactcctagaatagaacaaacatctgaggagcacctgggggccgagtacagggttcaggcgccaaagcatgtgattgcataatcaaccactgagatgccagagaaagttctttccattctccaaagagtcaaatgaacatttaatttagctcttttgaaactcaggcattttagtcagccaactcacacatatttatggaatgtttatcatgtttctcaaattgtactaaatactataaaagtttttttttagttgccattttttgagagcccacatttaggcattgcattaaacatttaaaatacatattttatttaaattacatgacaatcctacaatctgtatccaaacccatttacagatgaagaactgctggtcagtgattcccagtcagtggctcaaggtcacatagctgcaaagctgtagatatgggattataaccttattcaatcctaccccaattctctgacattaatcactaaaatgtaataaacttttataaaacaaataataaaaattataaaacaattcataaaaatgttaaatatcaggcaaacaatatgtatgtgttaagttctgagaatggagagatcaggaaggaacagagggatccaggatcaaccttgagtaatctggagattttattatggagaggggagaaaaacaggtatttcatacaaagaatcaatgggataaaatgcatcacatttttcataaattctgtcattatgcaataagaataggttaaacaagtacagtaaatcaggcactgaattctgcactgggggttaaaagttggatttatcagtctctattttcaagaggctgtcagcctggtaaaatagttatttctacttactttttagcttggttatattaattggaaataaaataactatgcatcatcaaaatcatataacaaatgtattaagataatgttttcgaagatagcaaagtcacagaagacggacacaagttagacaccagagtagagcaacaactcctaaatctggagagtgtttttagtcaatacaatctagaaatttcttaacagctaaggacatgtgtttcattgctttagagaaacatagagacttgctctggattgagagtcaagtccattgaatcacattgcttcctgtccgtttcttattttcttcagggctctcacttggatacttaggagaccattcaatagctttgcgtattgcccaacaaagttgaaagggggtacctttacaatactggctgggacagggaggtaaaacttttcttcttattctgtgtcatgtcctcccttcttagtgttgccccattttacttttctacagctccctgttttccaatccattaaattcctttgcaaaagaatgccctccattcctactaagctacataacttacatgcatatatgggagatacagatagtaagagcgtaagaaatgagggagaatgagagtatccatttttccactaagagtagtgaagacagttttagctttggagtcaaatagagttgggttgtaacccctattctttgagtccttaggtaaatcttgtggcttcttggagactcacctttctgcagggttattatagtcagaaataattataacaacatatgtgaagtgtttaacttgtgtgagaagcttaagaaatacaagtgaatatcggtgttgatagcctgacaaattaaaggtgggtgggaaagttgattctgatgatctgatagaggcagtcatgagggaattcacgtgactagccacctattttatcaagagtaaatcaaacccttttcaagaatgactttttttttgtcaaatacaatcttaaacatgagagttcccatcccctttttctcaggctgtctgaaattcacagattatgaaagttaaagtggcatccatgtttgaacagttaagataagacctagaaagaagatttaatcaaacaaggcatttggttgaaaatactgcaacatgcatgccctttaccagaaaatgtgagttctaagtaaggatgaaagaattggcatgcttatccacagcatcttggggtggagggaggagaataaactggtaaattaaacactttttgcaaacatttcaagcttcctataaaaattgttatatttcttagggccttgggtagtatatatcttattttgttttaactatattttaaaccccatgaaaacaagtttttatttcattagaaataattatttcccttatctatttctgtcccaaaagttagtttctgtatagttttattgtttttgtccttcacaattgcccatgaaaatttttatctttgtcttacgaaattagaaacaagttaaaactagtaattgaacctcaaatgccactgagataaaacttaaaatagatattctaagatcaagagtttgataatttcgtgagaattaagtgttttgtgatctctaataatggaaatttctagggaaaatgaaacatttctgaggaccaccatcctacacttctcataaatacaattctaaacatccttttttaatgaagagcagaaattttgttttcccaattttttaaccaaatcaagtttcactaaacttgttttgatataagatatctgagtgttggtatagcataactaatggaaaaagagtgatgaaatttatccatatgtgctcctttttggttaattaataagtaacttgtaattcccaagagactcaataattacacgtcagtgatatatagtcttcaacaaatatactatgcagcgtgaggattgtgtttttaatgaagtttatttttctcattatccaaaatagttatgctcaccctaaaacacacagaaaagaaaaaaaaaatgattatgataaatgcattcttcagttttatccgcacatagtgcttatttgtgccttttccagaattgtttttagtctagattttgtatttttgtcttctgctcatgtatattttaaatcagtatagtctaattattgagtattctatttattaaatattacttttaattttatcaaaaagggcagtcactactgagtatacttttgaaataatgtaagtattttataaatatcattttgatggctatttaatataatacttcatctggtgagtctacataaatgaactcagatttttttttctccttccaaattattggacattatatccaatttttaaatcactagccacttaaacacttttccacaacaaaaagttgtgaacataagtttaagtcccttgatactaactgaaatgtttctccatagaattggtgggactcaattttgcattatctttgggcatatatatatatatatatatgtactaagtaaatgaacaatgtaaacaaggagcaatgctaatccacttttgaggaaaggtcaacaaattgctttaagtattcataaaaatttcatgagctactttgcataaaatgataagtgtgttaattaagtttatggtttcattagatggagtaagtgaaaggtagtcactatttaagaagaagtacttttattttcctaaagtcttaaaattataaggagaagaattgttggatgcaatgagagtggcaaactttctgagccaaagttaagacccaggagagaaagggctgactttagaccttgaggagggtaaaggtaaagttactgatgctagctctgcttcccgcagtggagatgttcctgcccattgagatggtggtgatgatggtggcagtggatgcaagaagggtacagtgaacaacaaccgacataacctactactagaagctttaggatttgaaggtcccaatcatgtacttagagaaccttgatccagtcaacataacaaataccaccctatccaatttactagcgttctcctgccattttaaagttatacaatctatttcactaaataaggccactcaaggattttaaaatagtggaatttagacaattggtagccatctcaaaacataaaggtagaactgtgcctcataccatacatcagaataaatttcagttgaaagtacttagggaaaactagaagaattcttcaatgatctcagaataaggagaaccttttaaactattatacaaatccagaagctataaaaggaaaatgatagatttgttcccaatacacaaatacctgagtggtgaatttaaaaaaatcaatcaaacaaacaaaaacagaaaagcagcaacaaacacaaataaagaaaggcaaaaagatattttcaaaattcgtatcacaggcaaaatataggaagagagttcaaagaaaaggaaataaaaataaaaagattttcaaccttattcttattaaaagaaatgcatattaaaatttcagaaatgcacttttttaacctaccagacagccaaattttaaagctagaccgtatgttgttggcaagcctgtggtaaaggcactcctaggcatttaaatagtcatggtctttatataggacaatttggcagtatttgcaaaattgccaacatgaaagcctttgtcctccagttctttatctaagaatgaacgctacaaatacgcttgtgcccaagcgagataatatccacataataaagtatctcaacagttttaaagatctaaagtaaatagaaacatctaaatttatatcactaggaagctcattaaatgaaatgtgatatgccctatatatcatatatatgattatatattatttatatataattatgtatcatatgtatatacatcatatgttatatttatatatgtatatatattagagcatggaatactatgcagctataaaaaggatgggaaagctctttgtattctgataaagattttcaggatagatgaaataaaaatggaaagttggagataaatgcacattctattttaccatcagtgtaaaaaattaaatgagtagaaataaagaaaatctatctttgctgcttgcatacacctaatatttttctggaagcacaagcaagacattaatagcggtgattacctggggctatggaagatgagcagatggaggaagtgaggaagggaggcagggagggtgttttactatacccaaagttacataaaaaataaaatcagtttgactgattcataatatttataaaatttatcttttgaagcaggatagggtgattaaaatattttattttaatcattgttattattggctctattaaagaacttagtagttgattaaaggccacaaaaacagcacatagaacaaataagttggggaaagggtgtaattccttgccgtgtgtgtgtgtgtgtgtgtgtgtgtgtgtgtgtgtgtgatgtataatgactttaaattttcaaatgtttaatatttggacttattattaataaatttttgttcaatgcctttcttattttaagaaaaaagtgagatgcagctcaatttcaaagtgaaaactccaatattaaatctacctgccttgttacatctagaaatgacagtttataaagcatagtttccttcagccaatgttagctcctgagtcatttcattttatacataaaaactgtgtgtggggtggcggtggtggtgttctttgttctatctccgtcacctggaggccacctcctgccaacgcctcataattacttggataccattcttcctgtactcttcttgcctgaacccctttatgccccatctatccagattatggccggtcttatagccagtcttaccttctaatccaattcccacacagctgccaaaataacctttcttaaaagtaatctgctggccgggcgcagtggctcacacctgtaatcccagcactttgggaagtcggggcagcagatcacttgaggtcaggagttcaagaccagccgggtcaatgtggtgaaaacccgtttctaccaaaaatataaaaaattagcctcatgtggtggcctgcgcctgtaatcccagctattctagaggctgaggcaggagaatcgcttgaacccaggaggcaggggttgcagtgagcccagatcatgccactgtactcactccagcctgggtgacacaggtagactgcatctcaaaacaaacaaacaaacaaacaagcaaaaaaatacagtaatctgcattagtaacctctgcctactcaaagttccatttcttaaaaaaggtgtaaactgtgtgacctagcctacaaagtcctgcatagtgggatccaggccgacgagctcctggcactcagccgctggaagtcctgggccacgcttccctacatctctaaacctggctgctgcttctcctggccttgcaaccatgctcctccttccctcaggtttcagcctgtccctgctgcataaggagggtttcacagcaccgcactctgcatttccatggccctgtgcactgagtgctggaaacctgcatacattttatagatttatttgatgagcatctctacactaagaccacgaagaccttcagagaggacagtatacctttaaactctatgtctccttaatacattacttgtcactgtgaccagctcaggtggatcacacaaatatctttttttttttttttttttttagatgaagttttgctcttgtggcctggcccaggctggagtgcagtggcgcgatctcagctcactgcaacctccgcctcccaggttcaagcaattctcctgcctgagcctcccaagtagctgggattacaggcgcccatcaccttgcctggctaatttttttttttctgtatttttagtagagatggggtttcaccacactggccagcctggtctcaaactcctgacctcaggtgatccgcctgcctcggcctcccaaagtggtgggattacaggcgtgagccactgtacccggctcataatacctttctataggagaaagaaagggaggtaaggagaaaaaatgaaagtatcttttaattcattagcataatccatcaaacaatgaaaactcagaagttgtggaacaaaccaatgaaatcaagtcagctattaattcatcagctctacttttctaattataatgagtctgatgcttctaaccctatatgaagcaaccaagttactcagtgaaggaaataatgccttgggccataatggaggtgggagtgagcagccttcggggaagtggcagctaccgcctgctgaatgtcacacggttgaacaggctgctgcagctgtactggagaaaacacttcccaagagggaggagacagacatttagctttcagttactaaggaacctaatatataaaatgttacaaaaattgaaaatgtatatatacacaaacgttagttctatttaattgttcattttgctaaggttgacgcaagttcctcaggggaagatataagctgtaatctttttggtagaggggtatagccagggacttccataaaattgagagagaaggaggcggagggggaaccaggcaggttggattgcaaagcatgcctttccagctgcatctctcatgtcttctcaaaggggtcttccaaactcaacagaggctaaatcctcaacagtatgacccgagccatgatccatagctgtggtcaaagtaaaaaggatgaggcaaacctagattcaagttctgaccgtacctgaggcatgcatgtctcacctccctgagcctcagagttcttatttgtccaatggagatgataattttcccttagaggattaaagatgaaagttatttcttcctaagtgccgtgcatacagtaggtactcagccatgacatatgggatgattatttccttgccactgcttttgcccacaaacttactagctgtcttccctttacgtatcccagctttactcctcctcccaggcacggctcctaattggctttctccactcaagaaccattcaaactcaaagaatatgcattctttctaaaaacaaaatccccattttcaatcatatttatgtagccataaggacatagttcctttcattatttaatttttcaagtcttgaaaacatgccctattttgtctggaaggaggtatgcatattgaacttgattctggaatctgtgggccaagcctgttattccttcccaggtccagcacagttccaggcctgtagggagacatcattctttgcctttagaacagatatagctgcttttgcttgtggagcattctggtgtgcaaagctgcccttggacacagacatcatcttgcctctctcccctcttcacaggtgacagcaaagcgcggctcagcagcagcttgccctctgccaccctgggcagcctcctggatgaccagcactggcactcggtcctcattgagcgggtgggcaagcaggtgaacttcacggtggacaagcacacacagcacttccgcaccaagggcgagacggatgccttagacattgactatgaggtgagttgatcctccttcctgcacctcctcggccccttgcttcaatgaacgcagcaagaaaatcagtgagcagaccaactgagagaagtggtggggcactgaggagtcttaccctgggacttacttcctccatctatgccagatagtcaacaaggaaaggagtgcagccagagaatctgagcagtgaaggagtgatgggctaaaccacaagatagcagctctgtgcattttaaaatccagcaggtttccttctcatttttttttttcctgcgtgtagactttctgtgctgctgcctagtctattggttatgtatcttcttaaaaaaaagacctcagttatctgtggtgatgaaagatatttacattataaacaaaacccatggaatctaaaacctgcagtcgagactaccctttgactttcattcttccgatgcaagcttttgactaataccgtggcgagctgtttcttccctgctctcttgtagaagaggtacagtgaaatgaaccagttcaatgcaaagaaggctgcacaaagctctgcaaactggcagccaagagtttgccagctttgttagtagttcagttcaaggaatgcatgttgtgcccctgctgtacaccaggctctgctgggccataaatgtccagtctctgagttggagaaactgagataagctcttgcagaacaaggaggttaaagctacagtggatgaagcccctgtcactggaagtttagaatagagaaattttatatttatataattatgtatttatataggaaacagggcacttaattcaaccttgaaaaatggcagaagttttctagcaggagatgctgctaagccttgaaagaatagggttagaagactggggaggcaagacagagcatggttcaaaaaatgtcaaacagtccagtatttatggaattcaaaagaataggccatcagtggtgtgtttgagtcagcttgttaccagttcatgagtttcaagtgttagattttcagaaattttgtgagcccttggttaacctaggcattattaaaaattaagttggctgggcatggtggctcacacctgtaatctcagcactttgggaaactgagaccagcagatcacgaggtcaggagatagagaccatcctggctaacatggtgaaaccccgtcactactaaaaacacaaaaaactagccgggcatggtggctcgcgcctgtagttcctgatactcaggaggctgaggcaggagaattgcttgaacctgggaggtggtgcttgcagtgagcctagattgtgccaatgcactccagcccgggagacagagtcagactccgtcttaaaataataataataataataataataataataaagttatgtaaacttgaaattagttttaaaagctaatacattcattgatttctaattatttcactatattatatcgatttgcctgtctcttttaactaaaggtgctctggaggtatttcatgactattctatctgtgttgtggggatactgtaggttgggctgctaccacacagctcttcccaattctatgttcagtgaaatcccgttgacagcttgaagtctaccatagtggaaatacttataccacagaggttgacatacattacaaatcagggactgctttattgttttgtgcattgtctagaccaggggtcagaaaactacctggcttgtctggcttgaggcctgtttttttatgatgtgtgagttaagactaatttttacatttttaaagggttgtaaaggcaataaagaaatttttcaaaaagaatatatgacagagactctaagtgctacagataaaattattcaacaaaggtcagcaaaagcattctataaaactcaactggtatacagaacttacaataatagattattgcatattttatcattattcataaattgtgtgctacaagttgttaatatcattaaaagaatcttacgtttggatacacagtcatggcacaccaacacgtacatacctgtgggtatgtgtgtgttcctgtgtcccaccttggacagcctgctagcagacaacttcaatcactagtgggatagataatagaacagtggagatggagatgaataattgagaaatcgggacttattttttcaatcactatcatgagaataagagagctcttttgatcttaaccttagtttagtatactgtggataaaatatgccattcattaacttcaaaaaggaatttgtcactctttgactcagaatacaagataacaggtggatatttttgagttgctgaaaactggaaatctgtgaatatcaattgctctcctttgtcaacttgtttaattgattgacaaaagaaagaacacactcaatattggaaccatctcaaagaaaagagatattttttataaactcaaagacaacaacaacagcaaaaaaaacaaaacaaacaaacaaaaaaacctataaaatcatctggaagtctcgtcattcccccgacatactttccctttaatgtcccagaagatggttctaaaattcactctgttgccagatttaatgtttatttacaagcccatgtctgcttatcttttgtctcttgtgtgtggaatctgtataaaatcatagctgagtgacattacagtgaaagtcagcatttagggaaatgaaatccgatgaagttggaactgatttcttcagggcgtgcacggatgtcttggtgctttataaaatgtgctccctaggaaagaggcaccttgaaacgtttctctgaagtaacctctgctttagggaattcaagtcttctccagattgttcagccagcttgctccaatgattataaaagaagatagattggctgtaatagcggcgtttgacattagctgtactggaagacaagagttacgtgtcaagagaaacctccagcctttgaagattcaccccaaagtctgtgtggagatgaaagaacactggtgcagaaaccctgtgttctactcaccacatgaccactaactggctgtgtaaacctgggaaataaaaagttctaacttcagtcatccagaagcaagatccagacccctgttggaaggaatggagctaaacaggatatgtaaatctaaggtctattttatcacaacgttgcatatcaattagaatctacattgatttgctttctgccatgcgtccatatgtgcacaaatgaggcctggacatcaccagctagaggacaacagtcgtgtctttgtgtgccaatgactaatttttggagcatgtactactctgatatatacttctgatatatatatatactctgatatatacttctgatatatatatatactctgatatatacttctgtatatatcagattttatatcaaagctaatataattatgcaaacctatgtttctttttactctttaccatgatgtggtaataatggcaagaaaaggtagtagctttcattcttcatcttagactaccttaggggatatcaatcaagtgacacaatgactttctataaagcaactagcatgaactttgctgcactaagatgtctgcagtggtctgtttcccttcctgcccagaaggcaaacagacaagagctcacagaatctgctgtcaaaaaaaaaaaaaaaaaaaaaaaagggcagaatgtagatcctttacttctcattaaaatgtcttctcagtttacatcacttaacccatgtgacttctccaaacgctgcgagaaggattgtagcagctcagtttacttccagcctggagcagaagggctttagaaaaaaagatatttttaggatctttagaaaaaatagttcttttctaacatttttgtaatccaagaaggcttttcttatcaaaagtgctcagtaatcttgttttacatagctattttgtaagctcttaaactgttgaaaacatatttgaaaaatatatatgattcaggagtcaggcgtggtgttttttctgtagtcccagctacttgggaggctgaggagggaggatggcttgagcccagtttgaggctgcagtgagctatgatagcaccactgcactccagcctgggtagcagaataggaccatgtctcttaaaaaaaaaaaaaaaaaaaaaaatatatatatatatatatatatatatacacacacacacacacacacataatgtatatatgtacacacacaaatatataatgtatatgtatatgcacatacatatttgatttacatattatcacttcatagatactgaaaaggcattttacaaagtacaaaatatattttcaatgaaaattcttagtcaaaaaaacaaacaaaaaattagattgaactaaacattttaaaatacatagatgtttaatctctgagaataagtttcacagaagttttaaatagagatcatattttttaaacgtaagagtgctggagttcttctaggaatggcataaaatccagaaacttggaactaagatatataaaaaatttcgtctatgtaaaattttttaaaaccatgtgactgttcaccaaaaaaatctatataattatgtcatcctcccaagaactttaaaaagtactacaaaaaaaatcacacttttgaggcagggctggattgcagttcccactcagacaggcaaaacagcgtgtggagactcgcatcgtgaactttggctccagaacgactgcagtaatacattaggaaagcccggaggacacacagaccctccaaaagaagcagattgcttctgcaggacccaggaggcaccccaaatactgcgagtgcccaaactgtggagggaaagggagatcatcccacaaaaggaggatcatctgcccctgaacacaaacccccactggggaacccgaaggtctagattacgggagaagattttgaccttacttggagctcattgaatttagaaagctgggcaaaatacccaaatgaggaaaaaggaggaaaatccctgtgggcttgctgagtcaatttctgccttgcttcacagtggaccttcaggagggctaccagaggcactgagaaaaggccatagggagaaggaaatctctaggtgaacttcgtaacaatttgaacccattgagaagtctcctggccggcactcaaggaagggcatgaatccagtgtccagaatccacaggtcggggaagcaggaaagccctacttatttttgcagctgtgaggtgggtagcctaggacaagttcacagccctgcttttccactgcttggaaacagacttggtgctattgagggtggggcacggtgagagtgagaccagccctttgtgttgcgtgggagctgggtgaggcctgtgactgcccgctttgcccacttccctgacaacctgcatgacacagcaaaggcacccataatccttctaggaacataacttcattgacctgggaacctcaccctaatcctccacagcagttgccacaagacctgcccaagtagagtctgagttcagacatgcctagcccttcccccacctaatggtccttctctacccaacctagtaaatgaagaaaaagggcatatactcttgggagatctggggccctggccaccacctgttcctctccatactactaaggctgatgctttcttgaaaatgccagctcctgggagaaggccaaccagaacaaaagtagtgcattaatcaaacaaagctgcagatcctcacagagtccacttcaggcccctgcaacctccactggagcaggtgcccatatccgtggctgagagacccacagttctgtgtagtcaacccgcagtaccagcacagagcctggtagacttgctgggtggccagatccagaagagagacaacaatcactacagcttggctctcaggaagccacatccctaggaaaagggggagagtactacatcaaggaaacacccagtgggacataaggaactgtacaacagccttgtgtcccagaccttctctttcacatagcctacccaaatgagaaggaaccagaaaaccaactctgattatatgacaaaacaatgttctttaacaccccccaaaaaaattacactagctttccagcaatggatccaaatcaagaagaaatccctgatttacctgaaaaataattcagaaggttagttattcagctaatcagtgagataccagagaaagtcaaagcccaacataaggaaataaaaaaaaaatcatgcaagaagtgaagggagaaatattcagtgaaataaatagcacaaataaaaaacaatcaaaactttaggaatcaacagatgcacttaaagaaatgcaaaatgctctcaaaattctcagcaatagaatcaaaccagtagaagaaagaacttcggagctcagagacaaggtttttgaataaacccaatccaacaaaggcaaagaaaatagaataagaaaatatgaacaaagcatccaggatgtctgggattatgttaaacaatcaaacctaagaataattggcattcctgaggaagaagagaaatctaaatgtttggaaaatatatttgggggaataatcaaggaaaacttccctgtctttgctagagaactagatatccaaatacaagaagcccaaagaacacctgggaaattcatcaccaaaagatcattgcctagacacattgtcagcacattatctaaagttaagatgaaggaaagaatcttaagagccatgaggcaaaaacaccaggtaacctacaaaggaaaacctatcagattaacagcagatttctcagcacaaatcctacaagctagaagggattggggccttatcttcaacttccacaaacaaaacaattatcagccaagaatttttacccagcaaaactaagcttcataaatgaaggaaagatacagtctttttcagacaaacaaatgctgagagaatttgccactaccaagccagcattacaagaactgttaaaaggagctctaaatcttgaaacaaatcctggaaacacataaaaaaaaagagcctctttaaagcataaatctcacaggacctacaaaacaaaaaatacaattgaaaaaacaaaaacaaaaaacagagtatacaggcaacaaatagcacgatgaatgaaattttacctcacatctcaaaactaacattgaatataaatggcctaaatgctccacttaaaagatacagaattgcagaatggataagagttcaccaaccaactatctgctgccttcaagagacacacctaatacataagaactcacataaacttaaggtaaagggatggaaaaagacattccatgaaaatggacagcaaaagtgagcaggtgtagctattcttatattagacaaaacagactttaaagcaacagcagttaaaagagataaagagagtcattatacaatgataaaaggccttgtccaacaggaaattatcacagtcataaatatatatgcacctaactctggagctcccaaatttgtaaaacaattactactagacctaacatacagacagcagctaaataatagtgggggactttaatactccactgacagcactagacaggtcatcaagacagaaagtcaacaaagaaatgatagatttaaactacaccctggaacaaatgaacttaacagatatttacataacattccacccaacaaccacaggtattctattcaacagtgcgtagaatgttctccaagatagaggatatggtaggccacaaaatgaacctcaataaattcaagaaaactgaaattatgtcaagcacttgctcagaacatgggggaataaatctgaaaatcaactccaaaaggaacattcaaaaccatgcaaatacatggaaattaaataacccactcctgaatgatcatttggccaaaaatgaaatcaagatgaaaattaaaaaattttttgaactgaatgacagtagtcattcacaacctatcaaaacctctgggatacagcgaaagcagggctaagaggaaagttcatagccctaaacaactacatcaaaaagtctcaaagagcacaagcagacaatctaaggtcacacctcaagaaactagagaaacaagaacaaactcaattcaaatccagcagaagaaaggaaataacaaagatcagagcagaaataaatgaaattgaaacacacatacgaaaaatacaaaagataaatgaaacaaaaatctggttctttgaaaagataaataaaatttatagaccattagcaagattaaccaaaaaaaagaagagaaaaaatccaaataagctctattagaaacgaaatgagagacattacaactgacaccacagagatacaaaagatcattaaagactattataaacaccttcatgtacataagctaaaaaacctagtggagatggataaattcctggaaagatacaaccttcctagcttacatcaggaagaattagatatgctgaacagaccaataacaagcagcgatattgaaatagtaatcaaaaaattaccaataaaaaaagtccaggaccagacagtttcacagcagaattctaccagacattcaaagaagaattggtaccaatcctattgacactaatccacaagatagagaaagagacatgatagagaaagagagaaccctccctaagtcattctatgaagccaatatcaccctaataccaaaaccaggaaaggacataaccaaaaagaaaactacataccaatatccctgatgaacatagatgcaaaaatccttagctaaacgctagctaaccaaatccaacaacatatcaaaacaataatccaccatgatcaagtgggattcataccagggatgcagggatggtttaacatactcaagtcaataaatattatacactacataaacagaataaaaaccaaaaccacatgatcctctcaaaagatgcagaaaaggcatttggcaaaatgcaggatccctttatgattaaaactctcggcaacattggcatgcaagggacatacttccatgtaataaaagccatctgtgacaagcccacatgcaacgtaatactgagtggggaaaagttgaaagcattccctctgagaactggaacaagacaaggatgcccgctctcaccactcctcttcaacatagcactggaagtcctagccagagcaataagacaagagaaagaaataaagtgcatccaaaacagtaaaaagaaagtcaaacttgtagctgtttgctgattatatgattggttacctagacaaccctaaagactcattcagaagctcctagaactgataaaagaattcagcaaagtttctggataaaaaaatcaatgtagctcttctgtacaccaacagcgacaacgctgagaatgaaatcaagaactcagccccttttacaataactgcaataaataaataaataaataaataaaatacttaggaagatacctaatcaagaaggtgaaagacctctacaagaaaaactacaaaacactgctgaaagaaatcatagatgacacaaataaatggaaacacgtcccatgctcatgaatgggtagaatcaatattgtgaaaatgaccataattgccaaagtgacatacaaattcaatacactcctcatcaaaataccaccatcattcttcacagcattagaaaaagcaattgtaaaattcatatggaactaaaaaggagcccacatagtcaaaacaagactaagcaaaaaacaaatctggaggcatcacattacctgatttcaaactatactataaggccatagtaaccaaaacagcatggtactggaagaaaaacaggcacatccaccaatggaacagaatagaaaacccagaaataaaccctaatacttatagccaactgatctttgacaaagcaaacaaaaacaaaagtggagaaaggtcaccctatttaacaaatggtgctggatatttggcaagctgcctgtaggagaatgaaactagatcctcatctcacaccacatagaaaagtcaactcaatgtgaattaaagacttaaatctaagacctgaaactacgaaagttctagaagatggcattagggaaacccttctagacattggcttgggcaaagatttcatgactaagaaccaaaaagtaaatgtaatttaaacaaagataaatagctggaacttaattaaactaaacagcttttgcacagcaaaaggaacagtcaacagagtaaacagacaacccacaaagtgggagaaaatgttcacaatctatacaatctttgtcacatccaatgactatacaaattctagaagataacattggaaaaatccttctagacattggcttaggcaaagacttcatgaccaagaacccaaaagaaaatgtaattaaaacaaagataaatagctaggacttaattaaactgaagagcttttgcacagcaaaaggaacagtcagcagaataaacagacaacccacagagtgggagaaaatcttcacaatcttcacaatctttgtgacatctgacaaaggactaatatccagaaactacaatgaactcaaattagcaagaaaaaaaagaaaacatcaaaaagtgtgctaaggacatgaatagacaattctcttttttttattaggaaaatgtctttttattaatcaacttttatgttaagttccagggtacatgtataggatgtgcagatttgttacataggtaaacgtgtgccatggtggtttgttgcacagataaacccatcacgaagatattaagcccagcacccattagctgatcttccttttattttttaaatatacatatatatttattatactttaagttctagggtacatgtgcacaatgtgcaggtttgtgacaattctcaaaagaagatatacaaatggccaacaaacatatgaaaaaatgctcaatatcactaatgatcaggaaaatgcaaatcaaaaccacaatgtgataccatcttactcctgcaagaatggccataatcaaaaaatcaaaaaatagtagatgttggcatggatatggtgagcagggaacacttctgtactgttagtggcaatgtaaactagtacaaccactatggaaaacagtgtgaagactccttaaagaactaaaagtagaactaccattggatccagcaatcccactactaggtatctacccagaggaaaagaagtcattatatgaaaaagatacttgcacacacatgtttatagcagcacaatttgcaattgcaaaaacatggaaccaactcaaatgcccatcaatcaattagtggataaagaaactaatatatatatatataatatatataataaatatatattatatataatataaaatatatattacatatacaatataatatatataatgtaatattttatatatatatatatatatatataaaatggaatactactcaaccgtaaaaaggaatgaattaatgtcattcacagtgacctggatcagactggaaactattattctaagtgaagtaactcaggaatggaaaaccaaacatcgtctgttcctactcgtatgtggttgctaagctatgaggatgcaaaggcatgggaaagacaccgtggactttaggggttcaaggggaaagcgtgggaagggagtgagagataaaagaccacaaattgggtgccttgtatactgcttaggttatgagtgcaccaaaatctcacaaatcaccaccaaagaactttctcatgtaaccaaacaccacctgttccccaataacctatggaaataaaataactaaataaataaataatgctaaacaatcatacttttattaataagttaaaagtgtctacaattttttaaaaaaacaggtaacaatgaaaaaatatgtaaagaaaatgaacacataaaaatacaaatgactttcatatgtatgagaagatgctcaacctcactaataaaaaaagaaatgctaatccatgctaaaatattttcaacttatattgtaaagaccaacacttataatataccatgttgacatggaagaaaacagaaatattttatacactgttgatggcactataattaataatatataaaagaaacagtgatgttattcaaaactggaaacaaatgctcttcaacccaataattctgtttccagtaatttgtcctacaattattagcaaatgtgtgcaatggaatatatgctaggtataatacaagatttgaaattacccactaacttatcaaaaagggatttgattaaaaattgcggtcagccctgcatgggaacagctttgctcacggtgctccttgcaggtacccagagtacactcagccacaggcttgcaccgcagctgatctgagtcttggcaggacacctcgaaatgtgagaaggtgaaggccagtgaacaggtgctctgaaaacttacatcatttgcctccctacccctgtgggaggccaccatgtttctcatcacctctcagattgtgataaagggtagagttctctgccctctcctctcagaatagagctgcataatacaaaattgtttagctcaatcaagaattgcgttcttggccaggtgtgttggctcatgctcctaatcccagcactttgggaggctgaggcaggtggatcacctgaggtcaggagttcgagaccagcctggccaacagcatgatgaaaccccatctctactaaaaacacaaaaattaactgggcatggtgcacacgcctgtaatttcagctactcgggaagctgagggctgaggcaggaaaatctcttgaacctgggagttggaggttgtagtgactcgagatcacaccactacactctagcctgggcaacaagagtgaaattcctctgtaaaaaaaaaaaaaaaaaaaaaaggaattgtgttcttagcaatgggaataatacagcccatgttgtggtcatctaacccattttgtttagatgtcatccttcttggtatctacagctacagtgaatggctattctttgcttagctgtttgtgcaaatacaaaactgtctgaatcgaaatgactcttttatctttcccagtctattggtcaggctttggtcttaggctcaccttatgtattggtgcctgacaaacctctatgaaagtgtaatgcactcattaaaaggaatgaggcaatcctatatgttctgatacagaaatcatctccaatataaattgttagaggaaaaataaaatcaaggtgcaatgcagtgtaaacagtttttttgtgtttaaaaaacagaagagaacatataaacattaaagcacatataggcatagaaatttctgaaaggatactaaagcaagaggtaagttagaatctcagagagtaggacaaaaaggaagaaagccttactttttactgcataccctctttaaactttctgaatattttactccatccagaaaagtactttaagaagaaactgaggcagtagaaagaatacattatttaaaagacagttcttatatttgttttaaagttgcatgcactgatttatttttattcctagttttctttaaaaacacgtattactttataatacataattaaatatacttattttttaaattgtctatctcatcatctctagtccagccatagaatttaagctcatcataaaggttgagattttcttctttactttcatttatatctatagcattttgcctgacatataaaatatactctgtaaaaagttgctgagtaattggatgaattttatttctgtgaattataaatgatattaatctgcattctacctttcttcccttaagaagttcctaataggttctccatgctcagaggccaccccttgctgccttccttacttttacttggcgttgcctaatggacatctctctaataacagacctgatttgaaaactggccagacataataaaactatttatttggtgatcatatgatagaatagttatagatcctttgtttcctttggaaattcagttgcagggttaaaagtgaaggcctccatcgaggaaaataaactgaaaaaaataaagaaaaaggaagcaagtagatgcaaagggaaaataacaaaaatctcacaccagttaaaatggcaatcattaaaaagtcaagaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaagactataaatcatgctgctataaagacacatgcagacgtatgtttattgcggcactattcacaatagcaaagacttggaaccaagccaaatgtccaacaatgatagactggattaagaaaatgtggcacatatacaccatggaatactatgtagccataaaaaatgatgagttcatgtcctttgtaaggacatggatgaaattggaaatcatcattctcagtaaactatcgcaagaacaaaaaaccaaacactgcatattctcactcataggtgggaattgaacaatgagaacacacgaacacaggaaggggaacatcacactcaggggactgttgtggggtggggggaggggggagggatagcattaggagatatacctaatgctagatgacgagttagtgggtgcagcacaccagcatggcacatgtatacatatataactaacctgcacattgtgcacatgtaccctaaaacttaaagtataataataaaaataaacaataaaaaatacaaaaattagccaggtgtggtgatgcatgcctgtaatcccaactactcgggaggctgaggcaggagaatcgctggaaaccacccaggaggtggaggttgcagtgagccaagattgcaccattgcactccagcctgggtgacagggtgagattccacctcaaaaaaaaaaaagaaaaaaaaagtcgttttttatcattatatccttcaagttttaaaaactgaagattaaaatatttgtctcaggtcaggaaataaagttcactaagaaaaaaaataaaataaaaataaaataaagagttattattatgtatggcattttaaaattttgtttaaccacccaaaacagccctgtgagaaaggctattatctcctatatcacaaatataaaaggaggacacagagaagttgaagaagtctccaatccctattcctcaatagccaccaagaaaaacgaacaggatttgagcccaggtctgtgtgaccatttgaccagaggtttatctggggagtaggttttccctctgaggagagaaaatcaatgtctggagatacaagcacagactctggggcttggcctgggctctgcctgtgtataagacatgaaatcacattacttggtgccattttccttctagttttaaatttaagattattgtgatttgtggacttgctaactttatatttcttcaagttttatgtgagtgaaataagatacaaagacttctcttaaatttgttaaaagcaaattaattgttttacatatgatgaagggaatattttaatacaagtattatacaaaaatgcattgttttcattaacatgaactaaaggagcaaatggtaacatatcttgttttctattagctgctattagggggatgctagtaggttttaattagtgtgctacttctagtggaagtggccaataagacatttggagactggccaaatttgggctaaattactgtaatccttaataaactcatgtaaagctagccaagcccctctagggtgtttgtaagcctgaggcaagagtacagatagagaaccacatatcatgaatctaaatttgtaaagagttacaaaccaagctaagaaacgaatgaatcaaatatgctctactcccctcccttgacagatagacatccattcacgcccataccccacaggtcaaagttctgcccacactgcaaacagctgcctgttggccacccctcaggaaggcagatgagggacgagaacggtgaagacccttgaaggactatcagagctgttgaggcaggaaactgggtgttgtgtgcagagatcatgttctggaaggcggtggcaacctcctatgtcatctcccctgggctcataaggccctgcccttgtgacacaggatatgaccgaggaagaccacagtgagaccctttaggaacccagttcagggcaggaaggcccactggcctgggtataagggggatgtgaatggaggatttctattgaactctttgcttgaatactaaaatgtacataatttacctcattggccaaagaatctaatgtaaaaatatagtaaattcattcagacaaaaaattataaaatatatgttaggcctgttgggctgtgtcagcagctgacgtctgtcagtctgtgaaaaaatacctatttagagaaaggaactgtaggcctggcattgatcaggtttaagccaggagcaataaggacaaccaaaacaataagaaaaatggtctgaatataccccgttgcaaaacctgatggtagtttgagaatatagggctgccctgtcagcagaaaatacgaggagctgatttatgctgttaagaaaacatgcgtggcgtctgctgctatcactgtgccccacttctgcttttcatctcctccagggctgcaaaagactcaccaaataacatgggccagtgtgctcactttgcctgagacaagggggcaaattttgccaggtttcccagaatggagagagccgtaaggatgtggaacatttagttttaaaaatggcaatgtttcaggcaaatgaggacaagttggtcaccttagcctgggacttttcattgagaaggctgctcagtggaaccaggtgtagaagaagctagggggacactgtgtgtgtggcacttagagttggggctctagattgaaggatgtggaattccagctctttaccttgtggctccaaggtctcagtcaagctgctaaacctctgtatgctgtcattttttttcagctgttaaatggagcaaatcagagtacccaactcaaaggttagagaaaaaacagtgaaggtcagctctaagcatggtgcccgatatataaacatgatcaataagtcctactattgctattactaaaacaatactttgagagagtgcccagggttgaacaagagagacaaaatccaggtgaaatttaagggcaattattggggttgggtcagaagccataggcagaatgtagtaggagggatgtgagcctggagcactggggcaggatgtcaggacatggatgaagcaagggagcgcaggcactttctaaatgaggagcactatcaagaacagtgctttctcttactcaatgctgggctgtgtctgggtaagaaatcacccactctctatcactggcaaaaaagaaataggataaattttttgcagaaaaaagaaggacactggaaacttgtgaaataatagattgtaaaaccaataaggaagaggtaattgttggtaaaaatgtaaacaattgcctcgactcattatttggctccaaagtcgaagcaaaaataaggcatgatatgtactacgagcatattaaagtgacagacatcagaagttccaaacatgggacagactgagtcattcatcctgtcaaacagtaaaacataagttacaaaacgatgaccctgggcaagatttggaaagccatcgtccaattttgcctatatgctgttttactttcttttttaaatactcaactttcaggctaatttttaaaaatcaggagatttaaccagaaaattggaatttttgtcctcatttgtaatggcagaaattcatccacccttgactagtatcccaaaggctgatgatggtgtgtttctccttttgaagggccatgagctttgcatgtacctcagcaaacacccagccagtgtaagtcttaaaagatgaaaaagaagacagcagtttggatcctttttttatacctgtttctttaagaagtggactgtcagaacaaaagtgagacaaacatttacaaatgagaaacttcaaaagtatcagatattcaagtcagatacaaagtgggatctttagaacaggaagactccaaatttaaacaggaccagagaaaaagccaacaagggaggaatgaattccttgctgtggaagtaacatcaaagattgaaaaagagacaagcaaataccaaaccaaaaaaaataaataaataaaataagatcaaagaaaaagagagtggtagattctgggacctcatgcatttaacatcaatgcaggctttctccggggatttatcctgttggagctcacctgtgacaacagtaaatccagcaagttaccagatggactatgttgtccaagacattgagactgtgagtgaaactttgcaatctaatacctggcatttttgaccactaagatcaatgaaaggcacaccattcaatgaccactaagatcaatgaaaggcactcattcaatatgccaagaccaagcaagcaagaaaagtaagaaaagaaagagaccgaattgccaaaaaagacaatgaggcaaaagcagatttagaagcaaattgtcagtgctctttttaaaatccaatttaacaaatatctgttgaatctattaatggtttaatcatacctcttggaattacatattcaaaaatgaatcagatattatctgtgcctctgagaaaattttaaggaggtattccacaaacattcaacaaatgtttctttcagcatctactgtgtttcacgtacccctttaagtaggtgaaatatctcaatgcaaaagacaaaagattcctcccctcatagtgcttgcattctagcaggagaggcaaactataaagaataaacacaagtaagtgaattatatagtaagtaagaagataataaatgctatgagaagaacaaaaatagatcaaggtaatggatctaggagttcttggatggagggaacgagattgcaattttagatatgtcagtcagggtaggcatcattgagatggtgccatttgagaagagacaaaaaaaagtcagttttccaggatgctgtctgagagtgcttgctcagcgtattgatctcttttacctaccacaactagactccatttttcatgcttccaccacctctcacctgaggccaaaataagcctctttgatctaatatttgccctctttgtttatttatttatttatttttccatttttacttcaagaaaataattttctttaaaggtggttattatttttctccaaaaatccttcagcagaatagtgtaactattctctgaaaatccttcagagaatacaataactctattcttttcagcctagccttcaaatatcctatcctatggcaccaactgatcttgctttctttacttatgacttaaaatttgatggtttcctgtagattttggtcactagtatgcttgcattgtttctatcatactttgtcttccatcagtctgttggagcatgaatttgtctttagtgactggccctacacttttagatagaggcagcatgtgatttatccttaattccaccacagggctttgaatcatgcttcacaaaaagtaagggttcagcaactattaagtgaatcgaatttgtaccaaacaattggaattaactttatcaagtgtttctaagagttggtaacagaataataagaataaaagagtttttgatcagtattcactgaaaattactggtcagatgagacagattttgttcggaaagtctgtgacaactgtaagttgccaacgaatggatgagcacattacctaatggaagcaggatttccagctcagtcttccatatactgaaggccctgggccatttcatacagactatgtactcagaaatacaatctccattcagtatcatccacatctgccaaataatgaaatattctagagtatgaatagaaaggcataatcagatcttcagcatcctcggaaatgaaatctgtgaaggaaaattaaaaatgattaaaaacaggtttgaaatgcggacaaaggtacaccaattaaatgtagacagaaagaaagcagaagtggaaaaactagtacctttgaaagtaaatattaagatcaaaacaggccgttgtaaaataatcattatagtctctaattaaaaacacatactaaccccatgtgtatagcacataaaatatcaataaatgcaaaagtaaaagacttctaattgttcctatgcagatattggtcaatagtgcccttatgtgagtacctgtgttgcagttccaacatgcagaggccctagagcctggttgaggaagatggttgttggtttaaccagctatgctgccagatgaatgaactaatggacagagttcaagaggaaaagccaaggttgggaatgttggagggagccaatcagaagccagcagaactaagcaggagactagcttgaggatgatcagtattcaatttttgcaaagagtaggtacaataactcggccagcccaaatcttccatagtggtaattcttatatggagggcttgatggagagaaacagcttagaggaagattttaatttttattttcaaagttttggtaaatcagacaaaaatatgaaaacaaatgatctgagggatatatttattaatatagaattaagaggtgtgtagcctataagtgtttataaaatattcagaaaagaaaaacatcattatatgaagcaaatttctccagtctaatttaatctgataatggactaaatctatagttcaatagtcaaattataacttccaattctcaactacgtaaaacatctaaaaatctaaatcagggtgcaaattcacactcatattcaaatgcacataaaaacggttttgcttcttttccctaactggattcaatatgctcatcagcctctgttgcttctaatggtagaaaaatctaaccttgatgatgaataataattacttaatgattatttaaaaagtagtacattattgggtatatattgggttatgttgtgacgttctctctgtacttttttcctcttcccttggcagatcactaatggggtggtttgtgtatcgtgctgcgtcaagggagtcatgccattcacgagtcccacctgtttggaggcaaaagacttgcatcacagctttcattgctgttgtctgtaggacctgccttagtgtactaaccagggttctctagagggacagaactaataggatacatgtatatattaaaggggtttattaaggagaattgactcacacaatcacaaggtgaagccccatggtaggttgtctgaaagttgaagatcaaggaaggtagtggctcagtccaagtctcaaaacctcaaaatagggaagccaacagtgcagtcttcagcctgtggcagaaggcccaagagtccctggcaaaccactggtgtaagttcaagggtccaaagccaaagtcctcagagtctgatattcaagagcatgaagaatccaacacagcagaaagaagcaagtcagcttcttccatcttcttctgtctggtttttctagcagttccggcagttgactagatggggcccacccacactgtgggtggaccttcctgagggtgagtcctctcctagtccactgactcaaatgttaatctcttctggcaacagccagaaacacccagatacacccagaagcaatactttgcatccttctatcaagttggcacttaatactaaccatcgcacttggcctaagggagtgagatgtagtcacttggactctcccagacctccaaatccagctaccagcccttaacacatttactgataacttcagcccatttgtaccctcaacctgctcttctggtcctggggaccctcagttgcctgcctcacactgtgctagagtgaccaggtcactgtggaacccctctagcctttctgcgttgcctcttcctcagcctttgctaacctgtcttctcctccccagctgatttgctctgggatcatgctgaacttgagacagctctaacaggcttgcagccatcactgctatgggtacttctggaggcagtacctttctgtgttttccaagatctgtcttgtgacctctatccatatccacccaactcacatccagtttcaatccctcagggagaaccagagagcaggcctcaagctaccacctaactgtgctcttgtctcaaccaactgcctctgaaaatcttccacccagagtagaggagagattgctcccctcagtgtaataggaaactacaattttttagtatatggtaccctctatactacctgactggaaaaaactctccaccctgaatattttcaatagcactgtgttttgctatttaaaagacagcagctttttttcattctgtttttttactaacattttcctgcaaacaatattttcttaaaccataactgagcgaagtagagcattaatttttttgaaattgaggaaagtagccaacacaaaatacaaatgtcattaaatatttaaaataataaaaataagtaaaagtaacatatatccaaataacatatatttttacattataaatttgatgtatgtgaaaaatttgcaaatccaaaatagatcttttctttttttttacatttttaaattttatgttaagttcaggggtaaatgtgcaggatgtgcaggtttgtcacataggtaaacatgtgtcatagtgattagctgcacagagcatccaatttcctaggtattaagcccagcatccattagctattcttcctgatgctctccctcctcccaaccttccacaggccccactgtgagtggttcacctccctgtgcccatgtgttctcatcattcagctcccaattataagtgagaacatacagtgtttggttttctgttcctgcattagtttgatgaggataatggcctcctgctgcatccatgttcctgcaaaggacatgatctcatttctttttatggctgcatggtattccatggcgtatatgtaccacattttctttatccggtctatcattgatggacatttatgtagattccatgtgtttgctattgtgaatagtgctgcaatgaacatatatgtgcatgtatctttataatagaatgatttatattcctttgggtatatacccagtaattaaattgctgattcaaagacccatctgcctctaggtctttgaggaatcaccacactgtcttccacaatggttgcaataatttgctctcccatcaatagcgtaaaagtgtttctttttgtccacaaccatgtcagtatctgttgttgactttttaatgatagccattctgactggtgtgagatggtatctcattgtggttttcctttggatttctctaatgatcagtgatattgaactttttttcatatgcttgttagctgcatgtatgtcttcttttgagaactgcctgttcatgtcttttgccccactttttatggggttgtttttttctagtaaatttatttaagtttcttgtagatgctgcatattaggcctttgtcagatgaataggttgcaaaattattctcccattttgtaggctgtctgcttgctctgaaaatagtttcttttgctgtgcagatgctctttagtttaattaggtcccatttgccaatttttgctttagttgtaattgcttttggcatcttcgttatgaaatctttgcctgtgcctatgtcctgaatgctattgcctaggttttcttctggagtttttagagttttgggttttacatttaagtctttaatccatcttgagttgatttttgtatgtggtataaggagggggtccaatttcaattttctgcatatggctagcctgttatcccagcaccatttattaaatagggaatctttttcccattgcttatttttgtcagttttgtcgaagatcagatgattgtaggtgtgtggtcttacttctggactctctattctatggttccattggtctgtgtgtctgttcttatgccagtaccatgctgttttggttagtgtagccttgtagtatagtttgaagaagggtagcatgatgcctccagctttgttctttttgcttaggattgtcttggctattcaaactcttttttcgtttcatataaattttaaaagagtttcttctaatttcattaagaatgtcagtggtagtttaacaggaataacattgaatctatacattgctttgggcagtatggccattttcacaatattgattctccgtatccatgaacatggaatgtttttccatttgtgctctcttcgatctatttgagcaggggtttgtagttctccttgaagaggtccttcactttccttgttagctatatttctatgtattttattctttttgtagcaattgtgaaaggtagttcattatgatttggctcttggcttgcctgttgttggtgtataggaatgctagtgatttgtgtacataattttgtattatgagactttgctgaagttgcttatcagctaataagcttttgggctgagacaatggagttttctagatatcggattatgtcatctgcaaacaaagataatttgacttcctttcttcctacctgattaccttttatctttttctcttgcctaattgcctggccagaacttccaatactatgttgaataggagtggtgagagagggcatctgtgtcttgtgccagttttcaaggggaatgcttctggtttttgcccattcagtatgctattggctgtgggcttttcatatgtgggtcttattattttgaggtatgttccttccatatctagttttttgacagtttttaacatgaagggatgttgaattttaccaaaggcctttcctgcatctactgagataatcatatggtttttgtctttagttctgtttatccacatttatgtatttggaccttttcttaatgtaaatgactcaaatttaaaatgtttgaaaacagcaataaatcaacaaaggagattttgtaatacttttacaaaatatttgtggaatttacaagttcattggtaatttaaaattttccagaatgttttatgagatttaggagccattcatatgataaaatataaaactcagagacaaatttagacttgatctaaatgcttgacaaaagaaaactagagctcaaactaatttattacttaaaatatgagcacaaatggaacacaagagtggttcaataagagagaatttgttaactcacaatgtagtaatataattcagctcatcagtagatcaaacaaaatactctcttgtctgtcacatggatttttgaaataatcgtgaataaaactaagcattcattcttatttaaaataaataaataatttgtgtgtaaaagagcagaaggatattctcttcatgtggagtcagaactagtgttatgtatagctgagaaataaaatttttgttttgtttcgtgatggtattgttgttgatgttacaagtttgtataccattattattgttcaatattgcttcaaaaattttggctaggagttaggaagttttgatggagacagtaaaataggaaataaatgtataagaaattgatttcatattaattatattgaataaggtgttttatatatatatataaatacatatatatcatatgattaccatcataccttgcaggtattgtggattccgttccagacgaatgcaataaagtgaatattgaaataatcaagtcgcacaaagtttttggttttgtagtacatataaaagatatgtttatactatattatagtctattaagtgtgcaataatcacattatatttgaaatatatatgcctcaatttaaagatattttattgcaaaaaaaataaagctaacacagagacacaaagtgagcacccactgttggaaaaatagtgctgagagacctacttgccacagggctgacgcaaatcttccattcatgaaaaccacaaaatctgtgaagtacaacaaagcgaagtacaataaaacaaggtattgcctgtatctccctcacaaattaaaaggaaataactaaagagtatatgatttaatataaaagtatatacaagtatctggttaaagaaaatataccagcagcaataagatgagcacagcatttacatgataaaatgtttaatgaattaaaacaattcatatacaatggaatttttgaaatcatgaaattcatagaaattaatttaatgatgggtatgaaaactagagaaagaaaataataaccttagttggaggactttattagaaatattctgaaaatagaaaacaacggtgggttcttggaaagaaaaatcaaatatttaaaaaatatccattcttctctaactaaatgttttaatgtaaataataaattatcaataaaaattctaacaaactagttaaataaaattattctgtaattaaactttaaaatgaaatagataaaatatcaaaaaattctctttaaaaattaaagtagttgtaagtaaaagtgggcaacaggattaataatactcttcacctattacactgcattaagaaacacttttttactagtgtgaagcttgtaaaaaaatctaaaaatagccttaagtgtatcagtagttattcatataagaagacattctgattgggagaccacatcctcctgaaacattaagacagagacagctaaaaagagacagtgaactagagaaagatggagaagtatccaaatatagatatagttgaagtacatgctgacagtgatatttcaaagcagtggaaaaaactgcatttctcattaaatggtattgggataaacctgataatataaattatcttgattctttttcatagtagaaaaaatactcataacaggccgccttgcttttaaaataatatatctattaaaaaggcaatttgtgttaatactaattagaaataaaagttgtaaaagaagaaaaccgctagtatctcataacctttccaaagtgaaccactattaaattaggttggtgcaaatgtaattgcggtttttgccattacttttagtgacaaaaaccgcagttgcttttgcctcaacctaataataacaattcagtgtatttcctcccagactatgctttatgctcaacttcttattgttgacatcatactttatacccaattgtaactcttgcattttaaaatcaacattatatttacttcccattatattacaaatgtttaataagcaccattattgacaagtgaaatttcatcacattgattcttaattacttgctttacaaaactatatagaacatttggaatatttcctgtttttcatcattatagatgacaattgtggacaatcttatgcataaggctttttgcatacaatataggcttttaaactaggttcttctgtagctgaatagaggtatgttttgtttgtctcttggctttagtatggccatatcttttaagatgcttggataagagataattataaagacattgattttctttttctttttccctccttctgtaaattattgttttatttagtattaaaaaggttcagaaaggaagtgaaaatggttgtgtaaaatagtcccttaagaagcaagcaattacagttatttttacataggctaatcagtatccttttaaatgtgtaatcaagtagcatctataattatttgagccatttggctcaagcatacaattgaatctaccaaaaacgcacgtgtttactttcctttcctaatctttctgagcttaaaactaagagtttgtttctattttcaccccaaaagcttagttttggaggaattccagtaccaggaaaacctgggacctttttaaagaaaaacttccatggatgcatcgaaaacctttactacaatggagtaaacataattgacctggctaagagacgaaagcatcagatctatactgtggtaagtcagcccatctgttttgtcttgatggtttctaccactttggggtaagtcttgctttcaccagcccattcctgaacccattcgtaatgtgtttatcttatgctctgagttcccatcagcgtctgacgtgacactggagagaaagagaatggcagatattgaatctgtgttaattgcactagtggaagaaacaaagacattagggccatccagagaattcattttttttttttgactgtgggtcatatttcaactgtgggtagtatttgcagtctatattgggacaacatgaattttttattatctctggaatatgaaacaagaaaaccacatattccattaaattctatggcttgggagttacatatatgtctacttattgttaatattaaaaatagttccttttaaatgagggagattaaacttttagtgtgtttgagattctcatttatcatattgacaaattaaatgattttctaattaagtaacatttgtcttccctaataatgagtttcatgagggtcaggactgtgttttctttttactactgcattcacaatgcctaacagagtgccttaaacgttgtaggtgctcaataaacgtgttgatgtttccaacaataattttggatttgtctgtttctctctccagttctatccatttttggtttatatattttgtagctctgttgtttggtacatacacatttagtatgctatgtattctggtggattcactcttttatcattatataatattattatttgtctctgataactctctttgctctgaagtgtgtctgatgttaatatagccactcttgcttttcctctataaaggtctttgtcatgtaacttttcccatccttttgctcttaacctgcctatgtaatcatttttgaagtaagtttcttgtaaacaacaaatagttgggtcatgttttttaattcatgctttcaatttctgtcttttaattggtctatttagcaaatttacatttaatgtaatgaatgttctgggcttaagtgcctgtttattttgtttcctgggtttttaaaaattctctattttctctaacgtcctgtgtttcctggatagtttttaaaattctatttttcttatctagtgttagagtatatctgtgtatagcttttgttagtggtttctgtagacattatattatatatgcataacttattgtggtttactggtttaatcattttaccaatttagctgatatgtagaaacctaatttccattgacatccctttatcttcccttatttattttacaattgtcttaattaggcaattatatttttagaaccatttctatatatttagaaccatttcaagtggtattattttgctacaatgtcaaacatcatttaaagaattcaaaaggagaaggatagtttgttgcatttactcatatttttgcccaatattgacaaaatgtaaagaaaaactcttgaaaccacaagggatatgtttggcttggattagtattaaagactcatgactgctgcccatgtgatctgcagtgacatcacagtgtttgtgggtgggtgggagagggatgcccttcatatcactggaatgtgatgaaagtcctgactcaccactaaaccatctctgagactgctcctgcaggggatgaagggggttcctcatgatagctcagtagcggcagaagtctaggctttccttgtgatcgcagttgataccatagggagagacttggttctatctgacaatgattaaattcacagatcttcagaattggccttgtaagccagagagtcccagattgatcttcccatataccaccctggccagaaacttgggcacctcactacagcatggctcagtggaaatggggccatagtcttttctatggcatttggcttagggagagaagtcgttgtctaacagcatctctctttctatgctatcctttcctcatcctttggctatagacagcagtcttttaatggcaattttaaacaaaattttatctgcaccagttggtctctctgggttgtctttcagcagcatacttaaaacagatcaggttaagagaaaatccagagaattctccactgtgtttttcttttggtcccgagatttttatatatcctttatttcttttccccaccattcagagatattttaggtaagttttatacataattcctatagtcttttagttgtacttagcagaataaatagggaaaactatgttacttcatattcctggaattggaaatctcttcaactgacattttttctttaatccatggcaagagtaggtcaccctgtcattgacagcaaaaatatgattctctttgcaatcttattgtagaattatttgaacaaactatggcttaaatgactttgtgtttgttttattctttgataaatataatctataagaatttttttgtgttttgaggtatcatattaacacattttcttgaaaattgccattggattcaagggtatgaggcagaggatgctcatggggaatcacacttggattaaagattgtcagcattttaaaaggtttgtgtcaagtccctgactccttcggtttggaaaagttaggatgatgctagggagggattaattacctcactggctctagaaaagccatgacattacttgtccatctctggctaatgcccaaggctcctgacaattctgcaacttatccacatgagcttaggtcaaccatctcctaattaacataaacactggcttgctcatgacatttttttttttttttttttgattctaggtttggagtcttgggctatggaaagcacactcattcctatccctttcccaataatgtttcaagaaatatttcataatatatcagtttccttgagtccaatctgctgacacagattgtgattggagcaggggcactacattgaaatcatgcactaccagaagtttagattagcctaatgtcagaaatattaaagggcatcactacctaccattttgctaagatgtggcagagcaaagtgaaacaacagtaagcttataaaaacattgcacactcattgttcataaactggggcttaaaagtataaaagcctgagctttagatataaataactaagatccctatagtaatattaaaaaagaatatctttatacatattatgtgttaaaaaatatctttaacgataagatagattggagttactgaataagcagagcaaaaaaaaggaagataaaaaggaacaagagaaaaaaaaaacttcagtttctgaatatcagtagctttcaccgtttcgttttctgagagaatcattatctaaaactttgctaagtgttgtggtgacttttaaactactatagcacttatcaagttgcctacaactttgctagcatatgttactccttggggtttaattggcagtattgttaatatgaggcataaagaatccatttagcactaacgtatttggaaaaaaatcccaagaaaattgttttattgtgcaggtaggcaaccttagttttaaccttcacaatttagaagaaaaaatgtacattatttttcttccaaattgcttccaacaccctgcttaagtgagaattcgtatcactatacacttgcacatgtacacacacacccacacacatatttatatacctagtctatctcctttaggaatttcttacgagaagcaatggtttgcactgttaaataccgaagtacaaactctttcctttctgtagtcaagcttaaagtttcccccaaagacaccatatctgctacaaaatcagctttgctccatcactaagtcactgtggtactaagtaagggcttttggaaggaatgatatttttgtccttttctagtgttcgcagactctcttacagttattaggccttgggaagttcagattcaagggatcaacaaatcaggcagcaagagtacggtactactcataaattataaaatgtgtttcaaggcccacggaagctccagcctttgcctaacctaacgtatgcctctttagcaggctgcattcagcaggcatcctcattgcaatctgtcatctctttcttgtgggaccttcccactccctggagacttaacagctgttccatagggataattcaatttagtctttatagctcgatttgactacaagacaattctccacatcccgaaatgcagtaaaactaacagcttaaagtagacataaaaaatacctcactattcttcctcaaatcctttattatatgctaatacagcactatataataaacaatcagaaagcaaatggcccattgaagtgtgtgtacagtacctgtaatatggattattatatatgtagtataagaaatatattgctctgatagtttcctgaaaatgattaatttcataccttgcactccatcagaaatgatgctttttttgagctgtcctttctgagtcttctatctcttctcccagaggcaaggagcataacatgattccctgggagctggctgaagtttcactcccattattgtaggtctcaaaatattttcctttttatttaaaagatcatagtggaaatgcatgtgttactttactttgtcttcaatagaagggaagaaaatgcaaataactaataggaagactctacttacagagttggctttggagctaattgactatgtcaattcatttctgtacctttgtttccaaatgggaattggaatcagggaattggatgggcgatggccaatactaagccaatataataatactcccaaccccatggttgaaattgctaaataatcacaaaatgccttttcttttgtcctagagggaaacccaaaggtctcacttcagtgttcctggaagcatcctcaataaaatcataattgaaacattgacttcctaggttgttcatccccactccatggcttattcagctatgggatcttgagaaagttacgaaacttcagtaccctcatacataaaatgagggcaaatatagtatctacttcaaagtgttagtgtgaagattaaatctgcaatacccttagggcagtgcatggtacacactaagcacccagtagattggagctattaataaaaacatctataaatccattcaactgaagttgacatataagccaatatttatttgccattttagatagctaattaatgcagtcacatacagttccaaataataaaagttgattggagatagctcctgttctttcctgaatctgagtttctgtttactcccaaactatgagtcatgaagtgggtttgcagtaaatatattacaaacttaatcatctcatttatttgagaaaatttgatgaaaatcattacttcagatttgatcaaatggtagactcctttaaaataaggaacttaaaaaagtgttgcctgataggcttgggtataacagatgtattgaagagtaacaacagtgagttttcttgaagtatgttgcccttcgtttgcatctctgctgtcatgcaacttattggagcatggttgattatttcttatggctctaaagccaagcaaacactcactgtcagagttatgtgtaagagataagggtggacatgagagcacacacacatttacatctgcaggtgcacacatataacatacacacacacgtagtgacaggcacctttatcttacctccctgtgacccaaaacctcatgaaaattgctcagagaaaactccctactgtctagtaaagcctataatctctttagcttgtttccgggatcatgtttcatctctgtgagtatgctctgtgataaatgatactttctcttgatcgaaggaatcatttgaaaaagcaactaacatattgtgtcttttctcttctcattcctgctctcttctacttccatttgaccagtcggacatccacatcacctgcatctatgctgtatgctcctcatacccagcaaaaatcatttccaagttattcactcactgaacagttgcttccttcctttcttcaggaaaattggaattaaatagtttcaaggtcatatgaagaataatgtgccttaaagaaaaaaggaaaaactaacagtgtaatggttaatatcttagtccatcaaggcagctataacaaaatgtcataaactgggtagcttatgaataagggaaatttatttctcacagctctggaggctggaaagtctgagatcagagtgccaggacgatcgggttcgggtgagggctcccttccaggttttagacctcacagttctccctgtgtcttcctccttcctcacgtggtagaaaaacaaacaagtcccttggggctattttgcagccattaatcccaagacctcatgacctaatcacctcctgaaaggccttacctcctaataccaacatactggggatgaaatttcaatatatgaatttcaggaaggggaggataaaaacattcaaactatagcagtcagcctgtctgaaaattgttttacctgaaattagtgttatgacttttcctttctatcagataagcaaatgtaaccagtttcttttgctcatctgataaaattattatgtaaagtattaaagaaaatttctttagaatgttttaaaaatatttctatataaaatgaaaatttgcaaaatacagaatagggtatgcaaccagccagagaggaaaacactgttctcatctattataggtatttcattttcacactttaaatgtatatttatatatcatagaccacagtttattgacaattttatattttacctttttaaagtattttcaatgtttttaaaacttttattaaaagttgtttcttctctatttacaaatactatttcagcactaaatcaatttaccatagttcatttaagaatctactgtgttaaaatttgagttgtttgaatttttttctgccaaaaataatattgagattacaaccatggtgcaaaaataattttcttaaatttaaaacagataactagaaatgaatataattgggtcaaagattgtgaacttttgactcaacccacattgcataaagccacaccacattccacgcccactggccgtgtatacaggagacggcttatcctgctagtttcacctgatacttttcaagtcatttcaatcttcaagtgctttttaaaaaaacgggctatgtaaaagttgaaacgacctcagatgtgcttcctgatgcaaaacatccaactaatgagctgagcatattctttttatgctctcgcacctgcagtaataaacgcaatgaccactcccccattcgaagatcctgtatttcagagagcttatagacaaggccacagatcacggtgctagcactggaggggcggtcagtggagggttgactgatgacctgtggttctattagagatcctctgtctcctgtgtgtagcaggcaggaggcagacattattatccacgttttataccaaaaaatatactcaggattagggaaagtcaatgatatatattagtggctgtgcctttcacagtcttcttcctcctcttatggaaagcaatccaccatcaggttttattcatttttattaggcatttattttttttagggtcctgaatgactttcatgtcaaagtgaagaaaaaaataatacaaggctgggcagatccgtgaacagcactgatctctgagtattgaagaccaatgaggtgtttcagaaatggcccctgtgtgctttgttatttgccgaagaaatctctcctgggtgtctcttgcaatgtaagagcttgagggcggaatccttgtctttggtgtgaaaaaggaaggagggcagcgaagggcagagtgtggaatcccactgctccctggctcccagcggctcctgtctctgcatctggctggcaggctctccctctgggttgaaggagaaggaggcgaatgctgcaaagggtcaaagcgcttccccagaaactcagccctttgtttccagtgactcttgtactccttcaaggtgaatagaaacttttatgtgagtgtttcaaaactgttataatcagtttgtcctacatataaaagtttgcttcccagtttgtcactggtgtggcctcttttctaaccagacccggattactcgctgtttctggaattcactccttgcacatccttctctcagcctttgcatgttgtgtttctcccatgccagctgagctgtcttttttctcctttacctcttccctgacccagccccaaactaaccattcttcttcaaactcactggtagggttcacattctgaaccagagtaatgctcaaaatattcaccaggttctcagaggtaaagcagggtcctggagcccccaggctatgctaacccagaaacctggagttgctacattgtagggaggcctagagagcactggaagacaggcaggcaagcccaggtttcagggagccactaggagcttgggaccagtggctacatatcaagtaatatggaaggctgaaattgttaaaaatggaatcaccattagcgcaggccggtatgaacctgctgcataccctccatgccttatcaactccaggcattgtggagcacagtgctgagaaaaactgtagggctgtattcagagtgggtagagaaggctactgtaatctgtaagcagtgtctaccacagggtagggcagtggggagtgttgaatgtgctgtctgcccaccctgtccaggtgcactccttgtcccaccttctcctcagagcccctttcagactctcagtttcataatacctttcttgctgtgaatttcatatgtatacaacatggcataacttagcatttgagtcattattgtcattaaaatgcagttattgaacatctactgtgtttacagcaaatgatccttcttttcaaagagaagcatcctctctgctctcagaaattacacacctggcatggtcttatctttgtagaactcagagttcacagcagatgccctggccttggccatctcctccgaactttctgctctcctggccaccgtttgacagccacccttcccctttttatctcatttgcccttatggtttgacccttactttttgtttgtttctccatcttgatcactcatcacaattctggtttcccatttggcttttccacttcctttctttcaccacaactccagcctgtggatcccgacactacttccaactaccacagccacagccactgcaccaggtggcaagactcaaacacagcttataagagctagaaaggagaaatcacagggatagtaagttcaggaaagactttatgtaagtgcaggaacttggcttggatatggtagatgcaaaagctcaaggtgggactgtgggaaacaacaaactttattctagtctatttctttgcaagagttattcctgtttccctaagtatataaaagaaacacccttttatgtcactcatggtgttaaatatgtgatatacggtcaggaaatatatatggatgaaggcactaggtgttgaggaagagaataatctttgaaggaagtaagattaaatcccagccttaccacgtaatggatacaaaatttagataaagttttttaagctgtctctgcttcagtgtccttcatctacatggtagagataataatgcctactttacatatataaagtgactcctaggatattataggcattgaatcactaagagctgataatattatcataattatttttatagcctcactctgctcaccatttcttctcacatgttccccatgaagaccatagtcctgtgagtaatctctagcctgctcgacaaatggccttttagaagtacaacactaaaggttatagatcagtgattattagtattttatagggcacacacacccctttaagaatgtaatgaaaactatgaacacattttacttcacataacatttttgaggcttcattgatgcctgtgaagctcatccacagacagcagcccaagaactccaggttaaattttagacaaggaaacatttatatgtaaaataaaactgtgtttttataaattcctaataaccttctataagtgttccttgttgaatcaccaggacgcctagtaagtagggaccggacactggatttgttccatataagccagttgggcgggcttcttagaaacgcttcaccttttgtcacaagattcagaagacatctctatgtgtcaagttctgagttattagaaaatgcaaaaaaaaaattatataaaagtggctttctagtagaaggtgggtaactaataaaacaggtaaataggactccaagttgtccagaaatagcatgtgcaaaaaatcaggtactttctctagcttgagatagggtggactgtgaaggaataaggactagaaatgttctctctgcccacctcccaggctgagattcagacctcttcaagtaggtgcagttaccggccgggcacggtggctcacgcctgtaatcccagcactttgggaggcccaggcgggtggatcacgaggtcaggaaattgagaccatcctggctaacacggtgaaaccccgtatctactaaaaatacaaaaaattaaccaggcgtggtggcgggcacctgtagtcccagttactcaggaggctgaggcaggagaatagcatgaacccgggaggcggagcttgcagtgagccgagatcacgccactgcactccagcctgggcgacacagaaagactctgtctcaaaaaaaaaaaaaaaaaaaaaagaagaaggtgcatttaccggggaacacatagcatacagatagcaaagaagcttgccggaaaacttaggtcccagcttcctgcagaagctgacggctgtggggagactgaagctggggtcaaccatgcagattccctgggactcccactgaagaacagtaatggaggacaggaacctggaagcatcttccagcctctgtcaccctgcagcggccctctagtgccccttatggacaaagcataacattcagccagtagacaaaagagaaatgtttgcagggtccaactccgctaccgtttgattgagcaatttcactactaggtgtctacccagaggaaaataagtccctataagagaaagacacttggacttgcatgtttatagcagcacaatgcacaattgaaaaaatatagaaccagcctaaatgcccatccaccaaatggaaaaggaaaatgtggtatatatgaaccatggaatactactcagccataaaaaggaacaaaataatggcatgtggagaaacctggatggaattagagactattattctacgtgaagtaactcagtaatggaaaatcaaacatcagaagttctcacttataagtgggagctaagctatgaggatgcaaaggtataatcataataaaacggactttggggacttgtggggagggtggctggagggtgagggataaaagactacaaactgtgtgcagtgtacactgcttgggtgacaggtccatcaatatctcagaaatcaccactaaagaacttaccgatgtaaccaaacaccaccaatttacacaaaactattgaaataacacttttttaaatgtaaaaacaaaatgcagggcaaagaagagtggctttggaactgaacttcagaataaataattagcacaactgccaatctcttttcttcttttaaaaatttgggttaaaaactagagaccttggacatctggaaaagagagttgggaagaaacaaggagacatacacatattcacggtttcatatgtcacctgatcacagttttatgcaataccagcatgtctcacaaatgtatgaagtccaaaaccacaagtataggcctaggctcttgtaattagtaaaatgtcaatttatttaactttgtcattatgtatatgctccataaaaaaatagtgaaactactacttttattataggcccatgtaatttattacattaaaatgcatttctcagactcaaaaagtttagaacactgtataggtggacatgaattagaagtactctaataatttacctgtctacatgaagatttactgtaattctcacaaaaacttattcatatttaacctaaaaattgttttacatagcttattcttttccgctgaaattgttttatttccctgccacttctttctacgtttgtctaataccttagttcagctcatcactctaacagtacatccacccatggggttatccagtatcccccatggtggctagtgattacttcagtattttccctgatgctgtaacaaggtccaagatatgccctgtgtcagcctaggaagcaagctctctgaagcatattcaaattcatccccaaggcatcagggaaattcagtagctaaataaatatcttctctttaaaaatattaatgatcatttaagtataaaaaataacagattgactaggtcttcaagaatgtgactctgagatgaagaacaaagctaaatgaacatacgtagccttcataagccgcatttgatgtgtctgacagaaatttcgtatccaaacacattttagggtgaaggtatgctctgaaacccaccatttacttcatttatatgtgccacatggtggatgcctgtaaggacagtatgtttgtgcagctgaaaatctgatctttgttacagaaacttcaatgctagcttcccaaggtaaatggaagatccagcagccccagaagatgactttggtagaggattatatgtgcccatacacacggaatgagcttgcctagaagctcatttcatgtgcatgggcacatataatcctccatattgcaatcataatgaatgctttctctataggcttctagtaaactggagtgcattttatcaaacttttaattccttatgatgactggcaaagaccaagaaaatctaggcttttttttcccccatgtttttacccacaaaatcgaatgcttatactaggatttgacaatccacgacatttgggtaaaacttccagcttgtgacccaaagatttttgcaaccctcatgcacactacaggaagcagtcagtctccatgattcataagagtccagagatcattaggtctaagactgctctggaaaagtacaagaatcacagtcttctcaacaatgtaactcaacaaccaaactataagctaataaatatcttgtaaatcacattgcattaccattattcatgaaaaaataatacttatagattataggaaattgtgtaaacaccgaaaatcagaaagaaaagaagtcacccgcaattttatcaaagcaatcataaatactatacaggtatagattttttagtcttcatttcaaaaggactactttggtgtaattttgtgtaattccttttcttgttatcagtattctgccatgaaaataacgtgttgatcatttattacatgccaaatattgtgtcaattgatttttatatttatctattttaatcctcagaataaccttataaagtggatagctctttgtggtttcagtttgggaaaaatgaggttcggtaacattaaagtaacttccccaagatacgtaactagcatgtgatagaatctgctttccattagtggcctttctaatgccaaatctgtgcttagctgctgtgatgtgcttaacacacgttttatattttgctctaatcactgagtttctaaatgttaactaaaatgaaattacattataaaaatggtgatcgataaatgttgaataagtgaatgcatttttaataagaagagaaatgagtaattttaatttcctgtaaagaagtgagcacactacaaattggaggtgcatagtaaatattcattgaagcttatgttgtgatgattataccaagatgaacttgaaggatctgatgaaaggtgaagaagaatgtcttcctaagggagcatcttctcatagaaggctgagcctctctgtacctaaagatctccatatacacttaagagatctgttgcacagtctgactcttagctgcctggagatagagtgtttgaagattgtcttcacgtgtctccctccactaaatgttttctccttccctgattcagcagaggtggcaggacctaattaaaaagagccctgtgtgtggcagaagatgtggcttctccagtcaattgggccactacgtagctagtggaatccattgtttaaagttcacaatgaactcgttctttctggtgctttccatgattgagaattatgtcctctggataatgtctaaaatacttttcaactcagcggtttcattaagaaaaactattaaaactccttctatcactgtattagtctgctctcactgccaaaacaaaataccacagactgtttgactaacacaacagaaattattttcccacagttctggaagctggaagtccaacatgaaaatgtcagcagggttgattctgagggcatctcccttggtctgtagatggccctcttctccctgtcttcacatagtctcctcattgggcatgtctgtgtcctaatatcattttcttataaggacaccagtcctgttagattagagtctatcctaacagtctcattttaatttattcacttcatgaagtgtactgtttccaaatacagtcgcattctgaggtactgggggctgggccttcaacacatgaatttagaggaaacacagttcagtccacaacaattagactctgcaaaccatctaaagagcttgtgtgagcagtctttaagacctctcctccaactccacttcctaaaacaaaactaaaatataggattttcagctccatgaagtagtcaggtatccagatccttctgaccctctgcttggccattccaaccctccatcttccattctgagagtcccaataggctgctggagcttgaggtattctatctgcatgccaggctgcagaagaaaggaagaagtgaaggcaaaggggatattcctcccagctgagtcagctcccttcaaggagccttccagtaagtcccatccaatgctccttccatgccatgccttataggtctgacttagtcacctgaaaatacatgtctgcaagggaagtggggaaatgtagtcatccagttgagcacattcttgcctcaaacaaatcattatttcactaccaagaaatggaggaacaggcagagtgcagtggcttaattattattaattattacacctgtaatcccagcattttggaaggccaaggcaggcagatcacctgagatcaggagttcaaggacagcctggccaacatggtgaaaccccatctctactaaaaatccaaaaattagccaggcatggtggtgtacacctatagtcccagctacttgggaggctgaggcaggagaattgcttgaaccagggaggtggagtttgcaggggaccaagaaggcaccactgcactctagcctggacaacagagcattgttgtccatttcagaaaaaaaaaagaagaaagaaagagagagagagaaagaaagagagggagggagggagggagggagaaaggaaggaaggaaggaaagaaagaaagaaagaaagggaaagagaaagaaagagcaggaataataattaatttttgttatataactagggatctttccacaatctctttgaacaataaagatcagtatataagagttcttatgtaagaagtaaaacaatttctaccttagtgtcaaaattggcaaaactatcattactattataatgatgcactagatttgtgtcatccaatatggtagccactagtcatgtgtaactattgaacatttgaagtaagtatgtctggtgcaaactgtgatgtgttttaaggcatcccagatttttaagacttcatataaaagtaaaataattttatataattattatgtaatgtttttaataccgattgtatatttaaataatatttgcatctactgagttaaataaccctgtattaaaatataaattaagttactctgttttaaaaaaaattttttttaaatactgctactagaaaattttaaattacttatgtggtatgcattatatttctattagacagcattgacctgggatatcaccccaaatgtcagtatttcagtagcagatttccttttacttttttattttaaaacatttaattgaaaaataaagatagtatatatgttcaaggtgtacaatgtgataatttgatgtatgtatacattgtgtaataattaccacaatcaagttaatcaacacaaccatcatcgtctatgctgtaaattagatcccaggaacttgtttgaacatcttataattgaaagtttgtaccctttgattaacatctctccatttctcttaccctctaaccctgacaagtactgttctattctctgctcctgtgagcttgacctcttgagataccacatatttgcctttctatgtctggtttatttaactcagcataatgacctcctgatttattcatgttgccacaaatagcatggttttcctctttcttatatatgtatgtgtgtatatatatattcttatttatgtatgtgtgtttatatatatacacacacatatggagagagagagagagagatgtcacaatttctttattatctgttgagggacactaaggtagtctcatgttttggctattgtagataatgctgcaatgaacatgagagtgcgcatatctctttgagatactgatttcatttctttcagatgtatactcagaagtggaattgctaatatggcagatctaccttttggtttctagggaacctccatgttgttttgcataatgcctgtaccaatttacattactaccaattgtgtacaagccttccctttctctacattctcaccaatacttgtacctttttttttttcttttggatagcagccaccctaacaggtatgagatggtacctattgtggtttcaacttgcattgtggtttggatttgcatttccctaaacgattaacaatatgaatacctgttggccacttcaatgtcctctttggaaaaatctctagtgaaggtctttgctctttttattatattatttgggttttttgtttgtttgttttgttttttgctattgagttatattatgagtttcttgcatattttgtatagtaccctcttatcagatagctagcttgtaaatgttttctcccattctgtaggttgccttttcattctgttgcttcctttgctgtgcagaaatttgttagtttgatgtaatcccacatgtctatttttgcttttgttgcttgtatttttagtgtaatatccaaaatcattgcctagaccaatgtcaaggatatattcatctatattttcttctcagagtgttatggtttcaggtattatatttaagtctgtaatacatttcaagttaatttttgtgagtgttgtaagacaaggacttaatttcattcttttgcaggaggatatccacttttctcaacaccactggttgaagagactattctttcaccactgtgcaataagtttatttctgagttctgagttctttgttctgttgatctctgtgtctgtttgtatgccagcatcatactgttctgagtcctatggctttgtggtataccttgaaattaggaaatgtggtgctttcagctttattttttcctcaggattactttggctatttgaagtctttttcggtttcatacaaatgtaaggatttttttattctacttctatgaagactgccattggaaatttgatagggattatattaaatatacagatgactttgggtagtatgaacattgtaacaatatttattcttattactcgaacatgggatatctttccatttttgatgctattgtaaatgggattgtttattttattttcatatagtttgttgttagtgtatagaaattcaacttatttttgtatgttgattttgtatcttgcaactttaggaatttatttattagttctagcaaatttttggtggagtccttatgattttttaatatataatatcatgtcatctacaaacatagataatttacttctttctgatttggattttttaataattttactttttcttgcttaacttcttaggctaggacttccagtaccctgttgaatagaggcagcagaagtggtttgtcttgtttctgatgttagatgaaaagctgtcaacctttaatgttaagtatgatgttagctataggtttgtcttatatggtcttatatagcctttactatgttgagatacattccttctacacctaaatcgttaagagttttttcatgaagggatgttgacttttgtcaaatattcttttctgcgtctatcaagatgatcgtaagatttttatccttaattcctttaattgatttgcatatgttgagctatgcttgcattgcagcctctccttatttaatttttaattaaaaatatttaattattattatcattattattattattttgagacagaatctcgctttgtcacttagactgaggtacagtggtgtgatctcagctcactgcaacttcctccttccaggttcaagcgattctcctgcctcagcctccctagtagctgggactacaggcgtttgcctccatgtctggctaattttttatatttttagtagagacggggtttcaccatgttggccaggatggtctcaatctcctgacctcgtgatccgcctgcctctgcctcccaagttctgggattccaggggtgagccaccgcatcctgccttaattaattttttaacttaaaagtacttcattgaagataattacacacattccttcctatgttataaatattactgattaaattgagaagttgacttctataacatactcattatttgttgatggtactttcccttcacacacacttgctatttgttctatttttactcaagaacaaaggtactcatattttcagagctaagaatattttttcctgattaaagtgaatttagtctagaaaagcagcatatacttgtatgtgaagtggaaagttgttttgtttgtgggctaaaaaaagtagtttggagacaaaagaaaaccataaatacacacacacacacacacacacacacacacacacacactccacttccttcagccttatgtgttagtaagggttccctagagagaatcaataggagactgtgtgtgtgtgtgtgtgtctgtgtgtgtgtgtgcctgtgtgtgtgggtgggggggtaggggaaatgattcacatggctgttaaggctgagaggactcacaacatgccatttgcaaggtggagacactgggatgtttatagcgtgactaactccaagtttgaaggctggagaaccagggaagccaatagtgtaactctcaggctgaggccaaaggcctgagaacccaagggggtggggtgcaccagtgtaagacctagaggccaaaggctgaggcgcctggagttgttgttcaaggacaggagaggaagagtacatcccagctcctgcagatagatgaacatgttcattttttctgtttttgttctctctaggcccctagcaggttggatggtgcctgccaaacctgaggacagatcttcccctcctagtgcactcagactcacatgtctcctctggaaacaccttcagacacacccacaaataatgctttaccaggtttttaggtattccttaatttagtgaagttgacacctacatttaaccatcacaccttactgttataatgacttgttgcttttgccttatgtgagtagactggacgcatgactaaagattgcagtagaggagacaagcaattctgaaattatgcaaaagtagaaatcatttgaaaagtagtagtcattgggtttcaaacctagatgcttctattcctacctggattacctgctattatttctttcagcaatctacactaatttcctaatagcaattactgatcctgaatatttttgtcatgaaagccttcaaataaattcacatacagaaaactgtttaactgaaactcctagtataaagctatacctctttattttaaatacattggaaatacaaaagattttaagtatggaaataaaaattgccataattccaccacccagaaagagtcactatttagtatattagtcatggtcctatgcctacatatttatatgggtatatttcacctgattcatatgtgtaaatttgtattctatttgttcaatttaatgttataagcaattttcttgcttgccataaacatcgctactagtggtggcaaaatagtttttcatatacatataccataatttacttaaatatttatataatttcagacccagttttttattattataaataatggttctcagtgtgtaaatcttagtccaatttcaaattatttcctgaagacttctagaagtgaaagtagagtgtcaaaaggagtattaatatttttgagcttcttgattcatagttccaaatagctttgtgcaatatttgctaacggatattaaaaagtagatttgggagggcaaaaaaagaagcaaagacaagagaccatctctgaggccaaaggcagcatgtggctctagtagttccctgtttactggtgcctgtgcataggcagctgctgagaggccagaggagaggtcatgcagggcaccatcttctagcctgtccatgcaccatggccattagcagggccttccttccatttctaaaaatgtgtctctcgtggatgtctctcaaatgaaaccctaatgtgcacgatctttatccttgaaggcctcctttggcagaagcagaatgttgcctgtccatagtaatgccacttgtttagtttcacttaaattcctaacatgtattatggacttcttttcagtacttgtcctttccggttttctcttcctccacccaagtcctattcccagcttcactctcttccctgttttctcttcctccacccaagtcctattcccagcttcactccttcttacttgtcctacaaagctcaaatccaaaggcacctcataaagccctgtaacaatgctttgttacatgctctcccagcagaatacgtgtctccctcatggcacttggtcatagctgtgatgacatgttccatgacccttatcctactgccatgtaagctctaggtgggcgggtctgagtctgtctcactccttcactgtatccgtagtcatgagaatcaaggtggcccatatgaactgcttaatagagaactgctaaatagagaactgctaaataagtcaataaaaaaatgaaggagcctgtctttcccaaaaatgaaaaagagccttgatttgattcccgagtcaccctgagtttgtgaataggaaggtagcttgagctcacagggcagtcttttccctacatttgctgacagcgtgccagtcagtgctggtagttctcagacaaatcaaattagaaatggttgtactcatttggaaaatcaagaactggctttgaaatctttccccgcaaattagattggatgaagatcattttctccagcttataaatgcttgattggctttgtttgatgcctcatgactgaagctcagctttgcactgctagctttattttttactcaccagggtgttgtggcgtctagatgatgattaaaaacaaaacaaacacccacaatgaaaaagttttgtaaataacagctcagcacagtaatgtaacccttggaagcgtcacacataagaaacttgaaaaatagccaagctaagcagaacttcaagctgggcctgctgtattctcttcaggtcttaaaaattagtttcctggagtggcgggacagccacacctgacttactatttcctctcaggaataatgaaggacgtgccaggatctcactgtccctacggtagaggagtctcaatgggagcagactgtctgtcttccttccatcttcttcaccaacccatgcatcccctttctctggcttctgccttagtcacctgattggattcagatgcattctcctttcagtcgtagcctatccatagctacctggatgtataacctcaggtcttttttcaacaaagagtagtcccttattcttgttttattcttcccaggtgactcaaggtcagaccagagctttactgttgagctggtaagcagtgtttgaagcagtggtgacagcctggttgagaatccgctagagaccatggatcttgcatggtcctcacacgctttttatttatagctttttttattttcaggttttcatttaaagcagagcagccaacaactttctggagtcttccacaaaatagctaaatggcttgagtcactaatagtaaacagtaataggtgtctttgggtagtgaaaggagtccaaaaggaatgtgcttgaatatccaaaataactgaccaatgtttgactagaggtataatgcccactaatagaaacacctctgagccatttaacagtgatggttcactttagcataacctattgtctatgcagccaacatagggttggcaagtaattcagtaaaagtcttgaaagaggatggactcctagcagaaatataaggcaaagccagcatccaaatggaaaattcaagcagaattgtcttttcttgctaagttctaaagtttttcatgtacatcaatgacctcaagtgaaataaccaaaggattatgtttaatcataaagccaggaaatgagtacaaatgaagccatttgttaagaatgtctctcttctcatttctgataggtacttgttctagcttagtaaattatggtttctatgccacgtgctgagacctggcaaaaatacccagtgaccaatgaacatacgagagtccaggtttaggaatgtttgactaacatggaggcctgagctccctgttcaatacatttcagtctattctttctattatacaatcacattcagaccactgcagtggttccatccttgtgtctatcagcagagcagcatcttctgaagttcttcgtctgtgtaacagataagtgtaaattcattcgattggttctgtagtcacatgacaaagacttaactactactgtgttctctgtgtcaaaagtcttgaggaagtaaaccttctgccatgacactcctgtccatcagtcatgagatgatcatggtaattacactattactgcaatatctccttttggatgagtttctctgcgacagaggaaagcttttaggtggatgggttttattggatttccatcagcatatggcacacttctggtttagtggcagaatggcctgaatacgtcttcaaggaaggcgctgcttagaaacttcattctctctcacggtttgcttctggttttcattgcatagtccctgaactggcacctgtctaagtggctgcatataatttctcccattttatcttctgcaagaaagttgcaaccattgtagttcctcatacagctcagcattaatctagctttctctttgtaaaatattttaggctacagtttctggggagggggagggaaggggaaagcataatcagtcaattggttattatactcttgtaagtgtgttttaaaatatcaggcttcttatttactttttaaatagagattgggtctcatcatgttgccgaggcagatctcaaattcctggattgaagtgatcctcccacctcagccgttctaagtgctgggattacagatgtgagctaccacgcttggccttcttatttctttaacacgtaaaaatatatcatcttttgctcacttactttttattttaatatacttatcatggattgtgattcttggcctctttcctgcatcaagacaggaattattagggaagaggcctaagtttccctctttagagcctgcatcattcaaagaaaaagtcttctaaaatgtaaatacttggttacacttctcatgccaacaacagaatgattcagatgatccccaaatcctctccaaagacaagacagatgttaaagatgtgggtcttcagtctcagatacccaaggttagagaaacaagtgggaatattagggccctccagctcaatagcctcaggttacaaaaaagaaacctaagcctctagaattgacttacctctggccacccagaaaagcatcagatctgggaaaagggagaaacaataagccaggagcaatgctagatacattgcacgtggtctcatgtggtcttaaatcatcccactactattattccccagatcatgaaggaaacaatgaggaccagagaaaggcatgtttttttttccctaaatatttgtaacaagaatctagttctgcctaaatttaacaccctcacttccttcagaattcagagcaagatgatctataccaaattgtaaacctattgtgtaaggcatgggcagttatcaaaaagtagctaattattacaaggcagtataagaaacataatagatttccacaggtagcacacacgactgtaagcccatggagaaggcagccactgtgggatggatgtcaggaaaggtctgggcatgggcaagcccagaaggcttgctgggccctgcagggcaaaagtggggatggagggtgcagaggaatgaagaggtcatgcctggtggaggaaggaaggcacaacgtatgtctagaggacagctttgcttttagtgtgtctcttcactctagtgagggtagtgccgatgacgagggacacaatccaagggaggtgatggtctatcagtagtcagcaaccatctgtgctttcctgtttgaaatccattgtactctcagagaagaatgggaaccacacttgcccctccagcaccttcctcagtcaacactttctatcaattgtactggcaaatttctcatagatctgttttcttttctcactctcccacattgttattggtattaatcagtgttctccagaaaagtagggccaggatctctatatatgtggaatacatatatgaaagagaaatagatttgaaagagagattgagatttataatgaaaaattggctcactggactacagagtctgggaagtctcatgatctgcagacccaggaaagtcagtgctggtctgtatttgaaggcctgagtaccagaagttgtaaatcccagcctgaacgctggagaagacgagatgaaatttcttgatggagccaagaggaaggaaaaaaaaaagtacaaattcctccttcctgtgcattttactctatgccctcaacggagtggatgatacccacccacattggggagggcactgtactttgccaagtccaccaattttaatactaatctcatccggaaacacacagcgccacacccagaaataatgtttaatccgggcacctcatggcacagtcgagctgaccaaggaaagactgtagtgggtctctagagaagtgttgaaaaaacagtattctttacaattgttagagaagataacgggggctactaaatggggttttatagtagcaggaaagattgggctcagctctgaatgcaataaagaaaagtggggatttatagccaaggagtagggtgggggtcagggaatggaaaattacttagaggtagggtacttctttgctaaactagcccaacaggagctttgttgaaggcagacaagtgtgataatatatccaaggaggtcagaccaaggtgggaggttttggtatactgaactctgcagaattcttgctaaaactggaaaaaacgggacatggacagagcccaacatcacacctagtacaagggaggactcagaggagcctggctagagttagatcaaggaaagagtcttttgccagaaaaaacagacattgtctggggatccctaggggcaaatgtctactccatctttggcccagcacttctgaacatcttggctgttcgagaaggggcatgtatgacagtgaaaatatagggcactaagaactaccatcttaggaacaataggagacctacacttggcgggaccagtgacttgtggcagttgctgccctgggtggtctcattatcatctggaacagcagtcacagtcagacagaggagcccacggttcaactggagctttgggggtgtggtaaggaaaagcactcagaccccaaggatttccttccttccttgaagactgacttcctttttggacaatgaaagaccctggagttcttataagatatagggaggaaaaaaaggacccatggcagctcactgacttcctttcaatctcacttatgaggtcaaggccagtggttttaccttgaaggtttgatcaatgcatccttccttgccaggcatactttgtaccaattacagtaaattagagtaagtacataaagtgaatttaattactacagcatgcaaaggatcaggtcacatttatgtgtacaattaactaatccctgtgcttagcacaattttataatgcttgaaaaatcttgaatgaatgttgaaatcttgaatggaattaaacatacagagggacaaatgggctttggggaatgaaacttccttctcgggaataggaggaatgatatttgagaaagagattaaaagatatatagggtagaatataggccactgaccatttgccatgtctcctttgacacaattctaaagtaatgtcttctcacatggcttttctaaatggccggtgggaacttcctcaaatgccgtcttgagacagattctggagacacaaatggcactactgaaaatggtcagtccatgttgatttcaaaagtagcatttttacatgcagttcatttttcttttttctcctccctttggtgaataggggtgacactgatggccctcaacactgtacgtcatttctgtcagcagtaagcacagctgagacaggactgtcagaatagtggcacacagcagctatgtgacaggaaactgagctgccaacactcacgtgagcccagagagctgggtcagattctgtgtagaaggaatttcccatccacccacatattttctctcctacttgcctttggatttgcccttagagaatacagtagaggcatgcgctaaagacaaagaagttttagatagctggagtggcttcacaggggcaagaatgatagagggaagtgtgaagggaatcgggggaagggagagagaagctggcctaaggtgagcgagggagctgtccaaggaccgaaagcatatcccagtgcatttcaaagttttcctgctttctgttgagctaggtgtgcatccccactcacaaccttatcttaatagtgacaatctctgaaggcatttatttaaagcccttgctctggagaaccaatccaggaactccttagattctgagcaaccctgtattgtgctcaagaagttgggcccattaaacaatgaaatgaagggagactgaggaaagagagccaggcctctggtcagatgtgagcaaactgatcaaataaggaaagaatctcaggtcctctactcctccactgtcctgaagccgccttccatggctgtgatccagagaacactcagaagagggcttgggtgaagctaaactgggttttagataactcctggaaaggggatacttttgcaacctcctatgcctttgccttcttcatctttgtgaacattcccactctacacaacctcagactttgaatgcagctgtgttctggcagatttgtttttacaaaaatgatactgacctcaggaaaggaaaagataaataaaagttattactacttcctagcttctctgcagagcatttgtgatttggcttcttccaaaagacagccctaccacaatgagttggccatcattggtgatgtttttattcttgaaagggaatttaccagagatccaaaaatgcaaattaaaacaactgtgagataccaagagcaagttggtggatttttttttaaatggtagcactcagtgcagaggatggaggtatcagagatggtggctaaaagcaaaagcctccaagttagacaaacatgggtttgtctcccatgtttcctgctaactaggcacatggcttttgctaagttatttattctaagtctggcttgtgcaccctttaaatgaagaaaataatacattacggcattgttgtgcagaattcacaagatatgtatgtaagtgcctatcctattgcctagcacggtggggatgatatatactgtgggtgattgcttgacggatatcaaggtccttaccctttgacacattaattaacttgtgaggatctagcctgaagggaagaaaacatctaaacaactacaacaaatgattcatgcaataatatgctcatagcagtgtgactgatggatgaatcattagaaatgtgctactggtagaagtttggggactgctattcattttcaagaatacaagactgtcataaacaaacatggttggcacctacggatgttcttccaggtagaggcttttggaatcaaaccactacgctgctctggaactgagaactgtactgcgtatctaactctgccacctggccacttctgtggaaagttaaattcaggtagccattcaggttagggcattccccttgtgggatccttaccttttttttgctatgcaaagaataatcttcttactcttcttttgggttcgatgcacacttaatattccccatgaccagtcctttcatctactcctcatctatgttattgaaaatacttttactaagttaaatatatggcccatgtcactgcactgtttctaagtttgaatgaaaaccattcaggaagcatcagagggctttcaagctctgcctctcttcacctttccagacttacctcctttatgctacccggaccttcctgtcccacgaactacttagaaatggcagtttccctggaatttcatagggatgctgttttgctaatttcttcaagcctttgctgaaaatgctagtcaagttacccccactccacccctttcctaattccttcctttgttttgttttccttcgcataacctttgcttgtccagttatttctcctgtccggctcccgctggagctagtatctatcccttttttagcacgttccacattgtgagcttggcacatagttgacttgccataggtatttatataatgagtaaatgtaattatttttacgccccttagaaagtgtggatacttccatcccccttccttctgggactctcagatggccctctttgcagatagcattgtgatccttaacaaatgagcggaaaacgatcttgtgagtgtgtctgagcaaagccgacatttttttcttctttaagatcttgccgctgaatgtggaatgatcctgaaattaaggtcagctccaggtggttgtttatatcagctgtcagattgcggaataaaaaatggcttttatatgtttgacttttattgttttccagggcaatgtcactttttcctgctccgaaccacagattgtgcccatcacatttgtcaactccagcggcagctatttgctgctgcccggcaccccccaaattgatgggctctcagtgagtttccagtttcgaacatggaacaaggatggtctgcttctgtccacagagctgtctgagggctcgggaaccctgctgctgagcctggagggtggaatcctgagactcgtgattcagaaaatgacagaacgcgtagctgaaatcctcacaggtactgtctgctgacactctggatcagcttcttgtttatccaagtcgacaaaggttgaggtcctgacaaaaacatacagaatccaaatctcagggatatgggttagcccagtattcacaaatgtactccaagtctgaagaggcagcatttttttttttttttttttttttgaagatggagtcttgctgtccccaggctggagtgcagtggctcgatctcagctcactgcaacctccgactcctgggttcaagtgattctcctgcctcagcttcctgagtagctgggactacagatgcacaccaccacatccagctaattttttttatttttagtagagatggggtttcaccatgttggccaggatggtctgcatctcttgaccttgtgatctgcccgccttgggctctcacagtgctgggattacaggcctgagccactgtgcctggccagcatttttttttcttagtaggaagcaaaacaaaaagtgaatttataattagctatgtcaactttggttaagtgcttaaatttcttagtctcttagcagtctcattggaaagatgggaataagaattcttacctgggagtatttagcataatctagaccatttatagaactctctgctaggttctctataaacatggcatgtttcatatggaatcttcaccatgcttacggaaggaagttactattttacacttaataaatgaggaaatcagaagtcatggcaatcacttcaaaattccacgttcctaagtgatggagctgggaatttatcctgaatttgcctgacttccaagtctatattctcctcttaaaccacattaccatggaagtttgtataacccctaaattctatttcaagtaaaaatcagtaaatttaaaaccatttaaaaaatatatatgtatacatatatattttaaatgtattgagtaaatgctagtacatatgacaccagggaatgggaaaacttttaaatggtcctcaaatggccaaaatttgggaaacactgattcattgccatgtactacagatcttactgcctagcaatacacagcaggtcggtgaacaaattgtatttctggataccctggctcctccagctgctgtttcttcaacatgaaacagtggaagtctctctctcattctctgttatgttaccaatctctgatgtccttcaagcagcggtgtatttactaagttgacaaatactcattgaggtcaaatctcacatgccaaggattgggcagggattggtctgcagcatgctgatcgatgaagaagttctttcagaagtctccctgaataaacaatctgaataaaaacctccctctgcttttcaccgcaggtcaacatccatcatggattatactacaatttaatttagatgcctttttctcaactggactgcatggttcttttatccaagtagattagcaaaaattaagttaaattgtaaaggatatgacttaatagttgtcgacctaaaaggaagaagccaaggcaatattaatataagtagatagtttatttgggccaagcttgagtattgcaacctgggaatatagattcaggttgccctgaatgtatattctgctctgattagctgcagttagaagcagacttttaaagaaaaaaaaaaaaaaaaagaggcagtttctatgttgtttatcagaaatttacattaaaatcataccagctaaagattgcctgtgcattgttctttgtatcgcagattccaggagcaagaagataatgggtgaggcaggtagtcaggaaaaaaaaatgactttaaacaattgcctggagcatgggtgccttgagctcaggggaagggtgtgtgactgaagtttcatactcatgcctctctgggcccaatatactttgcatcactcacatagttcagactgctctgagctgtttttcttttctcatagttatggtcatgtcagaccgtgggagacattcaaatgtccatagtgaacaaaatggcccactgaacccctgagcatagcagaaaggcctgagtctggaagtcaggcagtcaagtttaaaagtattaatatgttttctccttcctttcctgtggccctggataaactttgtctcatatgcaaactgaattgtattagttatctatagttgcatatcaagtgacagcaatatttaatggttgaaaacattttttattatgtctcagtttctgtggatcagaaatccagggacaacttggctgggtgactggctcagagtctcccataaggtcacaattgaattgccaatggggactgaagccatggcaaggttcaatggaggaagatctgcttccgcactcactcatgtgctcaggaaggccttagaaaatccacttccacatgtagggaagtttacatttttaccctcaagttatttgagaataacttgagtctataaaagaaatgaattacagacaaattaacaggaaaaaatgcacacacattttattacatgcacacaggagtcacaacgacatacaaaatgtaaaagcccaaagaaatggcagatggttgatgcttttatatcaccttgagattatagaaagaactggcgtttagagcatggccaaaatcacgttatgggccaggcacggtggctcacacctgtaatcctaccactttgagaggccaaggagggcagatctcatgagcccagaagttcaaaatcagcctgagtaacatggcaaaaccccatctttacaaaaaactgaaaattagccgggcatgtgggtgcatgcctgtagtaccagctactcgtcaggctcaggtaggaggatcagctgagcccagggaggccgaggctgcagtgaggcataatcacgccgctgcactccagcttgggtggcaaaatgagatcccatctcaaaaaaacaaaacaacaacaacaacaaaacaggtatggtagtaaatcaggttatgatggcaagacaggtaattgaggggagagaaaaggaggttctgtttaccaaggtggtcttaaaatgtaggtgaagccatacaggtatcagcccttagagagaataaatgacaaatgtttttttcagacttttaaatgtttggactctcagtcctcgatccatacaagggagagccttacagaaagccttgttgtagcaatgcaggttttctctacagatgcaagtcccccacaaaagacagctttgcagggctacttcttttggaacagccctctcaaaatatgtcaaagaagtacattttgaggtgaaatattttagtttctttcacaagcttcctcatgagcctctccagaaggctgccaagggtgagtgagaaaaagcacccaaatagaagccgcagtctttttataatctaatattgaaaatggcatctcgtcacttctgtcatattctattccttagaagcaggtaaatatgcccagcttgtgtccaaatggaggggatgacatcaggacttggatattagcaggcacagattatccaggatcatcttagatattgcctatcacaagagataaaaaaaaaattatgttggtgctggcaattaaatgaggtagtatatctcaaatactgaacaaagtgttgagtagctatttaacacatttttcttccttccgtgctgactcaagagatacagctagaaggggcctctttctagagagtcataaaagttaagaatgaatttgtgcagtcagacgatttttataaaatttattagatttccagtaatggaggtgagttaatcacttagaattgtaatattttttcatgttccaaattataaaaattaagcctcaatcctccttatttgaaaaagaaaaacgtgagctggcattgagctgtttctctatcggtgagatgtttttgagtacagagacttgtaggcctcaggtcaaaaatgaagttttaatacaaggaaggccctggcagcacattgctcttaaaaatccaggtgctgtctgtattgttaagcgcacgtcagtccattaaaatgcatttatgactgaaagagagcctggtaagagctgccaccttacccagctgcagaaagggaacaaatcatcagttatttcagacccacctctcagaaactgaaataagcaaaaagaagtttttaaaatgtgcaaccagagttccaaaaactcttgtataattctctcctaaggagaatttctatgtttttggaaaatttgaacttaatgttttttagaaaaggatcaaggttttgtgtattcttcgattttcccatctgggaggaggaagaactaacaaataatcaaacaaaaacagttttctctttccttacatttctgaggaaacttgttttcaaagtacttgagcttatattggctttaaaagaagatgaaaatctcatatgaacaatgaaaaaataatgacaattgttccaataatttttgagagtcaacggggctatacttgatgcttggtatgtcccaaatgggtcagagaatgcagataatcaaaggtttatttgagactagttctaacatcctggatctaaaagagaaggtaattcctttggaaagggcagtacaatgatgcctcacaccttcaaccctgttccccgagctttgtacagtgtgcttggctttttaggaaggaagtagttcttatttagggatttttgcattgaagatcaaggagagacttgcaaagtaaatgcatcctcaaaatagaaggcatctgaatttagttattctagggatgaagtttcaggaagatgaaggacaacagtggaatctctttcttgtatttttctttgttttctatttttgtcatctcctttttttttgcaagccttatgtatgtatgtatgaggaaaggtagaagacctcatttcactgtaagggatgtgaaagtagaaccagcagccattgtagatcttctgccagttaggcattgtgctaggggcttgtcatacaaaactgtaaaaaaactcataaaactttatcaggcggttagtataccaacatacatagaaagaaactgagaatatgaatttaagttaaagtagccaaagtgatgttcaacctcagctttttccttagaattctcaagttcatggtctttacacagtatcctgctgctctccatattcattgtgcatactgtccattgcttaaataactcaaatgtaaagaacctctgcttttacatctatagataatctacagaagactcttaaggaaagtggctatttaggtctaaagctgtgtctttcaaaaacagtttcatggtggtcttatacaagaataagacttggataagaccttgggattcacactagattggaagtctgttgtctttataaacttctgtgtactttagctaaaattaactgtataatattattaagtaaataatacaggaggctgaggcgggtggattgcttgaggtcaggagttcaagaccagcctcaccaacatggtgaaacccatctgtactaaaaatacaaaagttagttgagtgtggtggcgcatgcctgtaatcccagctacttgctactcgggaggctgaggcaggagaatcacttgaacccaggaggcagagactgcagtgagccaagatcctgccactgcactccagcctaggtgacagagtgagactccatctaagaaacaaacaaaaaagtaaattatatatctatatatctatatctatatctatatatctatatatctatatctatatctatatatctatatatctatatatatatctatatatctatctatatatatatctccatatgtcaacacacacacacacacacacacacacacacacacacacacaaatattcattggccactgcactccagcctaggtgacagagcaagactccatcaaaaaaacaaacaaaaaagtaaattttatgtatgtgtatatatatatatatatatatatatatatatatatatatatacatatatctccatatatcaacacacacacaccaacattcattgagaaaataggtcatactttcttcagactctttttttggtgctcagtactgattccttaaaaggattatcatctaaggatgaaggctgccaagtgacatgaggtctacttcagtaagggcctgtctacttctaagaacattgccctgctttctgcaggctttcccattctaattttccccgtgccccatgaaacaagattagatctctcagaattcaaactgaaagatctgatccatgtggaaagccatgagtttcactagagcagagaacaccttctaggagtcttgctggactgtgaaccttatctgaaaatccatttaggcaattctccaatgaatgagcaactaccttgataacctaatttatatattttaagctcccagttctttcttacttttcataaggtaccaagtgccatggggacctctcacatggtcatgtggtcatgaggctctctcaaactccataccctttcattgagcaatagatatcatgttctatttttaatgatggatgtggttgccgttttaaaggcttttatggagatgcttagaatggagtttagtatttttcaaaacaacctgaattactaagaaaacaggacatttcataaaggtaaaggagaccacctggtttgttttcttaggaggaatagggcagactgttttgaatgtcatatgaaatcataagcaatcttaagagataaccggcaccactctaattatctgaaagggatctgacatttcaatgttatttttatttttccgatgggaaaatacaaggcaaggagaatcaaaagaaacaggcatggagttttagcttaagtttttgtttgtttgtttgtttttgttttttgtagtgcttctcaaaatgtcagccagtctggccaaagagcttgaactcaggcttcagtggttgtgcgtcagcctacctgtgctctaatcagatgtaggacatgagtaagtcttgttccgttagcctcactgtcctcatttgctgaaggagaggatcagtctagaatcatggatgctccctccagcactattcatgatttcttgagagaaaacaataggccaacccaccccttattatcttcaaagaaatcatcaacccaaggctcttcttttgaaactggcataaatggtcctgaatgattgggagtacccagggccaagccccttgccagaggtcatgctacccaactcccaaaactctggtgcactttgtggagtcagaaaagtaaacttagcctatttgataccatgaattttgtggatgagttgcttgcatggtcttaaaaaggttatgctatgactcttcacaacctgtagagaattaggagacaaatatctaaacctgaatagggttttttttttttttgcaaccttccttaaatgtgtatatgtgtgtgtgtgcgcacatctatgttggtaggagggttaacaaaatatattaggtcttcaacctatgttagtagaggaacaatattggttgtaggtactgaagctatttcctgcagagagaaatccaggcagagacacagcaagggtctttggctgtgggaccggctttcttatagctaacggttggtatatgtgaacatctctttagaaggcaaagcaagcagcagtgaggcaggcagagagcccactttggattccattaaagcatcttctccccagagcttcctagatgcacagtgtactgccctgatgtcaccagaggcatcaaactcagcctgggattttcagtattaaagagtaagtctacattttaaatacatggttttggcacaataaaatgaaatccagaagggtgggtggggggagaatccaaactaagagatctgaccctggcgctggcaccacttgctcattattagctgaaaaggcaaaaggtgaagctaatcacctgggacagacaaaatctctggacaaaaggtgacatggacagcaaagagccagaaaccaagaaaataccatgaaaaagtgtctatagtcaaggcaaatggcttatcggaggtgccatctcagcgcatcccatttaattcctaggagcaagcaatagtgtttatcatatttcctcaaccaccgtataacatttcactctttcgataattccttgaacagtattagttagagataaggtattccaaaacaaacaaacaaacaaaaatgtaaaaaacatttaagccatcctttttatcagttaattttctatagccagtagacttctgtgactggcttgttctttctctagcttgaaatatggtgagattctcagatcaacagccataatgaatgttttttctgatgattattgagcattgactacatttacattaaataaaatatgtcatcctgtagctatggtcaacatgacacccttagctttcagaatttaatctcaattgatattttctcaagaaacctttccaaggcaggccaggtgccttgtttctttggttttcttctttttaacgtttgttactaagtatgtatatgtatgtattcatctgctcaggctgctataagaaaatatcacagtctaagtgtcttaaacaacagacatattttctcagttttggaggctacaaatccaggatccagatgttggcaggattgatttcttctgagggcttctctctttgcttgcagatggttgtctttttctgtcttcacatggtcttttctctgtgcatgtctgtgttcaaatagcttctgctcataaggacaccaaacatatggaaacttattttaccataattacctttttaaagatcctgtctccaaatacaattgtgtttttaggtattaggtgttgggactttaacatacgcattttgcagggacacgattcagctcatgcaatgtatattaatatgtctatttcattgttgaccaatgcccttctcatcactagaatgtaagcaaccatggaaacaagtacattatttgcccaagccttggtccaacaccttgcttaccacacgtcttccataactatttgccacacgcatgaatacactagtggagttgacctctaaaacatttctgaaagatagaattttaacagggaaagaagagttagtagtgatttttaacaaacagtcctgttacaacaattatatgccgcataatgtgtcaaacccaggaatgagttatactcaggggggagtactaattaggtaaagggcaggggagctcccagaggtagggagatggcctggagagctgcatcgtgcaggatggaagtgctcactctgtggaatgctggcagccaggtggttataggctacggccctgcagttaacagagctgatccccaaatattgccctttctcatagaagccatttgtagctagccaccatctgcacatcaagtaaacatgacgaggccgcaagcttcatcctctgcttcaattaagttgtcattaatgcctcggtatttgagctaagataatgttaatgagaaaatcccattagcaagggcaaaaaagtggatagccacagggctgtgactgtcacaacaagctgtctggtttgagtttcagaagatagtaacatgatatcacaacaagcacagagttcgagtttcagaagatagtaacatgatgaagcatttcgtgttatggaaaactgagaaatgcaattgcctgaactttaagataccaagcaaaggttggaaatgtttaccaaagtagtgatttcttgggcgtcttcagctttttaagtttggataatgacaatggagacattgtatttcttaactcactgttattttctctgtctctcactcaaaagaggaattgcaggagatagaatttttttttatcatagattaatcttcttgtcaaacctgctatcacttccctttttcttttgtattttttactttgacaattttctcatgtaacttgaagttcctctcattggctttaggaaacttttggagtatctactctgcactgggtactgtggttgaacctgggaaggaggcactgccttccaggagctcataggcatggttggaagagacagtaaagaggcattaatgaataatagaacatgtgcctgggacactggggaagcactgggaagaggcagctggataggtgagaaagggaagactttctagaggtggggatatcacagcttggttcttaagaatgaatagaatttggccaaatatggagggaaggaaaggatgctctaataagagaagagaaatagaacgagaaccagaggtgtaagactatggaagcttagctgcctggggcccagatggcaaaagatgaagcagagttttggtcagggaccccagagtttgtgctgtatcttggagagaatagggaaataactctcttgagtttagcttaatggttagcgtgtggatgtttgatctcagcattcaagtctaccaaggaaaccacactttcaccatcaaccacaaatgcatcgtgagttcctaacagaccctagcggatggcaaagccagatgttttccctttatgcactgatcaaggcttttcaggatccaggttaccttgaaatatgagccaggcattaaacgactaggaaaggtttaacctgtgatttatggctaatgctcacatgagggcctgcttctgacacttggcagtggagattcagttggtctgatgctcaatccatcaatgaaccttggagagcgcagaatgctgccctgctgatactggggcagagcggggggtgtcccaaaacgtgactcaaactctgacccccaggtacctgttatcccactgggaagaggagactaacatggacggattgttaattaataccacaaggcagtaaatattatgagctaaacaaatagatcagacagtggatgctataggaatttagaaagagaaatcaccctgcactattctagtcaaggaaaacctgcttcattcgtttcctgatttattaacttactaatttattcaatcaatcaatcattcatcacgttttatatgccctgcactgtgctagctggctgtgatagaaagtaataaaacatatgttctctgtctgtacagtttaggaaagaatttgctgacacgaaaacttggccttggaagattgggggatggattttgatagcaggaaatggtaagggtagcgtataggtggagcagaggctgggtatggaagccccaattcactaagtatatttacttggagcataatgaacacatggtccagctggagcagggaattcttgtaaggattttggaaaatagcctgaaaagacagagggagacttgattagagaaagagtagattgtccaactaagcagtgtgattttcattctctgggctccatgacccagtggaggggtatttgctgtgaggtccatgataaccttgctctttaggtagttggatctagcaaggtgtcctctatcagaaagagacaggaggctgggaaaagagggggaccactaaagaaatttccagcttcagggataaggaatagaacaaaaataagagagggaatttgaaggcatatgtgaactcaatctaccataagtagggaaaagttaatcgaatttgatagctgatggataaacagtgtgccaggaaaacataactcaggctctaaattgtagcataatggtactagtaatcgtaatatactcttctactatgtaactgacattttcagacttccttattcaattattcatatattgcctactttattctcacaaaagttgactgtgagacagtcaacaaaagttgacagctaccttcgaattgttaaataagagcatgtatgagaggacatagaaaggccattgaattgagttttctggggaagataaagcctagaaactttcaagtcaagccaatctattttgtttccattttacagatgatgtaataggtttagagatattaagaaatctgtctaaatttccggaaatttttaagtgtcacgcacttgagcaaggaataacaggtgaataaagccatcaaggaaatctgtaacaagttatctccagggttggaaacagtctttagggactatgatctggtttgggctgtctttttgctcttgtgtgtggctgtcatggcctagggtagtcacagctgacacttaagggccctgaacagccacttggttacaaaggttcattgacaccttgcaacattgattatgatcttgctttttattttgtcttcaaaacataaaaaaagatgtcaaaatatggtgacaattgaagtgcaaagatctgttagaaattttatggaggaattggtggggttagagagaaagagagaaagaggtacaattgagagccagagtacaagagtgtgtcaaggctctgcaacctcaaaattatttctttaactcaatggttctgagccaagggaagatttccattcccaccaaactcaccttttagcccacccatcctccacatggtgaaaaaatgtgctgttggtgatggggatttgtagtgttggtgatagggttgtgctgttggtaatggaaggttgtggcattgatgatggaaggttgtggtattggtgatggagtgctgtggtgttggtgatggagcattgtggtattggtgatggagtgttgtggtgttggtggtggagggttgtggtgttggtggtggagggttgtggtattagtgatgggagattgtaatgttggtgatgaggtgtggtggtggtgatgagggttgtggtgttggtgatggagggttgtgatggtgatggagggttgtggtgttgatgatggagggttatagtgttggtgatggagggttatggtgttggtaaagaggggttgtgttgttggtgacggagggttgtggtgttggtgatgggagcttgtggtgttggtaatggaaggttgtgttgttgctcatgggaggttgtggtgttggtaatggagagttgtggttttgatgatcgttctttgtggtgttggtgatggagggttgtagtgttggtgatggagggttgtggtgttggtgatggaagattgtggtgttggtgatggagggttgtagtgttggtgaagaggggttgtggtgttgatgatggagggttgtagtgttggtgatggagggttgtggtgtttgtgatggagggttgtggtggtgatgggggttgtggtgttggtgatggagggttttggtgttggtgatgggggcttgtggtgttagtgatggaaggttgtgttgttgcttatggggggttgtggtgttggtaatggagtattgtggttttgatgattgttcctaatggtgttgatgatggagggttgtagtgttggtgatggagggttgtggtattggtgaagaggggttgtggtgttggtgatggagggtgatgatgtttataatggaaggttgtgttgtgatgatggagggttgtgatggtgatgggggattgttattaccatctagtgagcaggcgtgctgctacacatctgacacaggaggtataccacaagacacctactcctaacaaataataagccagtccagaatacccagggccagtgttgaggaaccccactttaagcccaaaccctactcttgtaaaacaaatttaggaccttagaatatctcttaactgttctgagtctcagtttcatcaagtgtgagctataaagggctgtggagatctcattatcaaaagcattttaaaagacatattatatgctctgtaactattttttgttttatctagaaagatatatcaaagtaataacaattgactagaattctaatttctgacataagtagacatcctgagaaacaaaagttgaattttcatttaattattttcagaagctaggtgattcacaaaataacagaactaaagtttgaagttggtattgttaaaagcgaagtcatttggtgggaatgtaaagtagtgtagccactttggaaaaattctggaagttcctcaaagggttaaatatggaattgccctatgactgagcaattccaattctatatgcacacctaagagtattgaaaacatgttcatacagaaatgtgtacacaaatgttcatagcagcattattcttaatggtgccccaagtggaaacaattcacatatccatcaaccataaaaacatacttaattgaccaggtgtggtagctcatgcctgtaatcctatcgctttgggaggctgaggtgggtggatcacttgaggtcaggagttcaagaccagcctggccaacgttatgaaaccccatctctactaaaaatacaaaaaaattaccctggcgtggtggcgggtgcctgtgatcccagctactcaggaggctgagccaggagaatcgcttgaacccaggaggcggaggttgcagtgagccaagatcatgccactgtactttagcctgggccgcaaagtgtactttagcctgggccgcaaaaaaaaaaaaaaaaaaaaaaaagtactgattcatgctacgtggatgaatcttaaaaacattatgctaaggaaaaaatgccagtcagaaaatagagcataatgtatgattttatttatataaagtgcccagaataggcaaatccatagaggcacaaaggtaggttagcggtggttggccagggctggaggtgcagggataaggggattgggagacagtatatcaaggttacagagtatatttaggggatgatgacatgttttaaaaattgattgtagtgattgtataactctgaatctattaaaaaccattgggtttcacactttagatgacatatatggtatgtgaattttatctcaataaatctgttaccaaaaaataataaaaataaaagcaaagtagaattcagtagcagaacataaaacttttcagagctttttggtcatcaaagagatggcaggagcagggcagggctggctggagttgccagcatgatgagcaaaaggagctcagctccagtacccacacttccctttgaacgctggctctgcctctgagcagccatggggccctgtgcagcctctccacttttctctgttacatctattacatgagggcaatcaacttgacctccaggactattgtaagaattaggaattacattatttaaagtgcctggcacattataggcatttgttactggtagtgtgatatattattagctatttttacaactggggtatttcaaaggttcatttgcaagttcagttggaaggatgaaaactgtcattctttttttctctatggagaaaattttccaagtctttatttgattcctaggaaagcgcagggcagcctatttaactctctctctgtaaggaaccctttatactgatgccctaggctgaattccagcacctgagagaagccatgagaacaaaagtgaaaaggacaaaaaagttttctgtcttttatttcagcttaaacagtttatcaggtttttttaagattataaaaaatgtacattaaaaaacactgaaaattccagtataatataaaagaatctgtgattctgtcattctacattattgcagtgttttttgtggtgttagtttttaacaagatgggaatcatgcagcacgtcctatttatttagagcttttctcttatcaagatatcagtagcattcttggacattatgatgtttaatgactacattatataccatattaggaataaaccatatttgctttagctagcctgctactatgggaaatatgggtagcagtgaatttttgctattgtaaataatggtgtcaagaactaccttcaccataaatcttggctacagctctgttactattttagaaataattcttcagaataaaattcacaggaaatgaggtatgacattcttgggatttttgatacttactggtgtattgccttccagaaagaatgtgcaaatttaggctgccacgaacaacatataaaattgactgtttccctctattctcattgagattgagcataatcagtttttatcctttattagtctgggagatggcaaataatacccaacatgtctttaaagttcagaaattgtatgtttgtcctcatctgtttctggaacccaaatcccatcttttaggcctcagcccctatatcatgggggtgcttagtgccccatattggccctcaatatcctgctcgtctctcctaagataatttttttcccccatcaagacattctcggcctaaaaggtgttgctttcctgttctcctcattggacacgtctattctttcaaagccatttatctcaaggaagtttgggaaaaaagcaatctcataaggtgatttctccctaacttgtgaataattaatagcacttccacttttacctttaagagagtatttttaataacaatacctcagagagtctctagggatgttattttggatctgttaacagaatgaagtgaaaacgaggaccaggtgaaagtggagatttttagctggggatgtaccacttcacttgccttgaaacccatgcctgggcagctctcctgggcgggtcccaatttcccagcttctttcctttctcttctgacacctccaatgacatggctcctgaccctggctgcaaacagaatccaagggacctttgaaccttccaagtcctgggataatccccagaaatctgacttaattaacctggagtgagccccaggttctgtattttcaaaagctccccaggcaatacctgcattgagaactattgttctaataattttcctccacagagctaaacttttcacccaggctcccactgcaggcattggggaacatgtaggaaaagaccaaattaaagaaagggcagaccaaaaaataaaaagaaaaaaagaaaaccaccaaccaagcaaaccctcattatgtgaaaacttgaaagagagacatagatggcgatgtggggagaggacaggacccacaatcacaacagatgatcctacagactcccattgagcagacctctcccctcaggccagtgccatctgtaacatgaatacatgatagatacctaattcgaggggacactcactgtggcctctataaatacattcttctctactgtatcactgatgcctagcagggtgcttggcctttagggagtatttagaacttttattctgaactagttactaactcccttccagtctagagtttacctgcaaatgcagtcccatatgttatgcagatgtattcaaatgagtatgcaagtgaaagtttttaaaaaggacttacaattgactgtgctccccaaatacccctgaaagaagtcaaatgttcaccaagacacacctgacagattctctgtctcattagcagaatccctgtggccaggacacaaaccctggtcttgtctgaggacaactgcctttgggaggaagtggggccaccaggctgagaagcctctgggttctcttcttcaccccaagcagatgttcaggattgcagtgatctggcttgagagatctggctgaaaacacatcaggtgtcctacatctgggatgctctgagcagatgggtcacagctgcccaggtgcaaatacagctgggctccaagcctggtgcttgtttctcccagggcagcctctccagccaactgggagctcaggggtaccggctcttcacttgccactctgacggtctggcacacctctgtggtgatcctcagtgttttcttcccagctggctgctttggggctgctctggtaggctctaccaaggcaggtctattttacctgcagaaatagctctgaatccatcacttactttgcattttcactgctgctacttttggtgagatcctctcattccgcctcctggggactctgcaagcagtaggacctgtgagttctgcctctagccttgaccccttccagctgctatcattggctcttgtgctggctgattctttgaataaacacctcccaccctgatattaccatcctagagagccctcatggagtcccatgttctaaagctgtaattttcatctctggctgcacattagaaccacccaaggagcttttgaaaaaatgcggatgcctggggcccatgcccagagatgctgatggaattggtttgggaaaagtgctcttcagaataatttgtcaaaggatattgtttaaagtcctcctggtatgtgagacctctgggtgattggatcctctttctagctgccttcatattgtcatctcctgcttctcagtccagacctttgtttctttatacaggctctctgtctcctggaacccttgctccaagaattacaaactcttgctcactttccacgactccccttaactgtcatccacttcaatgaaacattcttgggatcctcacatggagttagttaggctttctttcttctctgctcacatattgctgttccacccagaattgcaagaggtggtgttgtttgcttacttctctgtctaccccactagcctgaactcaaaagacgttattttaatcctccttgcatatgtctctgccttttaacaatggactaccctagggtagagatcatgtgatgttaatatccataccctctaatgacaaagaccatctcgtatttgcagctctgttcattttttaagctaatatgactgcccacatatgattgaaatgaactattctgcatacactgctggactaactggcgtaattctcacaatggcctgttaagtacaaacattgtcctctttgcaagcgaggaaactgacacaatgagaggaaagacaactcaacatgtaacagggcacaataaatgactatttacaatttagaattgtgtggctgtgtgctcttgccacagaaagtctttgtgaccaatcagttaatatgactttattttctcagcaagcactttacaccaccaggacacagtcttaatagatgataaactctttaaaggaaatagttgaaacctcatgactagttcccaaaacagttttttcagtaaggtaggtcagcagcacagggtacagcaaagacagctggagcaatggaataggagagaaaagaaccttacaaaagcacccacctttctcccagtgcctttagagagtgtcgtgcctcatttcatttgatccctttaacaataataaggaataggaatcataatatttacagatgataaaatcagagcttaatgaaagtgagtaactttgacaatgtctcctaattagtatgaaaaacgctgcaattggattatatgttacctctctccaacaggaggctgcctctgcctggcacatcattggaatctagctttcctcatctactttaaaaatagcttactttttcctaaaattgtaggaaagtatgagaaaaccaaaattgctcttaactctaccactcagttaaaattgctggtaatattttgagttcgtttatttttgttttttttttttcctctgcgtttatacaacaatagatcagaatacgtgacataactttggttgtggtgtgtacaacattttgtatttttcccttttgttttaaaacaaaacatatcagaagtagttcagccgtcttttttaaaaaagagattagaatgaagtggcaagaagaggaagaacaatgctttttatgaatcttccaagggcttgtatccagccgagtgaggagtgggtttgctctgagaatggcatggacggcagcaggctgggaaatgagccccctctctctaagtcttctggacccatcatctctatgcttactctcttgtttctcttgcaggcagcaacttgaatgatggcctgtggcactcggttagcatcaacgccaggaggaaccgcatcacgctcactctggatgatgaagcagcacccccggctccagacagcacttgggtgcagatttattctggaaatagctactattttggaggtaaattctccagtctttaagagggaaaattaagaagggagggaaatttaagtgggcaattatttcactatgatggttctggtttggtcaattagacaattctcccaacacacaaacacacacacacatgcacatacacacacaccctcaatctcaaaatagtgagaagcaaaatctctcacagctgtgtgcaaatataaattatctaggtcagtgctgaggaagaaaagaactttagctacaagagctggtgttatataacacatccaaaggagatttttgtagccatgccaagccctgtaatcacatgggaaaggagaaactcagctgaaaacttggagaaagtgtatcaagagtcagcagtacctgcaagaggcaaaattcaggtggaaaggcacaatcagcatgcttagcacccaggcccttcctctgccactttcctctcttagtctcctgtcccctccttccccacatccctagaggccatgctcgcagaaatccaggaatgaggaggaattaggaggcccatgaatttgtaactccaggtgtagaagccagttcagattattcacattctgccttctctgatgttaagtgagtcctgggaacctttccaatgacaaaaacacaagggcaagctgatggtgaagaaaaacataattaggcatctactgattttttataaatgcatatctatatatatgtatttagtctttcaaaagtatttttcattaaaaattaatatctaatttcatagttgtttgtattatagaaacagtctctgaaaaggatttaacctcaatagctgtctgaccttgagaaagatacttatagtccctaaacttcctaatctgaaacacggggaaataagctcacctccagaatttctggaaaagttaagtacgaccaaggtgtaagcatatggcagagtgtgccacatggcaggggatggggaaactggctccagctcctatagatataagtcagggtctggtctacagtttccttatttttttcctattagtaaattgaagagaagtattgtataaaattatgcatagtctcttaaatagaatttacagatcacttctctcataccaatggaatgtggttaaagctttaaaatgcaaaagggattttgcacatgtgcagtgtacatatcgaggtctcctaggagggaagcaatatctctgtggcttgattttagggtgaggaagggcctgtgacctttacctcaaatgtcctccacctgtgcatggataacaaattcctttagggagggaatacacgtccagtctctgcaaaagtttttatgacttaacctcatttaattcatgcagaaaccttgtgcagtaggtaatatccccacttaatagataataagactggtgtttgctgagatgaaagaatttgtgcaaggccatagagctcatgaattcaattccagatctgtgttcccacagcccaccagtgaaaacagagattggaacaaatgtattataatgatcgtagaacaagggtgttggggtccgaaaagataacctcacagaccgaataattttgcatcttatgcaatatttcagcatcagaggaaaaaacgctatcttgcatttattcttgagggaaatgtttgtaaataattctgatacaataagcatccaacatgcctcagagacaaaatggctctcctccctcagttgaagaagcgttcttagaggcaagttttaagggaccctgggtttagaaggtgaagatgtatcagtgatttgaacagtgtttaaacaaatgccccacgcgtagactgtaaacttaaggaaggtgaaaaatgagtttcagtaataatagtcaacttacataaattctctctacagcttcaattagaagttgtagcatctctcttcattttacagtgtgcctgtgagctgttaaccagctgctgggcttcagcccagcagtgactgtctattagagacggctgaaataattcccagttatttatgggttattaccatggtttcaagcttgcattcccatatgctctgaacctattaaagccattgggatggagttcgtatggagcacaagcactcatatacctgcaaggctctatacctgtcttaatgagaagtagatatgccctggttgcaagctacactaaatcagtgtaattttttaagaacactctttaaaaaggtatagtattaacctttcccatatgctattacagccctaaaatgacatgcatttaaacccttagttccttctaaaaccagcaaaacatctgattttgctttgcacatcacgtcaaaattccagttacgctcctgtgtgtacctttctcaggaactaagcctgttaatgctaacaattaaccagacaattactctgctgccatccttacccagagcgtaattttctttgaaagtgtaattcagaattgaatcgtgcatttagatatgtgtttcaagacagaaccaaaattctgaagcagctataatacatttcttccttgggatgagtgaaggatgccatataaaagaatagcaaatagtttaccaatggaaaaacaaagtaagaaggagacacatgttacagtattggtattccctttgccacgctttttattttctctacagtgatggagtataccctattttgtaccaattctgtcccctccctgagaatgctaggatttataatgaaaagggtgtgcactgctgtgaatgagaaagcaccaaactaattagacctcaaggtcttccatcaataggtcgccaaagcaatgacggatcatttcagcattcttcttcatcttttttctctgtcccacagggtgccccgacaatctcaccgattcccaatgtttaaatcccattaaggctttccaaggctgcatgaggctcatctttattgataaccagcccaaggacctcatttcagttcagcaaggttccctggggaattttagtgatttacacattgatctgtgtagcatcaaagacaggtaattattgtctcttctcctctgttctgccacccccttcccattcttactgttctaaatatgagtttctttaagcaaaattctaatccaccgacattagccacattagacataattgagttgcctaatggaaaatatttctgaaaggatttcaggcccagagaaaaaatggtttaaattagttgagtctctcttcatgttgacttgcagtaaatgggatatgcaaattaaatcaaaatacaaatttgtgaaaggattaaaattttatgcataaacaacatttgattactttgaagttaaagcaaaaaggaggaaggaattacttctctcctaaaccatttcatttttcactgctgtgggtgtcctttctaacacaggcagatgagcattggaccatctgggaagtctgcagcagaggttcccgaaatgcccaataacacacaactactcctgggtttggctggtttttgctcttactgcccctaccactgcttctctggcccagagatcagaaaaactcactttatctctcaatttcccctgggatctggctcttcttatattagaagtttctaaatgcaaagacacactgcagaaaaccaaagaggatggattctgaatttgcatcaaggtttaccatgttcttcttctttcctctccagagcctacctccttcattcttccagttctgctcacccttgtcaaaatatcgtttatagaatgggtgaataatatctgttcagtgcttgcctatgtgttgatgataaagggtctctgcttatgtttcatctgggaataaattagcaataaagttacaataaagttagataaatgaccaagaaatgcacccttatttgtcagacacatggcagcagcaacttagtctgaccctgagaatgagtcgaagaaggtttcagaaggtgatgctgagttgaatcttaaagcagaagacactggcaggctaggccaatgttgagaggggaagggagattggcatagaagcaggagaaagcatggattgcaagtatttcatcaattcaaaatacttttttggcatttgaaggcatttgaaatctctaatagttgaattggcaatatctatttttcatagtggcatataaaataattgtatatcttacaattaatggtgtcttagattcaataatatatagctcagtagggatggtaggccactgtggattgtgaacctggtgtgaataagtccagagatgtggggcaggaccagtcatgaaggactttgtgtaccagtgggatttggtttcatgctcttggtgagaaccacagaggaaggtggctagcttttcctgttagaaagagtactcaagaagaagtgagaaaggtggattggaagagagctggcccacaactaggcaggtgactgccccagttcaggagaggaataatgagtagtagcaggtgcctctactgaggggcacagaaatcagccatgcagtgcatagtctctgctaacgctagaatgagctgcgtaacttggtgaaaatttacacacatttctccattaatatcactatgcatgggatcatcaacaaatcatgcagattttctggctcttctgctttgttttttttttttttctatttgaccagctgaaaaagtagtaataaaatatgtgcttcattaaaatgtgctagtttagagctcggagaataaaagttattgcaggcgatggttggcaactattggctagaccaatagtctttagtaatggcgagggagaagcatcctacttcatcagccagtgcagcctcttccaaagtgttgatcaatacagggaacatttatcaacaggggtctcttatgctaccttaatttttaatcaagcaagctctcattatttttgattgcatgaaagtcattgccatgtactctgcatcattagttttgtgtaattgtagtcttgtataattgtattacatacaattgtgctttcattaattgtataataagggattgtgtttagtttcgtgagtaagtggtaagtttttcttgatttaccaggcactgtgtctaacagaagggaaagctggggcaagggactgtgtttgagtcactatttcttaaactcataattaatgttatctgaagagaggcaggagttagaagggcaggtgttttctgaatttggtgtttcatttttaatgtgttaatcaacgtgagctggatttcaggttaattgcaaactctttgccttcaaggagcttgctacttgctgggagaaaggaagggaataggctggcagtggttttccttacctggactgctgtctggaaagcccacagaggacaatctgagaatctcttcttactctgagaccccttgccagtccgttgttgcaggctgtagagaaccaggcctccatttgcctctttgtggttgtcctaccccttctttttctctctcaaagtgaagtgggatcccgccctgccagcttttgttttttgctggccccaaccgggcatcttacatacttaaacggtattagtgctagtcacgtgggaaaatcagatataagacatctaaagtagaattctggccgggcacggttgctcacgtctgcaattccagtactttaggaggccaaggaaggcagattaactgaagccagaagttcgagatcagcctggccaatatggtaatatcctgtctttactaaaaataaaaactagccaggtgtggtgacacatgtctgtaatctcagctacttgggaggctgagacagaagaatcccttgaacccaggagatggaggttgcaatgagccgagatggcacctctacactccagcctgggcgacagagcaagactccgtctaaaaataaataaatacataaataaataataaagtaataaagtagcattcctacctgaggcacaaatgttccaaaatctcaagagctccctccggtggaggtcctttaagcaacttccttttgaggtggtgcctaagaccctgacacctgcttcccagtttgcactatttacaaaccacctttgatacttcatcctgagcaaaagctaaaagggtctcttctcagggattaagaaactttaaccaatgtgcatctcagggatgggcaaattaccaaatcttctggctcctgggaggaaaggacttggaagaactggccttgcgcacggctctggaagcaggaaggtgttggtactgggcagctccagtgcctggcagtccatgggcaggatgggagaaggaagcagtaggaattagaataaggcattcctgacacacactgtgccctgttcacggtccttctaaacctctaggacacagtgtgcagctgctgcccctcttctgcaggccaaaccaccagcctcataatctctacaccctaagcccctgtccttcataataaccatctttccagcctctttgacttgaagtaggcaaaacacaatagtctaagccagcggtccccaacctttttggcattcagggactgggggcttggggagatggtttcaggatgattcaagcacacatttattgtgcacttgatttctattattattacattgtaatatataataattatgtgactcaccataatgcaaagtcagtgggagccgtgagcttgttttcctgcaactagatggtctcatctgagggtgatcgaagacagtgacagatcatcaggcattagattctcataaggagtgtgcaacctggatccctcacatgcacagttcacaatagggtttatatgcctgtgagaatctaatgctgaagttgatctgataagaggaggagcttaggcagtaatgtgagtgacgaggagtgtctgtaagtacagacgaagctttgcttgctcacctgacactcacctcctgctgttggtcccagttcctaagaagccacggaccagcactggttctggtttgtggcccagggtttgaggacccctggtctaagctatcacaaagaaaagtcactttcaataaggctttattcagtgaacagctgttgatacaccctctgtagttctgactcataggtaggcactgagagagtgagactgacttacatctatccctgagtaggatatgatgctgtaaaagctctagaagctctaggagtccagaggcactaatatccccaccttctaaaaggggaaagctaagacctggagacgtatgtcagtgttctcaaggtcccatagggctgaagttatgatcaagagtcaagcactgtgtgtattctctccttggtactatctagcaaggaggcactgatctggaaaaggcagtcactctgtgtcagtggctctaaatgtgtaaccccattttccaattgtcgacctaaaaggaaaaagctgatgcaaaattaatataagtagagagttcatttgggccgagcttgcttgaggcaatccaggagcacagattcaagttgccctgaacagacactcagtttagcagccattgcaactgggtttctaaaggcaaatgggaggacaaggagtgaactgatataaagttctgccaggaattctcaatggtttacagtttacagatttgattagtgattggctatgtattgttaagctgtagggtgtgggttctagtgtgtccagtgtagcattattaggttaataacaagcagttccaagaggtgagtacacagctcaaagtgggggagtagagtatgactggggtgtcattttaatgttttattggcctgataagtaaaaggacttgcattcctcacataaaagtttttttcttttctcatgctcaaccagattgaatttttaagaatatgcaatatgtcagattctttgtaacatttatgtgcctgatgtaattccatctatgaggggacattcagagtggcatgcaatgtctagcagggtctgagtggagtaaggtgagccaggttcaaagagtctctgccccgcatccatgtagatgattcccagtcaattccaggagccatgtccagtcctgtgaggttcaagatccaggacaggagagacagattagcaaatgctgtccaagagtatcaacaggagacaggctccaaggtgtgaagccaaaccaggagggaaaaacagggatgctgatgaggaaggtgtctgaggtggggagaagcagaggccatacctgggaaaaatccagaatcccagtgcaagtggcagcagctttcagaagcagcaggacacatttaaatccaccccgcccacagtctgagatgtgacacacattatttaaacttttgtccatgttttcccttttgcaaaatcaggatcacaaaacctacctttgtgctaagagttgaatgagagagtgcgagaaaaatgagagtgtgcgagaagtcaggtgttcaattgcatgactggaatgcggtagatgctcagtaaatgttcactgtgttaattcctctggccaaaggtttgccggttctctagtttccatggggagagaagaggcttaagtgccccgccaccctttccccaacccccactgttgcaagtgatccttagtagtttctggggtgattcccatgtgaatatttcacatttgtcccccctcccaaatcagtctgctttgtgaccccccttggactttggtcccactttttcagaagacctgccatggcccattaggaaagcactcataaatttaggtgccaaggttatggtcttcagattttcctaaagcattagtctcaagatcaggactagaatgagcctagagagtaaaatttaaggagacccctacttctagggccatgcatgcatggagatcctgcatttgcagaaacctgagagtgagggtctctttaaatcttataggcaaattggagcattttaacatcagaatcaccagaagtgcttgttaaaacacaaattactgggggtggagcctggaaatttgcatttctaagaaattcgtgtgtgatgctgctgctactgggctggcctggtggccgtactctgagaacaatgctgtaaagcttctgctcctggaggacgtggaattgtgtggaatctgcaaagctgatgtgggtgtggaggagagggatggttcctgcccccacctagggcctcaagcagctactcttctggccagagtctctctgaaaagtttttgcagctccctcaaagtcccaaagtccctttctccaaagaggtgttgaaatcagcccaaggggtgctgcaggaggccactgagtttcttctgcctctgagctttcctgatcttcctctctcagctcctcccctgcttcccactacaaacaaagccttcatgaataacaaggaaaatgatcagatcctctggcacgcctcagtgaggagtatttcggctggaggaaagtgtggttctagaacagctacagctgctgacaagcataactgtttgttgtgaggtacccctgaacgtcacagcttgatctttccttctaaaatacttcacagcctgcgggtggtggtggtgcctatataataggagtgactccacctctccccagtattgcttaaaaaactttataaagattgatggacacttttgcagcaacatgaatggtacttaagtgaaacaagtgagatacaaggagataaatattgaatgttttcacttataagtgggagctagataacatggacatacagacttagagagtgtggaatgataggccatggaaaagtgagggagttggactggggtggataatgagaaattacttaatgggtttgttttggataggggtcctgatccaaacctccagagagagttcttggatctcgcgcaataaaaaatttggagtgactccatggagtaaagtgaaagcaagtttattaagaaagtaaaggaatagaaaaatggctactccacaggcagagcagtgacatgggctgctttactgagtatgctcatagttatttcttgattatatgctaaacaagaggtagattattcatgagtttttcaggaaagggacagacaattccaagaactgagggttcttgccctttttagaccatataaggtaacttccagatgttgccatggcatttataaactgccatgtaaactctatcaccactgtattttctcccacacacattcatttaagaaattcgggtgtggtggctcacgcctgtagtcccagcattttgggaggccaaggcaggtggatcacgaggtcaggacatggagaccatcttggtcaacatggcgaaaccccgtctctactgaaatacaaaaaaaacaaaaaatgtaatgaacaatgaggatgagcagagatcactttcatcttgacttggtgggttttggtcggcttctttactggatcctgttttatcagcagggtctttatgacttgtatcttgtgacaccagtcctgttgacttcctatctcatcctgtgactaagaatgcctaatctcttgggaatgcagttcaatatgtctcagccttattttacctagcccctattcaagacagtcactctggttcaaaagcctctgacaggttcagtgtacgttgttctggtgatggatatcctaaaagacttaacttgaccactaagcaatctatgcatatagcaaaattacaattgaacctcacaatctatacatataaaaaaatgattagacagacactgatttcatatggccttctggtgaccaccgggcccattccttcatcatttcctcatacagtgatgctaccggggaagatccgaggagatcccccagctctggttgtgcacaggaggaaatggaggccacacagagggaggcaaagtcagatatggaagcagggtgctgttcctgcggtctttgcctttgcatcctatggagacttttcgctgtaatcctttctacaattaaaccatttactttttccaaagaggagatcccatgtggagcaccacattacatttcttgtggcaaacaagttatgaaatgtagcttctccctccatcaccactgtattttctcccacacacattcatttaagaaagccaggtgtggtggctcacgcctgtaatcccagcactttgggaggccaagaagggcggatcacaaggtcaggacatcgagaccatcctggccaacatggtgaaaccccgtctctactgaaatacaaaaaaaaaaaaaaaaaaaaattagctgggtgtggttctgcaggcctgtaatcccagctactctggaggctgaggcatgagaatcgcttgaacccaggaagcagaggttgcagtgagccgagatcgcgccactgcactccagagtgcagacagagcaagactccttctcaaaaacaaaaaaaataagaaagaaaagaaaaaagaaaaagaaagtgtctactgaactctctggtcaaaattcttaccttgttggttcagggtttggagtacagtaaacactgaaagttggcaagcattatgttggattacctcccataaacagactcttgctaaaaacccaccctgtgtgtgggagcttgttaaaaacagtgggtaatataaaaagattacattgcgcggtaatacatatgttttagttcttctctaaaattgaaagcctttacattgggcgccagaaaagccattggaagggcagtgcccacacaatctgagcttctaactctgaagtgagaaatgttacaatatgctgttctcccttaactcatgggatggggccaaaatcaaaacaagatcatttctgctttactatttatcatttgtggtctatttcacagaggggaaaaaaagttatattttatgtaacacttactgagcaaacattcctaaatgttatttcgttttattctctccatagtctgcaaggcctaccaagtgggttctcaaagtatggcccccaggactgcagcatcggtgtcacctggcaacttgttagaaatgcaagtctcagacagcaacccaattctactagatcagaaatgtgggttgggggccggggcatctgtgttttaatcatcctccaggtgactaggatgcacactcaaatttgagaaccaccacgttgttcggtgatcgccgttttctacataagacaaccaattcttagagaggttcagtgactgccaaggtcatatcttagtatttggaaaagccgggattcgaattcaggtttttctgattcctcagtatatataaataaggaaagcctgttaccaaaaggccagagaaagaggagacatgggcttgggtagccagagcgggccagggagggggctacagaggaagcagcacttcctgaggaacttgaagagcaggttggatttacgggggtcaaggaggggtgctccaagggctctcatgtggagagtgtaaagctggggttgggaagggctgcagtgctgaatgtttgcccatattggaagggctgtcttggcagcagtggatgcaagagaactgaaatcagaaccggagtaaacttgccagtgcacaaaacagtttaaaacttgagagaccagacacattaatagtgaatctttaaataatggttactgtgggccagggcagtgtgacaatgtgtggtgtgtgtgtgtgtgtgagagagagagagagaaagagagagagagacagagagactaatcttcaccacaatgttgtgaggttaatattattaactccattttacacacaataaattggaggcacagaggtactaagtaatttgcccaaggtcacacagcctatatgtggtagagcctggctgcaactcatggagtctattgggagagattaggcctgtcctggcactgtggtacttctaaccctgctgtgggaaggtgccccacattcttcggcaggattgtgaagtggaaaatgatgcatttttgtcttgcattaaaatcacaaaggtggttgtattaaagcaggaagagaagggctgtggaacacctcggtgcctcacgggttatcatccctatcctcgcagctcactgtcactatctcctaaagaacacactgagatagacgcagaacgagctcagggctcccatgagacactgggcttgatctaattctttgagctgactggggaatagaagaaactgggaacttgccaggaatgactgtcttgagaagacaggcttcaagctgactttgtaaaggtgttccatctggaactgcccagaaaaaggactgattcatttctctacttctttaatgagggtttccttcccccatctatctcacacctgcttgaatctcagaaaagaagaaggttttggagaaagggggaacctggatttgattagaaataagcgaccttgaacaagtgcatctgtgtcctcttacaaacctcatctctatcatcacttgtttttacaagaaaagtggatcattatcttgatgaaatggtccttctccacctgtgcatatggacgggcacaaaagagcctttattcatggaaaacacggagggctgagcaagccaggttggcacttcattttggcccaccagacggtggtgagaatccttccccaccaactggtaatctgacatattgatgctgaaaacgaagccagaaccatgagccaggtgaattatcacaagcacttccaaagacgaggagttcatttcaagtgctgtatttttgcgattgaggtacgacatgcatgtcaacgtatcaggaagaaaatgtctacaaagtccccagggctctggatcatatctgtcctgagatatactggcttagaaattcagatgttttaggccaggcgcagtggctcatgcctgtaatcccagcactttgggaaacccagtttggtggagaccaggagtttgagaccagcctgtccaacacagcaaaactccatctctactaaaatacaaaaattatccaggcatggtggcgcacgcctataatcccagctgatggggaggctgaggcatgagaatcgtttgaacccaggatgtagaggatgcagtgagcaaagatcatgccactgcactccagcctgggtgacacagtgtgtgagactctgtcagaaagaaagagagagagaaagagagactctgtcagaaaagaaagaaagaaggaaagaaagaaagaaagagagaaagaaagaaaagaaagaaagaaagaaggaaggaaagaaagaaaggaaggaagaaagaaaggaagaaaggaaaaatgaaagaataagaaagaaaggaaaaagaaggaaggaaagaaagaaaggaaggaagaaaggaagaaagaaagaaagaaatttagatgttttagatggcagagtagcagaggagactttttatctagatagaaatgtgagaaaaaggtttagattctcaagccacttatgtgaagcagagaacattcataaattaatgaaaagaataaagagattccttggtattgattcctttacatgatcgatatctcaataagccttcatccaacatcccgataagagccttccatctgtttctcatgttctctaaagagcactgccttctgcacagccaatgtcacattaattttttcctcatttacattgatgtccactcatggggcccttgaggcgaagcacctgaagcctttgaatgctgtttttccctggtccaaaagcattcatcgatggcccattataagcaccatttatagacacagttggaagagagaaggagtataatatgttttcagttgggaaaaaggcaggtctgacctgcagtaaaaggttctcacctgtgtctgcagtgaaatgtaaatttaaaattagctctatgctacttacattttgaattaagatatttcataggaagttcatagaattccaattaggccttgtgggtttgattgtgacatggatttctgaaggctgaactgatacttctgcatctgtatcataggcatgggcagcgtcatagatgccatccactttaacacttaaaatgcccaaaggaagcatcagtctccctggttgtcaactgagaaaatcgatattcacataaatttattaacttgcctcaaattggaatcagactcagaattttaaggtgggaaagcctgtgctgttcatattttagcccaatcttggacacaatgaatatgtcacttctttgtatcttagctcccctagttgtcaaatgtagataacatgttataactgcaaggtgttaaacaaaagcaaggcgatattattcccgcctgcctcttggaattttggcaaggattgactgagatcggaaagaaaagttcttaaagttaaaagcgagagagacagaaatggatggggttctgtgtatatcagcaggccaggttttagaaaacccatacataggcagaaaacgatgacatttctctgaataatttacctacatatataacctattttattttttagacaagtgattaatgttttcacttgattcaagttacaaatatgaaatcttccctctaggtttagcttcatcttaaaaatatctcttggacatgatttactaagcccactgcagggctcttctctcctaatcctgggagtactgtagacatagcagtagatatctcaacacctgagaaatgcaaagggaacacacagagctaaaacagagagttaattgggagaatgcagattaagttggattttatgtcttgccaaattttagtctctaaactcgtgtgaggtctagtacatccagaacaccgttaactttattatgacaaaatgttagaatcaccttgctacctgcttttacctatgctgaaaagtataactgtgactgtaataattaggtagggggctatccctgctttggatatggaaatcttctcagatgtggttcccaagtaactctaggtttataggtttgatcaaatcattgtattgagaattgtaaaaccctatactctgaaatgagaatcatttgtatcaacattagcatttgtgtatgtacatagctgtgtatgtgttcacatgcaatatgatattagcctgtgaattctgatgcacacttctaggtcctactaactgagagactgcctgtgctctgctaatattcctctgtgacctagtcattcatttatgaacatttccttgcatgcttactctgtaccaggcacatttctttgcctgaacatccaaaagtgagcaagacagagagtttttgatcttagagtcatgtcattgattttccctgctctgatcttccttggatcaggaatctgcttttttttagtattatgaatcattcattcattcattcattcattctttcatctcttgtgtttggaacctttctgctgtgccaggtgctgggtagaagctgaggatatacttgagtgccgaccacagtagacaatctctaacttcagaaagctccatggaaggacacacatttgaaccaaataatcatggaaataaacatatatgctcccaaataccatgagtgtcctcatgcacataaatagagcaccaggagagaacctgagaggaaggccactttatactgcagagggggcagtgtgccaggaaaggggatgtggacattgttatcttcaggctctacaaaagcatccgtacagaggtcgctgcaaacttttctcagtcagtttcttagagctttgtcctctccatggctttctaagaacctctggctgatgactgtgatctccatgttctgtgtgtgtcctctgctgaaatccctgtttggtgtggagacttagaggataagaagtacaaaattccgatttttttttttttttttggtgagaagaaattttttcactggtgttttagctgaaaacaaattccccacattttcccaaaacatgtatgtgctgggaattcctgtctgccattaataccactttcttactctcctcccaccacctcccatcccttccctggctgccatggttaaagggtcaggcttctagtaattcaattctaatagtatataggctacacccctacacttagaaaaatatgagaaaaagtcagcctactcaaaataaacaccagtgtaaaggtgggactgatatttcagctagcaatttggtaaatcccaagaatctgaaagtgacaaaaggaatatgcattttaaaggtcattccaattaccatgcttactcatgttgagctgaaactctggagtttatgtgagaagacccacgcactagggggataaatgagaacatgtggttgggagaaactcgaacaaataataaggaagggaatacaaatcactgttgttttctgtgatattaaataattcttcaacctcagaggcatctgagaagtagaggaaagccaactatcgataaatagctgggcaaatcctcacaactctaagagcccaggattccatgatggatttacttctgatctacattttgcacacttatatgaggatccagaagaagaggtctcaagggtgaactcttgtctgcattaaaatgtctatttgcaaccactgcattctccatgtcatagtggattcccaactcaatttttctcaatagaattatcctaaatgtagatatacctttcctgcttttgaaataggaaaacaaaatagccaagaattattcctttagacagggtttgcctcatatatctctcccacctccccaaatgcatacgttattgcaactgtagctattctaaccatcagattctgtatgtgcatttcacatgacctccagcacatgatggagcctgaggcattaaacacacgaatccaagtcctcctgcttgacttttgcagtcttctggcctcacctgttcctccctatctatttttacctcctactatatgatgaataattcatcattccatctgtgtgcatttactgagcatctagtatgttccaggacatatatacatagtttctgccttaaagaagctcaagagcaagagagctagataagaaacctgaaagcagacatcttacaaagggaagttaatggcactgagggccatgaagttatgtcccagctgcattttaacaggagagaagtaaggaaaatgggagtgtgatgggattccagaagtgcaccactgcctgccacaaagcagccagctgccttccagcctccaggcacttgctgctatttctcttgtctggagctcccttcccagtttcttttgcccaaatccagcccatctgtcaaagtctagttcaaatcctacctactctacgaagtcttcttgactgctcacactcttctttgcttatttgggtgtctctggcactttcttcttatattttgtttagctcccaaccatagtcatgactggttttctatttgtatcttgcccatccaaagttcatcacgtctactgatgcattcagctgagacacgtgccctgtgattatttacttaatgatttgaaccttttgagctttaacagcatctgctctcagtagctgggggataaactgcatatgaagctaacaaaactcaacacgactcttggttttgggcaagtattgcctcaagatatggaatgaacttgataatctttaatgtcattgtatacccaaaactctggaggttgctatccgagatttaggagttaaagcctttcacttcttttctcatcttgaaaacttcccaatgtggttcacgccaaatactgctctatttgaatagcaagagtgcctaataaaagcaacgccagagccagctgtcatcattcacgtggtgttaagtgctccttctgtaagcactagctagcaagagtatttttgtttagcaaggccatcacaaaattagacaagcaaaccatagcaatgtatttgagcaatgtagtctataaataacacagtggaaggaagcataggagcacattatccatattacaatcttgtgccttaaaaaaaaaaataggttagctctgtaatagaaggcagctccagagaaatagacaaaatgtctttggtgattgttaaaggatgtaagcagcctcctggtaataagatctgctgagtgtaccctgtggattctgtgcgcccctaagcaactcctacaggctgagtagtgaacgcttgtaaagttggcgttgtttacctagcaggaatggaacaaaaaattttcgtggaaggatgctgatgtgtctgtaaccatgtcggctgtttatctgaaagtgaagttattgaagaagaaaggtttcacattagcccagaaagcagcattcgaatcagatacggtccatacactgccactgttttttagatttatttatttttttctttctttttcagaagtgcctggcagaaacttaaacaacattgttattcatttggctttgtcaaactctgtagcatcgtcaaatgtagagagttgcttccaacttttgccaaatgccatctaaagcctcttcatttaataaaaaggaatatagaagatatatattttttctcctttgatgttttaccgtacttgtttctacagtggattctaactagaatcacctaggtttactaaaatgcaacaattggaccagatgctagctagtttttttttcctgctaattttcttgttcaaatccatagagaactataataaaatatcttaaaatgaactatgctcattttaccaagaaggacactgaggttcacaggtatgaaattactttcccaagattacagagttggcaagtatcttccacccccaaaaaacttagaagttaaaaaaaagtgccctttgaaagttaaactaaccatctaacaggtcttaagggatcatcttggagatacaagagagtatccatgcaaggctagttagtgcttggactaaggctaatgtttctaaagaaaaaaaatgtgtcaaataaaagtaggttggtaagaagatgagttataaataaggaaaatcaaatagataaagctaattttagctaaagaactaaattaagacttcctaacatcagatatgtaaagaaagaagcccattctgtgttgcaacatcaatggggaataatagaaataacaattgtacactcccatagttcttaatcctcttctcagactgagttggaatatccccccttataactgataaagcttacaggaatgtaatataattattgcttcagtgaatcaaatattacttgtctagaccagcactgtgcaatggaacactgtgtggtgatagaaatgatcttctctatgctgtcttaacatcttgttactattggtaatagagaactcaaaatgtgtgatacatttagatttaagtaccacatgtggctagtgactaccatattggatagggcagggttagacactctgctagggccagtacttgtggattttacatttttcttatccataagttcagcagcggactgcaccagaggttaagtataaagattgggtttgggccttcaaattcagatctggtgtggtagatttaatgtcagccttagcagcccaggctggatatggtcatggtcactatctgtcatggagccccttctcccaaagacaattacatcaggagacaagggcttatcactatttgacttaatttctcccaacatccttgcaaagaagtgatttaacgattactagatcaaaatgtcaaaaactttatattacttaagaagacaagtttactatatcaagtgttcttttgctatttctgttacccagttcaaagttcctttctaaattagaattcatgttaaaaaaacacacattgtaatctaaacataatccatttagtaaggtttggtttctaatttttttctaaaataagagagtcttcacttttaaaatctccaatagcatactatatgttgaagttattgacagaactcccaaaaccacctgctcaaatctgagtaattcagagtaagaggtactctgcttggtcaacaaaacatgtgagttcgttttctagggtgggtttagattaatgcctatcgcaaagtagaggcatgaaacccccaagttctgtgactattcttgtcctgatttcaagcttaattcacagccctcaaacatttggaaaacctaagaagctaacctaaaggaagaaaagatattgatcagtctggtggaaatattggtccctttgaaaatcataacatttaacatatatttattaattgggattctagtatcacatactagtctcttgtcagtttgcttgcatgagtcattatcgtggtgactgtggtcctgggaatctgtcaagagtgaatttcaggccttatcatgtggaaaacccagttggctttgatttcatctgagtctccgtactagcacaaatggcgtcacataaagacctataccagactacagatgttaacccaggacactcttcaaagctaaggatgggttacaaataattttaaaattcagcctcaagccaagtacagtagcacagccctccagtcctaattactgggcaggctgaggtggcaggatggcttcagctcaggagttcaagattaggctgggatacatagtaagatttcatctctaaaatataaataaataaaacattgaaagttagacctcagccctaccaactgatagcttcaaactttggaattcataaaaatccattaaaagctcttttaatgcagttgtttggaccctacaatcccagagattctgattaagtccatctggaatagaggttggaatctgcattttatccaacaccccagttggataaaagactgaccctgtggatcagtcctttagaagtactgtgtcagaagattaaataaagacatttctttattgaattcatcataatacaggctcatctaaattttttcctgcacagtggggagctatacttccagttctgcctaatgttaatggtagtctgtggaaaatgttttctttgttcaaattagcttgagaaatgctggagtaagaaaagtgtgtttctttactgcaggatttctcaatgtgtgtgtgtgtgtgtgtgcaagtgtgcatcctcatgcttataaactgtgcaaggggggaagtcactgaaagctatgcacaagtttacaaacgtatatgactatgaagcccttgtttccacaaaactactcattcacataaggagcttttggaaatgcggccctagagtgaataaatcacagtaaacaccaggaaccccttgggctgctcattgtgggcagtggggcagcaactctgggaggtagttggtagtgtagacaatgtggcttcaaaagctaccattaaagagaactcaggagtcataagcagacattagccttcactttctgcttttctctacaaaacaaacacccttaaaggtaacttcttctgcctctttttccttctagtatggaggacttgtgcttttgatttgtacaaacaaattttcagcctgcatttttagtgtctgtgattttaactgaccacttgacttgtgagcctccctttcctagagatagtgatacttgtcttacaagattgttttattgattcattgaagtaattattgtgataagctagcaccaagtccagcacgctgagtccagagtttgacacctggtagagaagttaactttattttatatgtgtaaatatttagggagaattaagcaagaaaagggagggagcagaatctctctgtctttcccctgtcaaacccactacctcccccacccccgaccaaaaccctagagatagcaaatagactgcaagttttataccagcctcaatgctagcaatggtggcatcagacagtatgcagattccctggcaggctttgggctcaatagagaaacggtgcattgaatgacagatgagtgaggtgacatcagccacaggagtagcaggagagagtaagccccgcaaggaaaaattaaaaacaaaatgaggagtgacctgagccatctaagaactgactatctgtatggcatttaattctaacttaataaaaatacagttgatgggcagttaaagactgaattttgtggtgtggattgttcattttgggaattctttcccgggatagaacttaaattgagcttagaataacaaagaggattttcatgcaaaagcgagagccagtaaaggcaggggacatgtgtattcctgtgtgaggccctttagaacccatctatgatttgatcaaggggctcctgttgtgtcagtatctggggtggctgctcgtattcatctcccatggtgtggtcctccaagagttctgtattcttgcgtaagtgcttgccttggccagggtggctggtccagccaggccaaagagagccccttgcaggggttctcatatttaagattaaagagtaaggttcttttctcatagcagaagccttaggctgcaggattcagcaattggccgccacaattcctgccacgggaggaagtggggatgagggagggtgagtgaaatcaactcacagagaaaagagatggccagggaggagccagcaacctggttgtattcaagccctgaggttcagcatttcctgaagctatgctgtgtctcttcctgctgtttagagacattcagctcttacttgcatcttcgagcccatgtctctttcatttcctaaaatggcttaaactgtgttttcaccatttccatctgaggttttcattagtataagtctttttagaccacatcttttacaatcttaagttagatgatgaagaatctaaacaagttgaaagagggggaaaaaacattaattgtggaaggaaggatttagtgttttcctctttgtttgtgttctccataatctccatgtgtaagggtcgtgacattttagctcaaattggatgcagaatctatttctagaacaggcacgatgtcaggggccaattaagttgttggccagctgtagtttgaatcattaacaacaacctgtggccaccagcagttttatggcgaggctgtgctataccactgagcgtggcttaggatctctctgccttaactgctcaagccccagatgcagatcagaactgaagtggagaggcagctgcccagttcactccatgaaaccaggtttgctgttcacaaggacaggacactgatgaaatttaaatgaacaaagatgaagtgtaacctttgttttcagctcctgtggttggcaacagagaatggaaatcccagatctgcataggcaggctgagtagtatactgagcttagcaatgtgcaaaccaaatctctctctccacgaactggaaaaaaaaacaaaacagttaaaaaaaggaaagagtgcaggaaagaaaaaaacacagtctatgactgtgtcacaaaaccatctgcaagtataagtgacaaaaataacaagagttcacagttacttacattttacaagaccttatttagcgcccacaaggattaagatattgtgctttgtcttgattttagaaacagggacactaaatctctgaaagggatcaataattgcaaatgtcacagagctagaaactggaggaactggaattaaaacttgggtctctaatctgacgcctgggctatatgactgaatcttgtcacctctgaaggaggtcacactatgcctcagctggggcacaaggggatggtctcagaccagcctttactccatcacaacagcctccatgctcagacatggtagcctctgggcacagtccctaatcctctgcttctcaaacaccagctcaattttaatttcattgcatgacctttaaagcaaaaattaaagaatcttgcaacatgtcaaaatcgatgagcatcctgggtaatccaggcactgctggtatctgttcacttcatccatgggttctagagaccacggcagccactatagcagtaagcgccaagcttggacagtggtagtctccattggaaaatgaaacctagaggagccgggataataagatccagagggagattagtggacccaattataacctgtgtcctttttggcttgcactatatgagtagttttcatttttactttaatgtggtgaaatctttttattccatcaaataaaattttagttctatccataacaaataaatacaatatttgaagattaaattagataattctagacctggtctatgaaaataattctttgatccagggggaggagtgtcaaaatttgcagtcatacattagcctcagtattcattttgtttggctgttctggtttggttgctaaatattaagaaaatcttgattcacacaaataagctgcccactgatagaagttctagataccctgttttgcaatagtagatgtttttcaataagactgatctagaagcgttcaaaagtaggtataattgctttttttcttcaaatttgagaatcgtttgcatttcttaaaaaagtaaaagccagataaatatatagtcagtgctaacacttgctatgatacgttattattttaatgtcatgttcatccattcacttgttcttgcttcattattatgcagtggaaagagcttgtagcatgcaggtgttcctgagcatggctgggtttaaggggatggggctgtggagcagcggtgccctctctgtatccacgctacctgcgtgggcctgagcagacctgataatacatgacagtgcagtgtaacatcattcccaattaaagttcacaggaatcccaggggaggtggggaaagatttccattaaagtccccagagttagcctggagctaaagactaacattgctagtgcagtgtgttaaaacctgattcatgacacatttgaaaacgataccattttaacataaaacttacaaaataattagaaatacttcacaagagagcccaaaacaaggaaaggaaagggaaaaaataaaaccccacaatttgcaacccctctgaaccatctctacagaatgactctctactgaagtgcagaactttgctattcagtgaggtctgggagccagcagttttctcattcccataagcttattataaatgcggaacctctgtatcagggtcttcattttaaccaaagtttgagaagcactgagtcaagtaatagaattatttctattcatagtggaatctgagtgatgtcctaaaattaagaagacccttacagtaatccagagagctctactgtctgtgcgtttcctgatagctccaatattccaaccgaggtatcataatcatgatgctgaacaaaagcctgtgagtgcagggaacacaaaacctgcttcctagtagatgtgaggtggactaacccaaccagatttctctcccattaaatctacagcccctctgtcaattgcgtggtggacttccattctgatggatcacttctaggtcactgagataaatgggttgattaaagaaatttaattatattctattttgtgaaaatgacccctaccaagctaatagggggttctcttcctttgtgaattttttgatatatattattttatagtttggtggtaggggacttgtttctaaagttcccaggtagcaatgtcttgctactattttcataggctcaggtggtttgtcatactaacaatattagtatgcatgatgctgatacattcttcttgattctgaatgtcctctgctttgaagaactggcctttgaagaactgagcacttcagggtcatacatttttcagtgtgcggtagagtagagagaggacctttcccttttctgttcagtggccttcactggcccgtgcagggagaggcatgtgtgccctttgtgcccggcttcttcttgaaccccagcattgttgctgggatcactgacgtgcattgcaaactcattcgatcatctttgcttgtccattatctggggatcatcgcaacaatctgcgattgactccctgctgtgaactagaccctggaaaatttaggaaactgacttttgacacttttctttttattcccttaatttcttaatgtctgcatctgctgtaattacaacaaatttaaattataatggagatccaactgtgggggtaaaatgggattatgataattgttagaatggaaagacatagaaataggtttcaaaagctttcagaaaagctatctgaccaaaacgagatcaatgcggttggctgctaattaaagcaaacagacaaaggaacgcaacctagctgatttttaatgtatgcgcttcataacacagcttacattagtcagcttgcattttgaggactattgaaatgttttgttcttttgtctccaaggaaagcatatagaaattgaaactgaccttcaattttataaagaaggaatgagaattctttaaaagggaggttactccatggagcataaatacattcagattcatgtatagagaatcatttatctgaacatttgggaatttcaaaggcctgtcatttggtgtcctattcatttcagtctgttatgggaaatggagaagagggaaatttaacagggaagaaaaattatttccgtaggtttttatttaagtacactgagtatattttttaatgctcttatcttttaagcgatgattttctcaagatgtgttcaggttgaagatttttttaagaggggtaggcatgtgtctaaacagttcatatgtctaaataactgcaataaaaaatgggcacttgggcacacacagttaactactgtgcttattttcttagacaaaggaccattttcttttaatttttacaagagacttagaatgtacatgaatcaatagggggcaataatgaatggtgatcatgaggagtgtgttatcagatgagcttaatccaaaggagcaaaggccctccccatttaatttgatttctagagtttgatgagggaagtagagggcagtcggctagacttgggtttaaatgttcactctgccctcactggaaatctggaactcgctgagtctcaggagcttcacatgaaaaggtgaccccactacacccctcgtgagtactatgacagctgcatccaggcagtgacaccaggacaggcctggcatctcatggggcccttgaacatattggcaatgatacatgtccagtgcccacctttccaggtggattgcccacgctcagatatctgaacatcttcttttgtccagctggtctcattcctgggcttataatgtgccttaggacagcttgactctctttttagagaccatttcctccatcagctgcatgaatgtccctttaccattgtctgatagcaagcatatacacacatgcacacacatgcacacatatatgtatgtgtgagtatatctataaatttgtgtgtgtatatatgtgtgtgtatttatgtatgcacacatgcatatatacaaactaaaataaaatatctctacatttctttccagactcattgcaaaagccatgagcagaaatatacaaaaagtgagatggtacttatattcccaccggtaaccactgttaacagttttccagtccattgaaggactttccaatctctttacgtacagacgtactattcgttttaatgtctcatggcattctacagtatgggtgtaccatcatttatttaaccattccctaaatggtagattatctattaattatgtttttaactgttatcaatgataataattttacattgtttttgtgcatgtaaaaatgcatttctgggacattatattctatttctgggaaagaaatagaattctaggtcaaagcagatatataagttaagtttttaaaatgccactgtgtccatggcattgtggcaatgttcttcatatgctgcatgagcagaaagtattataacacaaaacactggcaaaggctgtaaagggacaatgtgttccaagaagaaatagttgggcctggcagggtggctcacacctgcaatcccagtactttgggaggccgaggcaggcagatctcctgaggtcaggagttcaagaccagcctggccaacatggcaaaacacagtctctactaaaaatacaaatattagctgggcacactggcgcgtgcctgtaatcccagctacttgggaggctgaggcaggaaaatcgcttgaacctaagaggtggaggttgtagtgagccgaaatcatgccactgcactccagccttggtagcagaccaagactctgtctcaaaaaaaaaaaaaaaaagttagaatgcataaggaaaataaaaggattgattatgcagtctcaaaaaaaagaatgcaaataaaatgacgcaaaatgtttttctgtaatatttgcaaattaagaaaaataaaatccagagttttccaattttgagtaaacagatttatcaaaatactacttaaggagtttagggaatttgggtgaacaacttggccaatagattaaatctaaaacctgttattttcaccaaaaggcaaccattgtggagacaaagagacagacagaggaagggaaactagaggtagaattcagtgctccagactgaacaaatggaagtggctcccagggtcagctcccgggcatttgtgcagagcctgatggagaagctgaagttctcctcagggatatgagggccaaaggtgggatttaagaacagaattgtgagccaaggcaggtgccgatgggagtgttctggtgcctgcaaaggatgatttttgaatgtagaacagactttagcaagatttatttttggttttaaaaaagtgatgtcgaatttcttaaaattttaaaatccttgttctttaagtttttttttctttttttaaaattcaacttacaatgtctttttctatttataaatctagcaggtcttagctatcaagtctaagggacctttggaaatgtttaatcctggatttagttatttaagtaccttcaaatactttaaactacatatgtgatatattttattaactttccaagttcattgatttgttagtgaacaaacagaatgtgacaaacacttgtcaaacttgaacattcagaaaataaacatttaacttaaatgaacttctttcttaggttttttactaaggaagatttcaattaaggatctaaatcagttgtctcatacttttttcttttttttttttttttgagacagggtcttacattgtcacccagactggagtgtagtggtgaggtcatagcccactgcagccataaattcctgggctcaagcaatcctcccacttcagcttctcaagtagctaggactataggcgtgcacctccatacccagctaatatttgaatttttttgtagagacagggtttccatgtgttgtccagacttatcttgaacacctgacctcaagcaatcctcctgcctcggcctcctaaagggctgagatcacaagggtgagccactgagctcagccttacacattttaaagtgaagtttacaagaattatactcgaataggccaaattctcttaaaaactacaaacacaaaaggactattaaaatatcttcaaagttttattataatcttcctacaagagacacaaactagagctggccaattcaaaaattcactcttggcaggggatcttcataagagaaaagaaaaatgagatattcattgttagacttaatgtttttagaaaaatttaaaaattaaaaactcaatgaatgattattagacttcatgacttgatgtaagacattaagattctaagggtaaggttcttcctaagactgtcaactgatactgagtcttaaccctgttaaaattcatcataaatatgctctagtattttttttaacttgggaatgctatttttttctgagaaaagtgaaaattacaacacacagaagtttctgtccaggaccagttttgtgaccttttttctctttcagtaccatacttctttacccaaaaacattcataccatagttttgattattttaaacttttgatactgaatttggaaacttctgggcttaaaaattgcatgcctaaggaagacgtgtaatgtgctaagtgatgaagatttgaggctgtcagtgttggtgactgtggtggagcactttggcctctatgcgtggaagctcagacaaggtctccataacatccacagttggctgaccatgaaacccatatcactgtatcattggattcaaagaccaaatatgaatcctcaatgaattttccatttgcttaatacacattgatgaactcttacatttttctgtacttgtgggattatacaacttaagttttgcaataaaaagtttggtaggttaaatgattttatttggcttgcaatgataactaataaggtctttctactaaaagcaggcagagtctgaaattttctgacattagtagtaagaaagaggaagcaaccatgttaacttacacaggctcaggacacagaaaaactctgtcatgtgcaaaaaatgtaaactacaagagcagggcaggggcaaaggctgtcttctgggttaatctattttaaagatttcacaaactagaagcgaagagggattgaaaatagaattgacatctcctttcccattgggaatttgtagaataaatttgatatcattatgttaattgtgcaaacgtacatattttttctttagtgtaattttatttcaaattaatccatttgtcatattaagattccttttcctaccaaaaattatctttaaaaaaaatctaaactgacaactccacattgcataacagtgtctggaatcagtgcaaaatatgcaaagccccctaaccctcactttggcagaagtgatgcctcagatgtaggcttaggtatcacttttagggagatgatctggcatttgtttgaaggaggatgtgcagtgctctagagtacaggcttcagtgacaggtagtatgcttcaccttcctgactctgtcgctttgtacttggacaagttattcaccctcatctagtctcactttttaaatctgtaaaacaggggaaataataccattaaagcaacatcccagatgtgattgtgagcacatgtcaaagttttttcaagcttcttggccagggaaaagccttaaagaagccaagatcaaaatttcctcttggtggagatattttgtaggagaataggaaggaaaaaaaagtttggttaaaaattattaagatagtcttaaggctagtttaaggttattgtattttaaaatatgatctgccttaggtttttatgggatccccttgctcttgtgttgggaattaactgaaggggtcaagaacggaagctggaagaccagttagctgaaaattgtagttattctggtgagagatgcttgtggctcagactagaggagcatcggggtggggtgataagtggtgagagtcaggacagcttctgaaggcccagccagcaggaattgctcacatcttggatataggctatgagagaaggagagcatcttcaagtttcgggacctagatactggtaagaagggtattgccatcaactgtgatagcgaaaaacacaggtgaagcaggtggtgggggcagggtgagggaggagatcagaaagtcaggtttggttaaaggtaacaaggatcaaggtgagctggatgggtaaattgaatttttcagcagactttttatctcatgaaaatctatcaaaattgtacaaagattttatcaggaatgctagatattctcctgccttcccccccgctcaaaaaaaaaaaaagctctaagttgcatcatgcataagggttctgcttctgatccaattagaggacaattatctttctaagtacttaagcaataaagttgttagggcccaaaaatacagctcaatggacataagtaatcaaaaggaattgcattactgacttgcatccctaagtggccactaaagaacgtccaatttatggtctctatcttacttctccactcagagaaacctgagtttctcttccctctctcaattgctccttgcctgtggctgcacagaagaaggctctttttccactgttttctcacctcttaaaaaaaaaacacaaaagtgaggctcctttgcctgccctctttcctactgagctctgattgtgctgctcaagagcgtgcaggtaatagtaaatgggtgaaggccagcaaggctgtgacaaactgaagaggcttagctaacagagggctgcaccccagaaatgcctgtcattcattcactcaatctacaacaatttatagagtgcctaccttgcttcctactttgggtacgtcagtggaccaaacagacaacaagcagcgctcttatggagctaacgttcattttcagagaaacagacactgaatcataaactgatggataagcagagtatctagtgtgtcagaagataatacacactaaagacaaataaaatggcaggaaaagagattccagggaaacaatgaggaaggtttgcacattaaataacatgatggtggcaggcccctttgagaaggtgacacttgagcaggaacatgagctgagacatggggcatgtggacatctggggaaaaatgctttgggtagagagaattccagtgcaagaaccctgacaaggtagcattcttggtgtgctttaggaacaacaaagtcaacatggttggagcagatgtagaaaagggaaaagtgtaggggtgagttgagagtgttaaggggagcagatcaataagaactggaagatcattttaaggatgttgcttttaccctagataaaatagggagccagaggagacgcgtttaaaatgatctgccttaggtttttatagggtcccccttgctcttgtgttgggaattaactgaaggggtcaaggatggaagctgggagaccagttagttgataattgcagttattctggtgagtgatgcttgcatctcagactagaggaacatcaggggaggggtgataagtggtgagattcaggacagcttctgaaggcccagccggcaggaattgctcacatcttggatataagctatgagagaaggagaggaccttcaagtttaagaacctgggtactagtaaggagggtgttgacatcaactgtgatagtgaagaacacaggtaaagcaggtggtgggggcagggtgaaggaggagattggaaagtaatatctattagacacccacgtggagctgtccagcagacagctgcgtagaggagtctggagttcaggagcgaagactgaactcagatctaaacgttgaagtcactggtgtgtagccgtgagatttgctttgactttgctcagtaatcttatttttgctttaaaagaagccaaaaattcatatttcttctgtgaaactttacaaattaaaaacaaactgccagactgcatttccctgaactgtcttgattcctactgctttcatcacacttttcccaggcctcatccactccagctggaaacttcagcccggccccagttaaagctaagttacagagaaataaccactctgatcttcctgaaggaaagctgtgggggtccttttgttcttcttaaggctgacctagagagagcatgttctgctgaaagtgtgcttgccaggatgaaattggactccagtttacatactcagaaatgtctgtctctagtctacctagtggctcaatctcacaacatcctacaaaatcttatctctgctctgaagcagtttatttggctttctccattgctgtgcatttgcctttaaaaagaaatactttgtttcttcatatttcccatgaacagcaaaacacagtacaaaacaaccaccttgaggcccaaaccatgtacctctgtaggatggactgtgagcttaggtccatggaccactctagataaaccttttcactttatctattacctggattgtcaatagccccacctagcaatgatccttctcttttggaagaattttttatttggataaacattataaagacttttaaccctctgactttttttttctcctttcattcctatctcttttctttctttcaatcctttatctcatttcccttaagacaatgcacattctgcttttatacagaggctaacagcttccaatgtgtctgccacactatctaagtttttcctgggacacatcaccagggctttggggagtaagaggaaagccattgtgtccatgctgaaagctttctttgttaaacattgtgcaccaaaggaggtcacatccatccagatgcagttatagatgcaatatcgttaggattttagaagacagatgttcaatgtgtttatctcctagcaatttggattaagagccttacacctaaaagagtgagtgccctcacgcttaattcactctttccacttcccagttctatgatgggtctttttctgggttaatgtcttcgatgctcagtttatgccacgtagacagagaaagaaacaaaagcccagttaaaatgagctgattaaagaatgtggaaattatactcatgaaactgccccttttaaataagaaaattggtgtcatgtgtcttttatctcaagcgtcttctttacagatgagtttttctaatcacagtgtgcattgaaccaaaatgaaccaagcttgaaggcagctctactagtgctcatttattattattttttctttctcattctgggaaaactagatttttccttgctcaagtactcttttacccttccaggaatgcatcattggcttttctgagtgaccatagacaaatgagtttctagtaagttaataaagatgtagtttctacatttttatggtaaattgagtttatcattgtaaaacaaggtctgtgtgaggcatattaaatatgtgttctaagtgcccagatatttcttagagctttcccctaaacccttctcccaacatgccgaagtagattttgtaatcttttgttttaaaaacatttaaagtggggcaggtgccatgtggctcatgcctctaatcccagcactttgagaggccgaggcaggtggatcacctgaggtcaggagttccagaccagactggccaacccgtagtagagatggataaacctcatctctactaaaaatacaaaaattagctgggcatggtggcaggctcctgtaatcccagctactcgggaggctgaggcaggagaatcgctggaacccaggaggtggaggttgcagtgggctgagatcttgccactgcactccagcctgggtgacagagcaagactccatttcaaaaaaaaaaaaaaaaaactaaagtgcagaaaacgtttctttttctttttgtaattacaggattcttctttcttacccaaagttaaaattctgttagttgaatgtaagagaatcccagctcggactatcctaattgcattggggatttttctggaaaagggttaggctacttcacagcatctaatatatatgaaaatagccagctcttaggaagttcacgggtgcaatgaagtctcaaggacagcagggaccgaccacacagtgttggcatcccccttttttgctgcttgctgcatgtcagcatattttttgtttattctgtctctctttcactgcagacaaattttcttgtgtctcaaaacttgaccactgagaatgtctgggttttttattttatagtttcagccaccaaaaaaagtcaaccctgaactttcttggggcccaaaacaacaaaaaaaaaaactacagaataagcacctattgagtgtgctttgctcagtttttctttcttaaggcaatttcttgttttgttgggggagggcagcaataatactatcatttgctcatatggaaatctctgtttgtgtttacgtgtgtgctgtggggaggggatgggctggggcaaaaggaggtgtggaaaggtcatggaaaaactgggcagcttcagaagagaaaattatggcacaaggtaaactgcagaagaagcagtatttcagaagcagggagatgctgggatgtgaaaggaaacagcgtgtggggacagggggcattcaaaacagtgctagccccccaggatctcctgaggacatgcctggagaaagaaatccttactgggatgaggacatcaaggctctaagtttttggaacttccctcccagcacaggcatagagcaggacaggatctctgagttacccaagagaaaagcctgtggcctctgctgtccaccaagaccaggagagtgggtgggaataaaaaggaaaggtagaatttgaacagagagaggaccacttttttgtttgtttgtttgtttggttgttttgtgtgaatacatcccgtaacaaaactatgggtcctttatttaaatctttcctgtactttaggctatcgttgaataccataaagttatcaacaagcttttcccaaacataagccctgtcagcacaattgtatatttgctgtgctgagcagaaaatttctaatatgtctgaacatatgcaggaatattagtttctgggatttgaaacaatcattgctggaggctttcctacttatatagggcagtcagagtaaatcatcttacttttgcttgcctcagattcttagtggcttcacaatgaacccatttgttgtattatataccacttctgtaacttcattgcttgcaccctctctctttttaaattcgcggaatttattttcctgtactctctcaggccctataaagattgttttcaaaaattatggtatgtatcattgtttttactcttaatttcattcactgcatttactgagcaccaaccaggttatctcttaatggtggcagtataagaggtgcaaagaataacccaaaggcaccatgtagtaaaggggatttgaactcagatacatgtctccctaaagtctgtgatttctgtctggaagaaaaaaatgttacctccactcccattagcccaagtctaaagatttttcctttcaactatttttgaagtttataaagcctgtgttttattttgtggtgttcatgcttcgtatcttaaacttttacttaatctattataatcatgtttgtcctgttataatcatgtttgttataatcatgtttgttctgttataatcatgtttgtccacatcatttgttggagttttatgatagtccattaattttatgtactacagatttcctaagtaattttctaatgttggacacttatgttgattcaccattatgaatggcatcattgtgaataacactaattagcatatatatttttcatattttgaacaatagccttaagacaaggtcatctcagtgtgattgctgattctaattatataaatattttatggagtttttaatgtgtgtggtaaaaatatttttcagaatagccatgttattttgaccttaagtagtgaagcctttgttttaaggatagcatttacacttttacaaatgataaaatacccttgcattttagatgaacaaatatcatcttttctaacttcgtgttgtctttgtgcagtttaaaatagatacctggtcattccccaaaagagaagcatgaggacaatgacctcaattatctgcctctcctttaaaaatacaaaaccattaaaaaatgtaaaatgattatctttatacattttattttttagtaagtgaaaaaccttacaaattctgaccacttcaaattaactttaagtcaacatgaatttgcctcaatattaacatccttaacttaagtacttacatcagctttgcgactttcattgcgcagtaatgcaaggtgattctaccttttgtgctaaaactgtaatattcatactattttgatgtcattcaatctgccttaggtatgggagtatagcaaatcaatatctactattaattgaggcagttggatatgagacatttttgctttcccctttctgccaaatgatttggtttattttcttttcatttatgttttcttccattaggtgtttgccaaactactgtgaacatggaggaagctgctcccagtcctggactaccttctattgtaactgcagtgacacaagttacactggtgccacctgccacaactgtgagtagattgatcatttgcccctggtggcttggacaaaactccaggaacaccattgttaacttcaggatgtatttagcatggggcaggcatgttttattcactcattcagcatgtgtgttttaagaggttattatataccaaacactttgttgggctcagaggatgcatggatacaagccatattcttgtggagtttatggtctaccagcaagacaggcaggaaatgagatcatgacagtacagttgaataagtttaaggtggaagcaaaggaaggtgctgtaggcacacaagagggagctgttaagtcaattgcatagtcttgatgagttgttaggtggctataataaacaaactaacatctctgtggtctaagtaacaaggtccatgctatacctgtgtcacatacccatcatgcatgacaaaggcccttcttccaccttgtccttgttcttagatggtaacaaaattctattatctggaagattgctgtagtaagaggaaacacagggagggaagcacagggaaacatgggctagcttttcaaagcttctacttggaagtagcaaacattacttccactcacattccactggccaaataaagccacgtgggcacacccaacctcaataggggctgaagtgcaatcttgccgtggaatgggagaaaacagaacctgaatattggtgaaaagtgctaatgactgcctgtcaaccgcagtgttagggagacttcaaatagaagaactgagctgatcttgttgtagaaatatgggaggaaacaaaaacaagaaagaaacaaaaaggatactcagaagcaaagaaacaaatggagacataaagcacaggggtcctctgctctgtggaaaattggaattttcaaatagtttcagatggctggagggtgctgaaggtgaggaggagtgataagaggggagacagagataggctagggtgtacacaagataaggagtgagggatagaaaacaaataaagaatatgagccttgattttttatttgtttatttatttatttatttattttttgagagagagagttttgctcttgttgcccaggctggagtccagtggcacgatcttggctcactggaacctccgcctcctggtttcaagtgattctcctgcctcagcctcctgaatatctgggattacaggtgcacaccaccacaccgggctaaattttgtatttttggtggagatggggtttcaccgtgttggccaggctggcctcgaactcctgacctcgtgttccgcctgcctcagcctcccaaagcactgggattacaggcctgagccactgtgcccagcccagccctgatttttataattgtatagtcttattgagaccacgggtagggggaaacacatgaaaaagtatagaaagtttgccagtcagagaaatgtatgcccaactacggactataagtgtgattgagaaagataattctgaaatcactgtctggaattgcagagcatttcatgaaaaattagaaatttgaaattggcttagaaggtagaagggtaagataaacattttctagacgtaagagtgcagccaacgcctggagctcttctgaggactccagtgagaactatcgctcagggacagttctctccggtttttcttaagtgcctgctgtttttgggctggcacttggggatgcagaaagagcatggtagatgccaatagggctggaaccctgggattccagccaaggataagtaacgttgatattctcatctttaaagacctctcagccattccttagcctcttccattccttcaaagcaggattcactgatgatgtccatagggaagtctgatcaatttagagaagaactagtccactagtccactggtcatcagggagtgatgtggttattgctgttagttgcctgcagaaacaaaaaaaatattgtttggctttataaaaatatatctcattaaaacttttctactgataaatttagaaatcaaagtaactagaagagtatcattggattgttcataccacaaaggataaatgcttgaggggatgaatacccaattttctatgaagtgattattatgcattgtatgccggtaccaaaatatctcgtgtaccccataaacatatacacctactatgacccacaaaaattaaaaataaaaatacaattaaaaagaaatttagaacagtgaaaagaacaatagaataacagagattgaatttaaattttacctagatcctttttttttttttttttttttttttttttttttttttttttttgagatggagtcttgctctgtcacccaggctggagtgcagtggcgcgatctcggctcactgcaacctccgcctcccaggttcacgccattctcctgcctcagcctcccgagtagctgggactacaggtgcccaccaccacgcccagctaattttttatatttttagtagagacggggtttcaccgtgttagccagaatggtcttgatctcctgaactcgtgatcctcccgccttggcctcccaaagcgctgggattacaggcgtgagccaccacgcccggcctttacctagttcttctatgtgaatacgtataagattttatcaattgagggatcctttttttttttttgcagatcctaggaagaaaaactaatgaactcttgtgggtccatctaaggctaaaattatgtgtttttatctaagagtcccagtaaacaccaatctctaggttttaagtctggttccaaaaatattatcaccaaatagccaagaacaccatatacctatagagaaatgttgcaggacccccataaggctgtccagattgtaacgtcagtgctgctgtaagaagtcagagacaactgaaatggccatcaatttaatagcaagacaagggaaacatgaagatttaagtcaaaacaacccgaatttcagccaaatcacattacaacattcccgtgactgttaaagcttattccgctcactttctccaaaagtaatttaacaattttttgaggagttcatctctatggatactgttctcctttaatttacttcatccatcaggctaaaaatagaagatgtcgagctttaaaaaaaagtgtgaagttgaaaatcaatggaggtgaggtgctgatttttaaaggaacactgtcaagcctgatgagcaggagactcaacacacaaaaaccttaaaaatatcattttttaacaccttcctatttccttttctgtgaaattgctcaatgcctacactgtaggctgcaactttgtgaaactctatctttgcttctgggcactcagccaggacaaatcaaaatcccttgaatatttgtgacatttggcaagcacaccttggttccctgtgcaattcaaatatttgtcctccctctaactaatttccccctcccccagttgaatgaggaccattgtttttagtcattttgcaaaccaagtgatttcatcagcaagcttgtgcctcactctcagcaagcatgggtcccactcacaggccaggtgagagcttctgcagtgcagaagatggcacacagggcaccctttggcaaaaacaaaaacaaataggcctgaaattctgcacttgtggaaatgacagaatccttgctgtgtttgagggatgttttactgaaggaattgaccacagtcgaaacaagaaatacaaactctttggattaataaattatttataataatttcttgagtattctcttagttttgtcaagctcttcgaaaacagtcttttccccctcattgttggtgctttctagtaaatgtgaagcaagaggacagacttaggacagataggattaactttttttgtccagcctttgtggataagagaggtcctgggtgaggcgggcacaatggactctctaaaaaataacagaatggaaattcccaaagcgtgtagacacagcatgctgctgtcgaaagtagagatatcttcagtccgtcttaattttcttatccttacctgatgatacttaagggacttggatatgctaatttggtcacttttcaaacatacatcattcaaaactacctttttaagaaaaacatgatgaatgtgtgggcaatttctgtccaatctgtggcagctttcccatatgaagaggaaacctacctcataaagtgccattggagactattatatgatgtttgtaagttgttatggttagaaaatttctcccaaagtggtatcctattctccacaggagtaaccgaataaaaacagtgtttgcactccaccagatcaatccctggcaacccaaccaatgttcaatgccttccgactcccagagacagataccatggttattagtggaatataacgtgcaagttcagaagcctgtataatcaaaaccaagcttctaagtactcagggtatattttggtcatggtatgtcatatctactttattacaaatccaaattaagattaaaaggagcaggtttttgattgtgggatattagggcatagatgatagatagatagatagatagatagatagatagatagatagatagatatagatagatagataccattacaacatatcaataaagggatatgcatagtgttattatttccattttacagatgagaacattgaggcccagaaagcttatgtaaattccacaaggtctcatatctagtaaatggtagaagttgggctttaagccaagagaatctgcgtgttgatgccagatgctaaatcctgcatcttatttcttccttcaaacaagcaaggcatttgcaaacctctgtattacaaacttggtgatgggacattcatgacctcttttatattgcttaagacgcagtagaatagtgtgagatcataattgaaaatacagttctagaagactgagagatgagaaagtttttgtgttctagaataatcatgaaagcattatggaaggaagtagaatgacttggaggacatctaaaattgaagtagacaaaaggaaaagggaggtctgtcgaaaacagactgtcaagggctaagacatgatagtagacatacatgtgctgtattctgggacaatgcagaacttgcctggctcaaaaaaagaaaacatgaattgcactagtcattcattcctgaaggccaaatgagattcctataaagcactttcccctagagaatactgaagcacacttactattataaccagagcttttcacatgctactgcaacacctctaaatattattttaataactccaaattattttaataacaccaaaataagtagcccaagacgtttttgtttctatattcaaccatcttaatatttttctttgtctttcttattctggtgagagaggcagaggatctgttttgtttccaaatatttattattgtagccagcactatgttaagcatctttgtatttaagtattttctggccgggcgcggtggctcacgcctgtaatcccagccctttgggaggccgaggcgggcagatcatgaggtcaggagatcgagactatcctggctaacacggtgaaaccccgtctctactaaaaaaaatacaaaaaattaccctggcgtggcggcggacgcctgtagtcccagctaatcgggaggctgaggcagaagaatggcatgagcctgggaggcggagcttgcagtgagccaagatcgcgccactgcactccagcctgggcgacagagcgagactctgtctcaaaagaaaaaaatatatatatatatcttttttctaataccacaagttctatggtttacttaaacaaacctcagaaactgctttattgagtaaaaagttctgaatggttttaagaatcttgattcatatttccaacttgttttcctaaactcttattacggtttacactctgatcactactttctgagatcttgttttaccttctctgacattattgtttactacaacttgtaaaacgtttttacatgtatttttactaacacagtggcatattaaaatagagattattattgaccctcattgtgaattccagattaaaaaaagagatttttttcagatgacttgtattataggaataagattgcttccacaatcttttttcagatgacttgtattataggaataagattgcttccacagaattttcttttttcattcaacaagtactttttgaaagtacatctgattcattaaactgtgaatttagtgattactgtcacattgaacagatccagtaagtgatacaagcacttgtccttgatcttctcgatgtttatgtctgatgacactcacatgtgccctgttcaggatcttttcaccatttctcagcctttgccaatcccttttcaacagtgtaggctctctgacatcctaacaatgccctttagctcatttttcagctttgcagaaggatgtcagctttcttcctcttccaagcctgatgtagtgcttcttctatggagaagtcaatagccatgtattaatttgaagcatatcaagtcatctggctatcagatgttatagtaatcattgcagagggacaacacttgctttaacagtaggtaaatggtcctttgactgcatgtagttatgttaactaactactgagactataaacctatttaggtgagaaaacatgccttactcacacttgtaccagtcacattcaaggctttggtggcatataggctattatagaaatggtgagacagaagattaagcagaaaaagataatacagtgtgctcttagtggaaattccataagaacgggatgatatctgaatcttcccagggtctccagcctctgatctaatccctgacacatagtagatatccactctttgatgtataccaaaaacaaataaatgaatttatgaggcatgtgcacataacaatgtcaagttactgtagcaagagcattgttactttcttgagaaagtgagaaagtgctcaaaataattgaccttttagcagagatttgagggatgagaaagaggaagagcaccgacaacggccttgcaggaagagtgagctccatgagcaaaggcaaagtgacacgaatgtcaaacaacaaagtgggggctatgggacacctggcatagctagaattgaagatgaaatgggggaggcaggaaggagatgcaggaaatgcagccagggtagaaaaggcagacaatgaattgagaaggaacttacttctctgctggccaactaagagccagccacagtttgttggggatcgggttgctaatatttgtttgttgtttgctttgttcatcagtttcttttttttaatgtaatggtgatggtgctttggagcatatactgaagatggaaggtgtgggtactagggacagatactggatgcaatttgcaattttgtgggcagcaaataatgagaaccagcacaagctagaaagcagggacctgatatgaaaggcatatctaaaattggatcaagtatacttaaagaaaaattgaacacagtagagagaaggatgacttttagctttttaacttggaagacctcatggatggagaatggagtgactaagtcctgaggtctgtctcactctgacagcctagtgtcaaatgcaggctctacaagttacaagatatatgacctagggaaagaagccatgtgagctccatgtgctttaacttcctcacctgtcatatggggctaatgatagcaatcatttcaaagaagtattatgaggactgagtaaaacaatcttatttagcatggttcctgacaaatacaaatttcctgttccatgttagctgctgtttaaatagacagaggatgtgtagaaagaggaggagatttagtagttggacttcagtctagtttggggcacagtatttgcctggaaagtttcccactgtgcagaattagctggaaaactctggagggaggtccatagggaatatcagaatcagtgggtgtatagttgctgaagccttttgagtagatgaagtcaatcaggtgtggtaggccaagtgtgggaccttgaaagtaaaatattttaagagactcaagaagagatacaatcaagaaggaatgatagccaaaacatataaataaagtactacggaaagtgtaacctaggagtcagaagagggatgtttcaggaatagactattcacagagatgtctaggtacatggtatcccactgagtacttttttttcttttttctttttttttttttttttttttgagacagagtctcactctgtcacccacaggctagagtgcagtggtgcgatcttggctcactgcaacctccgcttcccaggttcaagcgattctcctacctcagcctcccgagtagctaggattacaggcacaggccaccacacaagctaatttttgtatttttagtagaaatggggtttcaccatgtagatcaggctggtctcgaactcctgacttcaggtgatccacccatctcagcctcccaaagtgctgggattacaggccgaatactctttcatcataatgattggtaattgttaaacgactggatagatgtttagggagaagatggaaaaaaagcacaataagggggaaaaatgaaataagcaaaccaataaaattcaacctgaggaagctaattcaaaaaaagaaagaaagaaatcagtaattttctgtcggcagcctaagactgtggcagtattggaatgcactggaatttgctgatccaagagaatttgtttgttgatgagtatcccagattttgtcaggatctaggtgattcaaaagcattcactgctgttgagaggatttcattctccttcaggagaaaaaactccaacctccttgaatccgttaatgaacagtgaatgcactgtgcaattgagtgcacaggactgcctgtaagggggaatgcttcttctgggagggagagatctgagcaggctgaactggatgtgagaaagtcttcttaaaaggaaacagcagatactggggtctacctgagggtggtggggtgggaggagtgagagaagcagaaaagatgagtattggttactgggcttaatacctgagtgatgaaataatctatacaacaaacccccatgacacgtgtttacctatggaacaaacctgcatgtgtacccccaaaccgaaaataaaatttaaaaaggaagaaagtcttcttaaagaagagattggacctgggcataaaggctggacttggggagtcagataggtgtcaggaggatgtttttcaagggtggatattaaaataagaaccaaaaataaggatgagcacaggggatgtttggggttcacccagtgctctagcctaaggggaaaggaatggacatttgttgagccctatgtaagtgccgtatgctttactcagtggtgaatacatgtcatctcacattctcagctctagccctgttagactccggcggctcttcaaacaactagaccttcagatttgcacatctcttggccacaaagacttcttaccactgtcttttcctgaagaaaatctgtcaactgatgcaagaaatctgagcggaccttttgcagctattacttctttttgctcctttagcattctctcacatagcacttattctaccgtataaaaattgtctgcttcttgtttttccttgcaaactgccacttttctatgcatttctccttgcatatttggcacctagttacacatagtagacaatcactgaatgtaaacattcttttatggccaaaatgcttaaagccacagaaccggtggagtttgaccttagttctagatggcttgaaaacactttctcttcacattacaacatcttaagtgcattgaagagcactcttaaatattttatggaacacagaaggatttaaaagcaaaactaatccaaagacttcttatcagagaaaggaaggaatgcagggtgtatattcaccttggattgattttcttccttttgaatacatctcagtgatttgagagtttccctcagtcatatcctacatgtcaattggttccatttcttctttccttcctctttatctatgtctttctctccatcttcctccaaccccttgttaattgaggatacagtaaagccaacttcaaatatttacactgggttgataaagagcaagaaatgtaatcacaagttttagctttgttccaaacccctacaagcaacaaaagattccaaaatgtaagtgaagataattaactgaatataatttaattgctgatgttgcttccattggagaatcattgatatttactttgaataccaagcaagaaaaattagcacctatttttaatgtatttcaatcaacagaagattaattgccagaaaaatacaaagctctagtatgtcccatgagtaagaagttatctggaatatacatacataaaaaattcaatatatgaagacacagttttcatttgtgcctccactttgaatccagacagatggaggttatcaatagctctctggtatcagacaaattatttaacttctttcagccttggttgtttttggtctctaaaataacagtaactcctttacacaattgttatgtggattaaaggcaagaaacagacaacatctagcacaatatttgaaatttggcatttccaggttaaatggtatctattacatatatataaagttattgccataaaagtttagaaatactttttcatataagagacatcctttctatgctgctaggtcatatggctgttttctactatggatttctactatacattttttatactatagactaccaaatagaggttaggttttggcataggtgttgccatcagtagaaaaaccaagaggcaaaacgtcaccagtagaaccccggtggcaggttgcgggggggacgggggatactcctgcatgagtcagatcctctctgccacaaatgaccttaggcaagtcacttactttttgtgatccatgattcctcatgaatactgtgtggattatacgtggattatacatggtcactaaggaaaactgttttgatttgctctagcagcatgactcagaataagaatgtgatataatctcactcaatagtttctatttcttatcttagccattttataatattctagcctaaaataacaattacataaaccacatagtccacatcttgtctatagaaagcactaagtattaatttacactgttacctcaaataggcttttaaaataaaacaggttaaaacatgaggaatgttctgcaagcatcacagctctttcagcttccccttgaagtatttggtatagtttaattacttgggttttcatttggaatgagtcaactcaaacagtaataagagtagtgagcaataataaaacgaaggcatcatgtgattgttcagtataatttatcagtattttttaaaactatgactgacttgactaagttgtcatgaaatgaaggaatttccagtgtgttcattccgattcatgcaaatatattttgactatgtaattcagagacaaaagtcagaatacatttccctagtcattaaaattctataacacaataacactgtgacttatgtatagcaagttatttcagcaatgtgagcctcatttgtgccatattcaagggaaaataatagaatctgcccctcagtgctgttgggataaattcatgaatcaatgggcgtgaaatctctctgacaagtatgatcataaccctttcttatagatttcttctcatgtatttacatcatttttttcccactgcaaccttgatgagggacgaggcaagtacgctttaatgtacagaggaaagtcatgagatgtacaatggtttaatatggagagcccaaggacattcaggtacaacagcccagcaggacacaagcctgaatattgtgactctttccaagattcttcagatatatcatgctctagacaaggtcagttgttagggaaaatccagggttcttttaaaatatagtttctgttgtttcctaaaagtgactttgattatatcattgcccaacttcaaattctttagtggctctctataatcttattgaagaaaaccctttactatttgatctcagtaagtgaggcctttcattatttggaacgctcttgggtcacaaaccattttcagtcatggccctgtatgtgtccactttatagcagttgtgatccactattcattccctgagcatgttccgtttttcttatctttccagtattttggccttgaagttatttctcctggaatgttcttcctgacttgttttccaaataattgtctattctctattctactctatgctctgctctagtatcacctccacgtatacaggtggctgcaataattgacttttgatctttctctggcattaggttgagctccttgaggtcatgcactttggcttttcttgttttttgaatgtgttcccaactcctaaaccaggtctggaatattactcttgcaaaataggtattgagagaatggagttctaattttcaaattgttggcactaccttgaaatatacttatatccattccttattgagggaaggtgaaagatagcaaatcagataacaggccacaacctccgttaggctttcccttttagcaatcaggtaggaaaacttcccatttttaatttgatggaagaattgaggatcctgctttttatttaaagagtatttcttaaagatcctcacactacgtccccatttgctctcaaactagcttgtaaatgattcttcacttggcatagctgtagttccagattttaagatattagcataaataggatttttggatggctgtatatatctatatctatatctatatctatatctatatatatgtgcagaaaacatgaaaaggagataaaattttccattgtcatagcgggacatgcaactgagtttattagtctgttaacggaggagttgtcaaagtcagttttcagtggcacagatttcctgctggcagctaatgtgatgatgaagaccctggcaatcattcccttgttcctgtctgcttgattttgctgtcgtgatgcctggaagagggagctaatatttctgtctgctaacattttatttcattactgcatgtttactaaatgggcattcaatggaataactgttacataacatatgcagattagggatacctgcagctcacaggccatcagaggagaagctgggctctctggcttctactttaacagaagtcttccatctaatgacatcactgggggaatagtcaaaactacagaaaacaaacccgttctgtatttggttttgtgtttaatggcaatgcagtatgaaaaaggaattgtttttgaagattaggctgccctgggttaaattccaggctctaacaattactaattgagtgacctgtgggaaattattcaccttctcagaacgttagttctctcatctctaaatatagggatagtgatatctatgtcttaaaattttttaataaataagagattatgcttagagtggtggatgcagtgcctatataggaagtgcctgattaagtttacttattttacttcgtcagtcctctacacttctacattttctggccatctgtgcgtagcttttggactagtagcaagttctgatttctatgtttggaagggacttttaagtgcaagtatgttttcttgcagacttcttcaaatcgatgctctagaaacggactgataaatacctcctgttatcactgtagttctccagtagctataagatttatttcttttaggtagtaaaatgtaccttctaactttccttagttagttttattttggctctcaatgatcctactatggacttgccattttttccgcagcactatcatcacgtctcagtcgcttgacatgaagtacactggtgggctccatagctcctgaaatcactggattcagaacatacctaggaacaatcagagtgagaaattgcctttacttattttaattagcatgtagtttacttatcattacattataatacatccctaaatcagtgaaagtagctgattccacagtttattttggctgttgttatgacataatttcattgagatatttatttttattcaacaccaattcttgtacatctctcctattttggggtcacccattcatgcaacacacatttgtatcaggcatgtataaatatctattcagggttcaacagtcaaccaaatattgtgggtgacacttgtgcaattgaaggtctgcttcctgttctcaaggactttaaaattagcaggaatgtgggcagaagggagatgggttatatactaagaaaataatgcaagattgtacatggtcagaagctaaattgaatataggaaatggccaaaatataggcaccaaacaaggagaaggagatgagccgtaaagggaagggatgctggataatgctggacttgagccaaaccctgtggcatacatgggatctgcacagacagagaatatgacagagggtcaagaatcaagactgacattaacttggttggagttggggtcagagggatatggacttgaatagttcggggattcttattaatggagagaaataatgatgatagacaaaactggtatcagccagagttcagagaacagaaccagtggaaaaatacatgacaacaatggtcacattgttatcctgaattgaccaagatgctgaacatggccgggcacggtggctcatgcctgtaatcccagcactttgggaggccgaggtgggtggatcacctgaggtcaggagttcgagaccagcctggccaacatggtgaaacctccgtctccactaaaaatacaaaaaaaaaaaaaaaaaaaaaaaattagccgggcatggtggcaggcacctgtaatcccagctacctgggaggctgagacaggagaatggcttgaactcgggaggcataggctgcagtgagctgagatggaaccactgcactccagtctgggggacaagagcgagactttgtctcaaaaaaaaaaaaaaaaaagatgctgaacatgtgaaaaaaaactgcccttgctttctacattgcaacaaaacttggggattcataatcttacagctcaaaagggtctccccacagtcttggaactgtacacccactggaaaccacaggataaagctcaccagggaattttctccccagagggagacagcatccctacttcagaaggccgaggcggtggatcacttgagctcaggagtttgagaccagcttgggcaatacagtgaaactttatctctaccgaaaactaaaaaaattagccaagcacggtggtgcacgcctatagtcccagctccttgtggggactgaggtgggaggatcatttgagcccaggatgttgagtctgcagtgagctaagatcacaccactgcattccagcctgtgtaacagagtgagaccctgtctcaaaaataaataagtaaataaataaataaataaataaataaatgagacaacagcatctttgatgtggacagctttttcccaggatcatagatcaagacttctctattatcatgacactctttgtttttcaatttttttttctttgcttatgcctctatgaaagatagaagtgacaagggagtctgttgtgcacactcaagggatacacttttatttgtgaaagatttttcagctagctttaaacatgcataaccttataccttgatagatgggagatgaagggccagtgtgggtgagaaaattttatggtacatatgttgcctcataatcagtcagaaacagacattgttttactcctcttaacatatgtaatggatcaaaaataatgctgccaggaggtcttcgctcttctagaatggcatcatttgttaggtcctttttaccatgatttggagtaaatgaggcaatgattagaaattcattcctcatgataggctctatagtagattctattgtaaaggatatggttacacaaaatattttatattctcccataaaagttatgctaaataatagaattgctctaaattacttacttactggataaacagaaaagtatctgtgcagctgctggaacttcttgttgtccatggagaaatacatcacatcaggtattatagagattcagttgtaggagattaacgtagagactgcttagctaaaacaagtagactcttcatctagctcattctttgatctattttatcttagttggtttggtttatggggaccctccaaactcttggtattatcccccgatagtcataatagtagtctccctggtgcactgtattttttcaaaagttttaaatgtttgcatgcagccttctctagaatgtgaaatgatctgtcttcaactgggatgacaagagctgaaaaaaatgagtgatcgtgagggcaccataacctgtgaataacatgctgagaccagaaaccctaaatgatggtcactgagagtggtgctaaggccctaagttttggtcacactctcacctaagtgagaaaatgaccaaaaggagggagtttttaagcaaaataatgggaagcaattgttttggactgagttcatgcactaggttccaacagaccagaccaaaccaaagtgtagtcacttatgctaaatgtgacataatcaaactaagactttaaggaaatacatagatcctagaacaggccaggttttgttctttgtttgtttgtttgttccatcataaggaggcaccctctactctaactttcacagaaaataacctgaaatcctgtccccaccttacaaaactcactattctgctatttcccagtgggtttcaagactaaataagtacattgacaatggtgacaatgacatcaatgactaaagttctggtcagtctctcaaaattgagaggataaccaaaagcggggaattgttaaatcaagtttagcctaaagctgcctctttacatattttaagttcagcctaaaggcttctctgtaagttgtcaactataacctaaacagagttgtaaacagactgtagccactcactgagttttggccaatcaaaggtggtcaactgttcaaaccatgttcaaataaggcagatgccaagctgtaaccaatttggttgtttctgtacctcacttccactttctgtccacatattttcttctaccacgtggctgcactggtgtctctgagacaagtctgactcaggaagctgcaaaattcacgaatcgttctttgctcaattaaacacttaaatgtaatttggctacagtttttcttttaacaagtgcttggccccctcctccttacagcctccacaatgcataacagttacgtttggtcatgatgcccagaagggtgcagtctccgtctctctctctcagctgtccatccccatctctcaatatctgtttatatagacctatgcatgtgtgtatctgttcgccttaacaaggtgagaggacaaaacctatgcatatggagtgatttgcatgacagtacttgattctttgctgaatgataaaatagatataaaggagaagttcagaacaatatgggatgtcctaagtttggggaatctttatacagggagtgaggagaagcgaggccttacaggatgcaggtatttgcataatgtgtggagcacagggggaacgggagtcattggaagtagagggaatgcctggctcctcaaaggctctcactgaaggattatagaatgtgatggatatgatagggaagagcacagatcgtgggcttggggccaatgaggaaaccaggggaataggtggatcacaatgaagtatctgctggagaggcggtaggaaacaaggctggaagtcactaacccttggagagagaatatcctgttttatgctttcaaattcttcaaaattcttctccgaacatgagtctttattagcaaagatcatttcaggtttcttaattttaaattaaaatcatgccaaggtgggaataaaagtgaaacagggaaaaaagtaaaagttgaaataatgcctttgtaatagtctctagtctcctcatttttctttctttaaaaagtccaatcctctaattagaagacaaagaataaaagtgagtgcatagattcccttatgtgattcttctactaagaaatcaaagctctttcattttcaattttctagcacgacaacataaaacaatctcattaaggactttgtcgaatattggtaaaggttagacagagttcaggcggcagggactgagaaaaagtgtttgagagtttgagcaaaaattggaaaacttcagatttaagttttcaggaagctgaaatggaacaaaaagagaaagcccacaggtaatgatcagtcaagagaccctcccttatacccaaagacctagccagcacagagatgaaccagtgtcctgaaatgcaaacttaataggaagaaatgtgaggtgaagcccgttgagatcccagcctgctgaggaaagaaatcctattgtatatgcacatgacgcatccccaggaagagaaagactacctgcattacaccattctccaaaagcggccgtcatattgcagtgtcgatggtacctcagggaacctattctcaagtcaaagacagaggaacattcttaagctggtgctgtttcacaaacacggaggcaggggcttagagtaggagtttaaattacttattaaaacagatggtgaaatctctctctactttaaatctgcgttaaaatgaatcttgaaagactgaaatccaagtgatctggaaagactacaaatggaagttgctgtgtaaatctggtgaacttttcagtgtaaagcgattccatgccatttagcaggagcttgatttctttggatcggaaggcctcggtggctgtgtctcgtgtctgtcattttgcaggcatgtggttgggaattggatggcacaggcaggcacaaagcagcctcatcggacagtattcaagtggcagtagttgttgctcacctggctttactcactccagaaaccaggatttgactcaaagaggcagctgatttcccctgtcaattgtctgtttataatagtttctcaaaagagattgaactcaagatttctgataaggacaaaaataaaaataaaaaagcaaactcagagcctagaagtcaaaaggcaggataaagatccctggacactaagcaaactctaaatcaagagtccagggctcttgcctacctgggctagcagctgggacacatccctgcaaaagggggctgccagcttgtctggatgaccttggaaatgatccagttctgatggcctgctcaggctctgtgcactgagctggggcagaccaagtttcaaagggctcaaaatttatataatccatgaaagtttttttttcctaaattatttttggaatgagaaaagaagtcactacaaattactaacattttaggaaaaagacaataccacagatatttgcaaattttagaacaacataatgttttaattaacttcttgacacaattttataacacttttatttccttacaacttttgcctagtgtttgattgcttccttatatgatgattttgtttaaaaaattgcagaaaataaataagtaattcagtttttcctctagtatggttgataaaatcatttcttaaaaaattatattcataatttaaaaaaggcttttttttccagcttgacacctcattattggtgatgccacataaacttttataactgtgattgaattggggatatccatgtgaagttccatagattagatagtaagatttattagaatttccacagaccagcttctgcttctgtacatttcacaccttgcttccctacacgacctacactcttccattgctggtgctacaggagacatctctagggagacatgacctctggccctgcaccatttttctctgatgctggatgactttgcatagcaaggagcaggaatactcagggaagcaactcctcaaatgcaatggctaacaatccatgtacatagccgggaacgatatggttatatgctaccaatgtaaactaaatatgtatccacagcatcatttcccctcactggatcttaaaagtttctgtggcctctccaatgccacctggcttgagaagtgtaacagtgggaagggcaggggaaagagacagtagtattaacccattgcagttcaatattttgtttttactgattgccattaaaataacttttgtgaagtttaatagctttataatgtgtcaacacaatttgactgaactaaattccaaagcatttcctttcctgtatatttcgacttaggggaaaaccacaggaaagatacttttgggaggtttggaagggggaagggaggctgcagtccttatgtgtttcacatccactacatccactgttgctggctttttgactcatctcaccggtgaggcagtgtctgggcctggaactgctccaccttcctctggatcctgcttcagcatctctaccttctgggtcaggtgtgtgtgtttagctctgtgacaaagccccccagcttttccagaatactcacatcaccaaggtcaatgacaacaggaagttccatgggttgcagtctgtcttcctggccccagcatgtcctcatgggtttcaatttaacctagctcccgcacctcctcacatccaccttctcctctccactgtggtcttcaaactccagcatctgatgagaagacaacagctttccagagatcacttcacctgctcccacaatagcatcaggtcaaatccttataataaatacaggtatacctccaaacagcctacttctctgacagcctacacacaccagcccttactgacacacatagtttacaaaatgcataatgttgtaaacacattgctcgggttttgcaagaagatcttgaagctgcagcttccggagctttaaaataaattcatctctagcccagagctttctgcctcggttttcctgctggtggtcatgaagtttcatgacaattagtattctctcatcactgtggtgataaggaacttaactataagcatgatctagtaggaagaattacaacgtgatttgtatttaatctggaaatgggtatctcatattgcattaacataaaatgtcctgggtaacagaagtaaatatcctctaagtgtagctcatggcatatttgttcatcttttcctcaaacctcatgtgaactgcacaagctaaaggacacagatttttcatcgtaaaatatccttctcacagcttgaaaaatagacattcaccaattcacacagaaagaccactctttaatggtatgcaaatgcaaaaatgtttattatattaccaccatggcctctgcacaaagaattctggactcgttaaaacaatgacagtgaaatatagacaaataaatactgtataattatttccaaggatgccttcaaataacttccactaggatagcccttattactctgtctagttgaaaccagttttgaacacttatgaccacaatataactgttttatgagttttttgttttccgcatttagaggcgaaagcatggagcgtagagtcaagaacaaacatcagatttacagatagagcccttactaatgggggtggctttggggaaagctctcacattgtatgagctcatttgcattattcataaataggaatacttgttagcaggctctttccccagaaggcttcaggaaccgtgcttaagtttagggagcaagcatgtaggctaaggtggtaaatgaccctaacctgtcagtggcttagcaaaggaaaagtttctgtttttctcactcacactgcaggatggctggtacatgaagctgtacaggggctcaatcagcttctatgttatcactccatttcctttcaggtcctggggaggctcttttcagctgatagagagagaagaaaatgagaatcacatgggaagttctaagggttatgcctgaaagtggggcacgtgtctcactcagtttttacttgagcaacactaaactacccttagttcagaagcttgcatactatcctggcaaaacagggatgggagtggagagaggaattctgttgaggggcatcaaagtctaacaggaagaatggatggatccaggaacagagatcaacttgtaaatagttctctttggaatttgaatgagcctaggagacaggatctgttcaaagtgtggttacattcttggtcttacagggaggggaagaaaaaacaattgttctttattgtgggtccagacattaggcatataaaggaacttcagagaacaacttcattctggcttagggacagtgagtcagggagagcttgaagcttttttttttttttttttttttttgagttagcatgtggaagagtagtacttggggtattggtttctgagccccaaccttacaaatcttctgaagcagatcttttagtacccttcaaagaaaacagaaccttggaacagtaatgaggccaggtttataaaactcataaatagcaaagccaggattttaattaaaacctccttggctaaaacacttctctcttttttactgcacaccacgaactcaactctcaacaacagtatcacttggttgtgaggtcaaggcttacaaatatgaaacaaagtgtgaacctcctcacacaggatatggatctgcttctcaatatatggtcctgaccaggagctataaagaaagaggactggagaaggtgggtctggaataagcctcaggcaacttcctatagtaggacttctcatatatactatttaatacctggagaaaagaggcaggacttcctcacttagactccctgctcactagatggcgatttcaataccaaagccaaggatcaacgaatgagctgtgctatcttatctttagagattattttctagttgtatgactcaactggcaatttgtactgatgatttgatctgttcaagtccccaaattttctgagttattgaggttttgttccatgtaatataacaacaatggcatgagtcagggtcgctgagcccctgtaagcatgaggacagcttagctactatccagcggagccaggagcgggtgctggcctgcctgcaggacacatgattttacctctctgagcttcaggttgagttgctttcctgtttttgtttttagcttttttatgtataaaatgaagaatacaataatatcctcatcttcaaattcttaaaagtcatttcttatttaaactttcacctctttacctttttagcttagagataggttagatgatgtgatcaagtcagaggcctcagagaaataaaagaacaaataatgttatccatggggagggtgtgtcaagagtgaagtatcacagcaatctaaaggctttctttgctatgcatcaagctagaaagttgcaattgggtggatagatccttccagggcaacctccaactgtgtttggaagctaactacagggaacatttgaaagtttgtaaagatttcctggagactctgatactgaaataagtctctgaatatcatatccgattttttatattaaatgtacctgggtaagatgcatgagctcctacctctgtgaaggggaaaatacgcagagcaaagcctggcctgggttcagataccagcttcctgctgaatggtgagtggacttggacaagtcagagtcctgttctgagcctccttttacttccctgtaaaaatgaagctcaaccctgttgtatgagattcctgactgtatgtgagtcaggcactataggatcaaatggtaaccactaactcaagttgtaactatagtatcaaatgctaactattgttatcagatggtagctactatgattttgtctttagttccatgtgctataatcatctgttccatgaccatctccctgtgctgaatacatttctccccctcattatatactgtattgtgtagcatcctcaatttattctgagtctttggataatttgaaatggattacaatgacagatgcatttaaggcttaaatcttaccatagtattgaatcaacttgtaaacaattttttgccccagaaggaagaaatatttatatttttctttgatgtctgattgtttccatatgttatacccagatatatggagtccaagataaggtatagaatagttgtctccaaattctagtgtgcataaatatgtccctctgccaaacttaggtctcttttttaaaagatctcttattgcctctttctggctcagatctttattcttcctcagggggattgttgcaatagtctcctcgtcttttggggcctttgtatagctagttccactctggcttccagaaaggtctctcagaaggccacgtctttataaatcatcagtgatgcttgaattcagagtaatcagcctccaaaaattatttctggaaagacctcaggtggtaagatgataaaatcactagtcggagcagaattattgaataagtgagttgggaaacattcttaacttacatagttacatgatgactatttcccctaaaaaaaagtaagattactaggaaaaacaaaagaggagagaagaaatatatatagagacttagggttctgggaaaaggtaaatttattgttttgactagtggtatgttgatacatattggaaacttgagttttcagcaatgggtttaaaagtgtaaaaatctcaggcctgtcacgatttaataagagttaattttcaaagtttcctttcccttccctttctctttctttctttcttttcttccttccttccctccttttccttccttccttttccttccttccttccttccttccttttccttccttccttccttccttctttctttctttctttctttctttctttctttctttctttctttctttctttctttcttctttctttatttcctctttcttcttcttttctttctacaatgcttctgaaattttaacttgcaaaagaattacctgacactattatgaaatgcaacttccagatccctatccccagagattctggtttaataggtcaggatggggcccaataatttgcatgcctatcttgaaagctcagagtatgccaattgtcgtcggtctgaggaacatactcagggaaccaatactttagaaggtgtgtgtgcccactgagaaggttcaagccttgccgtatctttacataccaacgactttacttccaggcatctgatggcctagactcaattcagctttgaattactgggacagtttatattgagcttgcttatgtatttatattttaaatataaaccttattattatgtaaatctcatagattaatgtatcagatcatggagggtcagggtgacgtcaatgtaataagaatgttagtcacaacaacattctctacttatatttagcaactgttgctacgttttatcttaactaaaatgtgtggtggtttttaagaagaaaatgaagtacagatgccggcttgggtggtggtgaagctctaggcaggcacagtgctttctttgcctttctcacagagccagaggtcatctggctcctgtgttgccctaatcagacaccacaggccaaatcaagcagacaccaggctctggtgcagtgtgtcccgggagcctgaaacatcttttgggacctgacctacaacataacatcccatcctttaactttttttcaggtttattgaagcatatttcatagaccatacatttctcctatttaaagtgtacaggttagtggtttgtagcatactcacctggctgtgcaagccttcttcactatcttaattgtagaacatttcgatgccccaaaaagtgaccccatacatggtaagtcattcctcatctcccctccaccacccccagcccctgcagtcactaatgtactttctgtctctataggcttgtctaatttggacatttaacataaatggaatcatacaatatatgctctcctatgactggcttctttcatttagcacgttttcacgatttatctgtgttgtagcatgtctcattccttttcactgcctagtaatatttcatggtatggaaataccacatttgtttatccattcattggttggtaggcttttgggttgtttccactttttgactattatgaataatggacatgcatatgtcagcttttatttgggcacatgtgttcatttctcttaaatatatacctgcaagtgagattgctgacttaacctcctgcctcctttttcgactttgtaccttgacataatttatagtaaactttgaacaaaaaaaagcactgtgaggttctgtgtaccccagtttcccctgtgctaatatcttacgtatttatggcacgatatttaaaaggaaattgatgtcggtatactatatggagcttactcagattgtatcctttttacgtgaactcagttgtgtgtgtgtttagttccatggaattttaaccacatgtagacttgcacaatcactgccataatcaagaagcagaatagtttcatcatgaggattcctcctgctatccttgctgtggtttgaatgtgttccccaaagttcacatgttgaaaacttaatgcttaatgcagcagtgttgggaggtgggacctttaagaggtgattaggccatgagtgctctgacttcctgaatgggttaatgctgttattatgggagtgggttagttactatgtttctcatcaaaggatgagttttcccctccctctctctctctgtctccctgccattccaccttctaccaacggatgatataggaagaaggtcctcactagatgcagtcccctggaccttggacttgcaagcttctagaaccataaaaaaataaaactttgtactttataaattactaggtctcacataccctattatagcagacagcgaactaagacaatcctgttatggccgcacctgcactctcctatctccatttgtaacctgtagcaaccactaatctggttccatctctaccaatctccttttaggtaatgaaaatgttacagaacctatgtctattttcagcctgtaccagctatgtgcagactgggacaccaaaagatctattttctaatttaatccccagacacattgtttgaactaatttcagcactcccattagttttaacatatttatttttcttttcttcactgaaataaggccaaggcaaagtccctcaaacctaccgcacaaggggtttgataaacttaattaaataaatggctgctaaatgcaaaatgcttcacaagcatttacttaattactagaattaatttgatcctattgatgtccgtaggctgtgcatggagatctgtaactaaatatgcagtcatgtggtaaatattatattgctggggacataggaacaaaggaagaaacaggactgatacatttttaaggccttaaaaatatgtactcagcttcttgtctatttctatagttttacaataggaatataaatggcagtgcagaaacaccacatctctgaccttgatacttgaaaaggtgaggtctaaataaaactatttcgctgtctgaatactatcattatctttaatgagagtgggcatcacaaggacatttcaaattgtaccttaggcaataaattagctgccagaactatattcagactattttcctcaaaaatgaaaacactgatccatctgctctgtccagctacattatacatctgttcacattaatataaaaatctattctgaagagacttaatatgtctatcgttgtccttttcattgaagagcacatatctttctgagtacccctaataccagaccttcaaatgcaacaataggtttactagttactgttttttctaatggagacaaatcttgttactgataatgtttattttgcttttccttcacactcccatcttcttcccaacagaaaatgtgatgatttcctcaaagatgaccttcaatgctaatttagagcttgtgtaagatgtagcaagtcatttcatatacagtggatggtaatctctgtcttgagctttactaggtattgcagagaacaaagatattgccatacaatttttaagtttagctcaatttaacctttaccaaaggttaaacaagagagatcaaaatgctaatccaaggatttccatacatagcagtggagaaagagaaaggaagtctacctaactcagactgatgatatggaaaggctttctggaggaaggaagccttggatttagtcttgatgaacatacatattacaccgatatgtcaccatgttgcacccttgttgcactgttgctgttctatactgagaaggagccaccctgcactcatatagtgaacacctactcatattttaaagcttaccttaatggtgggaacatttatggtgtcttctctacctctgcagaaaagattactttataattacaagcagttcaaaaaatgcttgtttatggaacaatgtaaaaccaacaaaataagtcttcatcaaacaagtcttgcttttattcttattccttcttcctcttcctttccattctctatacataacctttataaaaatgctgttttcttaaaaaagataagcaaatacaaataagttcatacccccatttattagataaacattagcatagtatacatgcattgtctgtgcttttctctcatagctatatattcagaagctcagcttgtagtgttacgtgtggggatgcttcattcctgttcaaagctgaactatattccatgagtgcaacatagtttattcaactagtcctcaattgatgaacaccgaggatgatttctgtctttttgcaagcacaaatggtgtttttaaaaaaatatggaaacatcttttttcccccattttttaccagtgtttcttggagcagatcactagacatggtgtttctgggtcaaagtttaaatgtatctgtaattttgctagatattgctaaattccacatttaggatttgtatgatttttgcattccctctcagccacatatatatatgtatacgtgtgtatatatatatgtgtgtgtgtgtgtgtgtatcaaaataaaaggttaaatggacaaatatttatatataattagcaatgatccaatatctatgctcatgatatgagtgaccactcatagaaaaataaatgcaaataaatctacaacacataaaaacatgtctgaccttgcttataggaaaaaaaaatgctaaagaaaatgacattgaaatccaatttttcacatatcaaattagcaatgatccaaaagattgacaacactccactgctaagcctgctagggaaaaggcctttcccctataatataactaatattctcattttcattagcacttatttttctataagtaacgtcagacatcttttatgtgttttagatttatttgcatttatttttctatgagtctccactcatatcatcagcatatattcctataggttgctacctattgtgtctttatttttaacttgtaaaagtatattagaaatgttagtgctttgtgatgcaaattgtaatttttcccagtttgtccatttgccctttttttgtttattgtatcttttgccattcaaaaatgtttgtttatttttttaatttattttgaatattaggaaatttatctatatttttgttcattgcttctggattttgaatcattgttagtaatacttttgctgcttctaatttacatagaaattcagccttgtttttctctagtacatgtatgtattctatttttcaatatttatttatttatttatttattattattattatttttttaattatactttaagttttagggtacatgtgcacatagtgcaggttagttacatatgtatacatgtgccatgctggtgcgctgcacccactaactcgtcatctagcattaggtatatctcccaatgctatccctcccccctcccacctccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcctagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccctgaggaatcgccacactgacttccacaatggttgaactagtttatagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcattttttcatgtgttttttggctgcataaatgtcttcttttgagaagtttctgttcatgtccttcgcccactttttgatggggttgtttgtttttttcttgtaaatttgtttgagttcattgtagattctggatattagccctttgtcagatgagtaggttgcgaaaattttctcccatgttgcaggttgcctgttcactctgatggtagtttcttttgctgtgcagaagctctttagtttaattagatcccatttgtcaattttggctttggttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcatcgtttattaaatagggaatcctttccccattgcttgtttttctcaggtttgtcaaagatcagatagttgtaggtaagtggtgttatttctgaggactctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaaggcattggtagcttgatggcaatggcattgaatctgtaaattaccttgggcagtatggccattttcacgatattgattcttcctacccatgagcatggaatgttcttccatttgtttgtatcctcttttatttccttgagcagtggtttgtaattctccttgaagaggtccttcacatcccttgtaagttggattcctaggtattttattctctttgaagcaattgtgaatgggagttcactcatgatttggctctctgtttgtctgttgttggtgtataggaatgcttgtgatttttgtacattgattttgtatcctgagactttgctgaagttgcttatcagcttaaggagattttgggctgagatgatggggttttctagataaacaatcatgtcgtctgcaaacaaggacaatttgacttcctcttttcctaattgaataccctttatttccttctcctgcctgattgccctggccagaacttccagcactatgttgaataggagcggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttgtagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcgttttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgctacaatttcagctcctgttattggtctattcagagattcaacttcttcctggtttagtcttgggagagtgtatgtgtccaggaatttatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcagtctatcaattttgttgatcctttcaaaaaaccagctcctggattcattgattttttgaagagttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcgttatgtatccagtagtcattcaggagcaggttgttcagtttccatgtagttgagcggctttgagtgagattcttaatcctgagttctagtttgattgcactgtggtctgagacatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcctcttgttgaattgatccctttaccattatgtaatggccttctttgtctcttctgatctttgttggtttaaagtctgttttattagagactaggattgcaacccctgcctttttttgttttccatttgcttggtagatcttcctccatccttttattttgagcctatgtgtgtctctgtacgtgagatgggtttcctgaatacagcacactgaatacagctcttgactctttatccaatttgccagtctgtgtcttttaattggagcatttagtccatttacatttaaagttaatattgttatgtgtgaatttgatcctgtcattatgatgttagctggtgattttgctcgttagttgatgcagtttattcctagtctcgatggtctttacattttggcatgattttgcagcggctggtaccggttgttcctttccatgtttagcgcttccttcaggagctcttttagggcaggcctggtggtgacaaaatctctcagcatttgcttgtctgtgaagtattttatttctccttcacttatgaagcttagtttggctggatatgaaattctgggttgaaaattcttttctttaagaatgttgaatattggcccccactctcttctggcttgtagggtttctgccaagagatccgctgttagtctgatgggcttccctttgagggtaacccgaactttttctctggctgcccttaacatttttttccttcatttcaactttggtgaatctgacaattatgtgtcttggagttgctcttctcgaggagtatctttgtggcgttctctgtatttcctgaatctgaacgttggcctgccttgctagattggagaagttctcctggataatatcctgcagagtgttttccaacttggttccattctccgcatcactttcaggcacaccaatcagacgtagatttggtcttttcacatagtcccatatttcttggaggctttgctcatttctttttattcttttttctctaaacttcccttcttgcttcatttcattcatttcatcttccattgctgataccctttcttccagttgatcgcatcggctcctgaggcttctgcattcttcacttagttctcgagccttgggtttcagctccatcagctcctttaagcacttctctgtattggttattctagttatacattcttctaaatttttttcaaagttttcagcttctttgcctttggtttgaatgtcctcccgtagctcagagtaatttgatcgtctgaagccttcttctctcagctcatcaaaatcattctccatccagctttgttccgttgctggtgaggaactgcgttcctttggaggaggagaggcgctctgcattttagagtttccagtttttctgttctgttttttccccatctttgtggttttatctacttttggtctttgatgatggtgatgtacagatgggtttttggtgtggatgtcctttctgtttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgcccattctcagatctccagctgcgtgctgggagaaccactgctctcttcaaggctgtcagacagggacatttaagtctgcagaggttactgctgtctttttgtttgtctgtgccctgcccccagaggtggagcctacagaggcaggcaggcctccttgagctgtggtgggctccacccagtttgagcttcccggctgctttgtttacctaatcaagcctgggcaatggcgggcgcccctcccccagcctcgctgccgccttgcagtttgatctcagactgctgtcctagcaatcagcgagattccgtgggcataggaccctccgagccaggtgtgggatatagtcttgtggtgcgccgttttttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggctcacgcacggtgcgcacacccactggcctgcgcccactgtctggcactccctagtgagatgaacccggtacctcagatggaaatgcagaaatcacccgtcttctgcgtcgctcacgctgggagctgtagaccggagctgttcctattcggccatcttggctcctcccaccttcaatatttaaatctctgattcaattaaaatttgatcgtggtctgcagtatgaggagtggatttaatttcatctttttccatatagtttcccaattatctcaataccacatgtaattttttttgtttttctactgatttgagttgcctttatcaacaaatatctatagttgtgaattatttatttaaatatttagataaattattaaatattgaacctctcttgattttttggattaaacattcccttggccattatgtaattttaaaatacgttatttagttctgtttgctgacactatatttaaaattttgtgattgatattcatgagtgattctataattttggttttctttctttatgatgtttgtcaggttaaggatcagctttgcatttactttacataacaaatgtggaagatgggaagatatctttcttcttctgttctttggagaaatagaagtaccagtgagatgatttgttctttaaaaggttcatttgagaaaccatttactctcacaatattacaatcttactctattatctcagggagtttttttgtttttgtttttgtttttggagatggagtattacttactcagtgacccaggctggaatgcaatggcaaaaatgtggcttattgcagcctcaaactcatgggttggggggagctccttaaatacttttcctattttttataggaacaggtcgatttaaattttgtgtcagattgaggttaatgttggtaagtttaagacgctgaataacttgagatttagaaccatgtcttttttttttgcatgtgattttctcagagcttaccttagattagtgaaaaacaagtgcattctcaataaacgtgtgtggagtatttgttccataatgtgttaggcaagcaatgtaggccgaataatttagtaaacaaaagtgtatgcttgtacttcctgaaacagttggtgaattgcacatgtgtgtttaactttgtttccttacactcctcatgaagaatagtaaatggttttttttttatttttattttttaatggctctgtaagccagcagcaaatcagaggaactctttgtcgtttaccatctccaaaacagcaacttcagtgatggggtgctcataggagactgaaaattcacctggctagaaattaggctagaaatgagggaagctgaaggagaaggtagcccatctggagtaacgcactagtaacatgtatcagtagatgagcccatctggctgccacacactagtaacatgtatcagtagatgagcaatgatgtgtgtaaatctacagtagcacatcctgcccttcattgaccttacacacatggaatcaatgtctgtgctatgctcttgcacctgccgcatctcatgtaaaatgtctgttgtgggatatgctgaccagagctatgcaaggaaaggaattctggtaaatgtagttccagtttggcttaaattgacacaactcgaatccaccacaatggcatgacaaaaggagacaaatacaggggcacacacacaaaaacccccaaaatacaacaacaatactcagagagagagagagagagagagagagagagagagagaaagagagagaaagagagaagcaaaaaccacaggggaaaagggcaagaaaatgttgaaagcagaaagtgagtagacgaataggaacaggtaacagattaacataattataatgctgaatcttaatttacatgcagtgaaatccaagaaacaaacaaatccacattacaaaatcccccaaaggcacagaagtaggaatcatcagtcacctttgcaagtgaaggtgaaggtaagataaatacaggaagagtaaatctacatctgtgtaagaagtagttagattatcaatcctctttccagttgtggacacttggtgattgctccttcaccactgagagagaagactggaagtttttcttttggagaaaacacaattcctaaaactgagagaaaacatgtatggttgaagaaggttgtaccatattgaaaatggggtaaggtatgaaaacatttatatagaaagaatgctaagacctggccttcttctcttcagctccgagatattccacagccaagcatacatcctctaaatcatagactctaacaagagcaagagaaagacaaaagacactaacgtgagcatttctcacaaaattcttcagccagataagcctacattaaagtccttggaaggcaaaccacagacatttgtttacaaataccaagtagtatttcagggaccactatcaaatacgagagaacatcccagaaagcactattacatgaaatgtaagatagagaccaaaacaaaacacacaacaattaaagcaattaaccaaacaagcacagcttaaagggaacagcctatacggagcaaagaaaggatcaaaggtactgtaatatgattaatattcttagagacatgaatgaagtattgcgtcaatgagtcaagcatcacgtgctattagagaaaataatattcaaaggaaaaaaaccaatcttctataattttaaaaatactacaactgaaatagcttaaaacggaaacaacccaaatgttcttcagtggattaattattaaactgtagtatgtccatgttatgaaatactactcagcagtgaaactggaattgacaactgatacatcacaaagcttgaatggatctcaagggaattatttttagtgaaaaaggccagttttaaaaggaatatccagcttgagggtgaggagatgctttggggagacaactgtaaccagacgggtagctcaatatcccgtattacagcaagtcagaagaatccagaagatacttttgattttcaaacacattttcaaacatatgaaaaagataaaatcggccaggcgcggtggctcacacctgtaatcccagcactttgggaggccgaggcgggtggatcacgacgtcaggagttcgagaccagcctggccaacaggtgaaacctcatctctatgaaaaatacaaaaagtagctgggcatagtggcatgtgcctgtaatcccagctactcgggaggctgaggcaggagaatagcttgaaccaggaagtcggaggttgtagtgagccaagatcatgccactgcactccagcctggcgacagagcaagacttcaccaaaaaaaaaaaaaaaaaaaaaagaataaaggcaatatcatgtaattgtcccacatgtatccttcattcaggctcaacagttatcaatattctctcatttttatttcgactatcccctcctcacttgtttgatgcaacatcttatttatttgtttgtttgtgtttttttaaactgagacagggtcttgctctgtcacccaggctggagtgcagtggcttaatcatagctcactgcaggctcaaactcttggactcaagctactcttctgcttcagcctcctgggtagctgagactataggcacaagctacgcacccagctaattttaaattttttgtaaaaacggggatctaactatgttgctcaggctggtctcgagctctcagcctcaagtgattgtgccacctcagcctcccaaaatgttggaattacaggtgtgaaccactgtgcccagctgatggagaattttagaaacaaattgtggacatataattttactacaactacagtattcatagtgaacaactctctaacacaggacaactcatcttttaaaacataatcacactgccataattgtaactatcaaaattaaaaatacttaatataatctgttataaaatctgatctataatttttgtggttatcttaaaacatcttccctctctccctccctccctccctccctcccttctttccttcctaccttccttccttccttcttcttttcttcctttctttctttctcatcttttctttaatgtgtttgaattagggtctaaacaagatctaagcatagtgtttgactgactgatatatcttttgcatttcaactccatttttgccatttttgttgaagaaactaagtgaaacattccagtattgtagatttaactaattgcattcttacagtgtggctgggcatgtgggcctctttctgtaaattggtgtttagatcttggggctcgaatacatttatcttcaatttttgtggcaagaatgtgttttagatggtgttacatatgtcttattgtgccacattagaggcaccctgataatcacttttcatgatgttaagattgacccatgagttcaggtgttaattgaatccactgactaaaatatcccattaatgtttcaactaatggtttggcagtccttgatgatcattgtttaatcctttatctcactgggcattactaaaggatgattttcaaattctattattcttttgcagattctggtttggttattctctaaagacttttttcatggactgttaagttgcattcaaatacatttatacaagaaagacaggatatgatctctgttctttctaatattcaggacatgacttcattctctattaaacttcagaggggaccaatggacttgagtagagagacaagatagatgctacgtaggtagatagatagataaataaatacatacatacatatatacatacatacctacatacatacatgcatacatatataaattgattgatggatagatagaaactaataaattgtatatatttaacaatcaaagtgactattattttttatgcccaaattgtcccatcaaactaactcctgggctgttttgagataattccagtctttaataaaagtcttgtttttaggcaaagcaagacattccactttcattctgtacttttcatggtcccaaaattgactcagtaaaatcttttttccttttatgtgttaacttttatttagagacaactctctgtgcattaatttgcttcttgcactttcagtggtccaaatgtgaaaatgcatcattttttgaaagcattaaattataagcttaagcttattaccaattctaagatatattgcagaattttatctgtttgcattttatattttatcttttatgataagtaatttagtttctgttgataagacaattattagctttttcttgctatgtttaatagtttcataatataatagcaatatcgtttaaaatgaggttattaaatgtatttttatattttaaatttttttggtaggatacatcctactagtcaaactactgtttcaatatcaaatatgtttaaatctatacattcataataatactaaaaatattttcatccgttactttggggcaccctagggaaacatttcagcatttcgaaactgatgaattaaagtgaaagcatcaaccatgtaactcgcttttcccaaataatcttgtagtttagggaaatcaaacgatgaaggttgtttcagttttgtaaaacattcccattaataaatcaggaagggatgatagcattagattaaccacctacaagctggtttgtctttgggcaaagtacttatattttatgaactcatttacagtgtccataaatggcaatgctgttaccaggctttgccctcagagatctcccagttactgagccagcatttaaggaacaagtatatcaataacagtaggttaactaagatggtaaatcaccccaagatctcaatgacttagtgaaataaacatttattttatgttcacatcccatgctgtgtgacctgttcaatgaagtcaaacaatgataaaatccatgtctaccctattgatccatttcatttagcttcttgggatttttttctgagaattttggatgcctcactgatttgccttgggcaatggggcatcagcaaacatcatgcaagcagaggcctgacaagtactttgtttcttgctgttctgggaggctgtaccatgtaaactcccctgctacagtgtgagaggccacgtgggccgaagcaaagaactacagcttaccaccacccagcctggctgacccagcagctgactgcagatgcatgaactgcccagccaatcccagactaaatggctggcctgcagaatcatggcttagtcatgacttaaagtcaaatttggagttttatgtgtgtttgtttttatacagcaaaagaactgatgcactgaggatatagatgatggaagattagcaatatactgggagttgctgaagctggttgtgatgctagcaggatcctctctgtgctctttgtatttgaaagtttctgcaatgagaaagttaaaaagaaaatattaaatttcaatattgctttaaataattcctggttaaattatcttgttttcattttctttcaatgtttaagaactattattctaggctgagtgtggtggctcacacctgtaatccctgcactttgggaggctgaggcaggtggatcacacggtcaggaatttgagaccagcttgactaacatggtgaaaccctgtctctactaaaaacagaaaaaattagccagatgcggtggtgtgtgcctgtagtcccagctactcgggaggctgaggcaggagaattgcttggacctggcggaggttgcagtgaggcaagagcatgccactgcattccagcctgggtgaccgagcaagactctgtcaaaaaaaaaaaaaaaaaaaaaaaagaaggaaagaaagaaagaaagaatagaaagaattattatatttaacttttaaaaattattgaaaatagttttatggtttcaaaattaaaaatataagacattcagaaatgtctcactttcatctttgtcccctcccacatttttctctctctccatagttatcctcttatgttaattcttacctgaacattttggtagatattttagatagttgttagtaaatttggagttaaattagcaatttatatgtagaaaactaggcaaatgagaaaatatgacaattttaaatttcaagaaaaactaaattttgttcagaaaagaaaaagtaatcacattataatatgtagttaatctatgaatagcatttacaatgtcatatcaccaaaatagtaatcattgatgtagctaaaattattatacaactagactggatggatgggggaatggaaagttgtttttattttggggatggggggataaaaagggctaaattcccattttccaactgttaaataaatagataacttgtaaaagtaaaaaaaaaataagaagtaacaatatagacatgctatttagtcattccagtcaataacagaaaaatgaactaagaatgaaaagttatttctgtgcagaagggaagttggagctactgatcttttataccaaggcttgtggtttatgatgaaaattgaaaaaaaaaatcaggtatacaaaaactgtattagtccgttttcacgctgctgataaaaacatacctgagactgcgcaatttacaaaagaaagaggtttaattggactcacagttccccatggctgggaaaacctcacaatcatggcagagggcaaggaggaacaattcacatcttaagtggatggcggcaggcaaagaaaaaagagctggtgcagggaaactctcccttttaaaaatgatcagatctcttgagactcgttaactatcatgagagcagctcaggaaagacccgccccctaattcaattacctcgcaccaggttcctcccacaacacatgggaattgtgggagttacaattcaagacgagatttggatgaggacacagcgaaaccatattaaaaactcataaaaaaaggagaggcaacaagtcatgaaacaacactactactattaataatataggctcatattaatcaagcactttctatgtgccatatgtggattgtgtctttgaatccttactacaacagtatgagggaggctctttttgagttactgtagtctaatgagacaatttatacttcgagagttgattagctacctattgtaatgaaggattctaaaacaacacctggaaacaacagacattatcatctcagagtgtctctgggaccgtaagcaacttagctaggtggttctgtcttggtctctcatgcagctgcaaaaaagatgtccacagggctgctttcgttttaaggcttgatatggggatcttgctttggtgcccattctcagggcatgctaccaaaacttccaggctcactcctgtgggcctcttgcaagggctgccttgttacattggagttggcttctaccaccgtgagtgacctagaacacccaagatggaagtcactgttgttttataatctaatcttggaaatggtatctaccacactatcatattctatttgttagagcaagccagtaagtccagcccacttggagggaggatgtgattttgtcagcagaacatgaatcccaggaagtatctgtccatcacgggaattaccttagaggttgcctagcacaggtggggtagcttgtccacgcttccacagggagaaaggggtagccctgccaggaaaaaccacccattctgattccaaggtttatgttcttaactactatgcaactgctcacatgctgtggggtggtgtttcccttttgtgggacaacagcaactccttccacatagctgtcatcccgggaatgtgggagtggttgggaggtcaacatagacaacagctgattttcacctttgtgacaaacacccaagggcattatcaggtttaggcaaacaaaaataatctgtacattatgctcacaatgtggggcacagattgtggcactcccacatacctcctgctgcggaaagtttgctggaatgcaagagagaatgccatgagaacaaggataaccttgagttcactctaatttataaaaagtcaaaccctctcaggcttcataactttcctggtaataaattatttgagccacccctcacatttgatcatgacaaactgcagcttcctcttcctgggatgggacattagtcacaaggggcaggagttggctaggagaggagttggtactatatcttgaaagctgttgggagccactgaaatgtttaaagcatcatagggtgacatgattggagatgtagctgctgctctgagcaacagcattttgtctgaagcatcagacaacattctatattctcatatatgagacagtagatgtctcctttatacccccaacagatttattcatgttagcctaataaaatttatatatttcccaaacttgcagatttatcaaagctccctatctcaggacacctgaacctgcctctatctgagcatgcagacttttgtggctgccaatcaagctgtgagctttctggggtagagatttattgcctcctccatggttccatcctctggtggcaacctcatctgttgacacgtattaggaactcagtaaatgcttattaagtcaaaataaactgaacttcgttgtgcacttactacatgttatgtactatacttagtactaggtacataaaaataagacagtctgggccaggcgcagtggttcacacatgtaatcccagcactttgggaggctgaggtgggtggatcacgaggtcaggagttcgagaccagcctgatcaatatggtgaaaccccgtctctactaaaaatataaaaattagctgggcgtggtggcatgtgcctgtaatctcagctactcaggagtccgaggcaggagaatctcttgaacccgggaggcgagtttgtagtgagccaagatcaagccacggcactccagcctgggcaacagagcagactctacctcaagaaaaaaaaaaaaagaaaaagtctttaattagtaaaaagccatactgtatgtaagcagtaatttttttaattcatgagtcaaacattggctcaggccctgctgtgattgttgcactctgctagatgctggggcacaacatcaaatgacacgtgaccactactcttacaggttctgtaacccattgaaagagacacaatggtatttggatgatccaagctcagtatacagtgggagcaaggaggaaggtcatagagataagcaaagaggagggccatgtaagaggtgaggggccacattttgagaggcattacctctgcactgattttaaaagaatgaatgaatttaaataaatggaaaataaggctgggcctggcggatcatgcctataatcccagcagcttgagagactgaggcaggagaatcagttgaggctaggagttcaagaccaacctggataacagagtgagaccccatctctataaacatttttttaaaaaaattagtcagggtggtggctcacacctatactcccagctactcgggagactgaagtgggagatcacttgagcctgggagtttgaggctgcaatgtgccgtgagccgtgatcgtgctactgcagtctaaaacaaataataataaaaagagagagagagagagatgaatggaaaatctgaatgtcaaacatcagtatcaagccactggtactggtgtgttaaggcttggggaaaaagtcaaggatatagaaggagggaaatgaatacacatagagcaaatctaagtaggagttactgattcctgcaaagggatatgcagagccaagcaaagttttatctctgctgcctttgtctttccagccatctacgagcaatcctgcgaggtgtacaggcaccaggggaatacagccggcttcttctacatcgactcagatggcagcggcccactgggacctctccaggtgtactgcaatatcactggtaagggtgcagtagccctactcacacttaaccaccccacttcatggaaggaagcaaaaataaattcactggagggggatacctacgtgaataaaaatttgaaagaccaactggtctcctttggggaggaaatggtattctggtgagtaatgcaaatttgcagctaggttaattttcatgagacagaaaaaagaaaacttgttaatggtcttgataatgtttcactgaagcaagaattaattatcagtggttttctttagggcctccaagggcattttctctcctgaaactcaaaaacagaaagaaaaggtaaataagcaaacaaacaaacaaaactccaaatcagtgggaagccctgactcaggaagctggaaagcttgattccactctggccccaagggatgcatgacccttaggtgaatactatagtttctctgagctttatcagtgaaatgagaataatagtggctacccccagagctgtgagaattagatacaatcatgtgtattggagcagctagccaggctggttgttcttagatgcctaaccaaaacaaaacaaaatgaaaaggtgagttttttcatttttctctggaaatttcttgatagcttaaacttatttctcaaatgcagaaggacatggtaagaggcaatcattacatgggcttagaaatgacatatgatccttaatttaccatgaaatacatttccacaaaaccaaatcttgaggtaatcattatttaaaaatccagctatgcagccaggtgcgatggctcacgcctgtaatcccagcactttgggaggcctaggcaggcagaccacgaggtcaggagatccagaccatcctggccaacacggtgaaaccctgtctctactaaaaatacaaaaattagctgggtgcggtggcatgtgactaatcccaactactcccgaggctgaggcacgagactcgcttgaacccgggagacggaggttgcagtcagccgagatcgtgccactgcactccagcctgcgacagggcgagacaccgtctcaaaaaaaaaaaaaaaaatccagctatgcaagcactcctattatgagcatcattaattggcacacgcacattttttgtttgtttgtttgtttcaagcactggtcttcagagatgccagctgcatcatgtaatgaagcaggaacgtaggggcctctttaggctcattgagccttcaggcctcaggattttctgcaacaaagcaaccacatttatggagtgctttctgtaggcagacactgttttagatacagagggtatgaaaagtaagacacagtggctgttgttcatgaggcagtaaagtcaggaacactaccgtgaggtatctccagctaaatgcaagaaaactattggaaagaaatggtgagtaaggaagcacagtaatttgcccatctggatacaaagtcctatgctgtctgcgtagaaaatgctggtgacctggcattgggtgccacgtccttgcatttccgtaataactttctttatctctccaaaatggttgtatgatagctgcttttcaaaagccctgtaacataattagaaattgtgctcctgttgtcttttcatggttgtggtaacctatagtgttcaacaacctggtcaaaaactaggcttctcagtggatctcggttattttaaaaatgtaattaacatatggactcttgctaaaaaggcagatttcccagccccagaaattccaattcagtaaatgcacttttactgagcttttcaagtgattctgatgcaaattgtccctgttccacttttccaaaaaacagggaaagtaatttggctgcaaataaggcaaaagagataaatgcccactgctgagtggccaggtgtgacttgtaataataagagtggtataatggacagcaattactgagcttcgactctctctgggaattgagctgggagtttacaaataccatctcttttcatcctcacaacaaaaatcagaggcagacattttttttatctccatctaacgtagaagggaagagaatatgagcatttcatgactggctcaaggtaaattctgtgactaacagtcaagacttaggaagcgggcatagccttctggttcagtaataattcatatcactaaaatgttaattggatatgttctattacatacattttgtttttaaagtgttgttttattgttagaaaattttgtaacaataattgaagaaattttgagggaaaaaagtatgaaggaaatattaaagccaactgtaatccgcaatccagagattgccattgttattaaattattagaatttcctcaagacattttaaaatgaatgtttatgtgtgtttttgctatgaatgtgtatgttatatatatacatacagacacagaaatatacatatacatttaaattataaattttaattttaatgtgttgtgtagattttccctattaaaatatatattgaaattaagataaatatagcttagaaatgttaaactcttcaaaataatgcaaggacaaggacttagagagtctgactgatacataggtttcatgtacatgaaactctctgcctcaccatccaacagccttctcccagggtttatgtttgatcatttgtccaagaatggctaaaggtgagtgtgtacttgtatttaaaggttactgttttgctgatatgatcctgaagaaatcagagcctctgaattgtgtcccgagttgatcagcttgatgcgtatggtggggtatttattttgaatatgatttttttgggtcatattcagctgcacgatgtctaactttctgtttttgttttttaaaatacctgcaaaaataaaagcagaccaggcatagtgattcatgcctgtaatcccaacactttgggagaccaaggcaggaggatcatttgaggtcaggagttcgagaccagcctgaccaacatggtgaaaacccatctctactaaaaatacaaaaattagccaggtattgtggtgcatgcatgtagtcccagctacttggaggctgaggcaggagaatcacatgaacctgggaggcagagattgcagtgagccgagattgtgccactgcactccagcctgggtgacagagtaagactctgtctcaaataaataaataaacaaataaaaataaaataaaagcaaagctctgtgtaggctgaactacacaactctcatatttaaatggaaaacaattttctgatacatacatgtaatgatgatcaaatatgcatctttctatttgaaaattttataagttgaatgttgttaaaacatgagtgacttatcacagtatgaaaagtgtgacacagtggtccagggaagagagtcaggaagaagggagagaagaaacagaaggaaacttgtgctatctttaacactgggataatcccagaatgggtgtccagagcaccagaaggcaggaaaaccaagctctctttctgcaccttgtgcctgtcagctcagttaagtgcctggggcccaagcccacatctgtaaaattaagatctgggtcctctggcttccacagcctttcctcgttgagaattctctgagcttttctttgaggttccagagaaaagagacttttcttctaagaagtctacagatacttgcaaatggatgtcatgggactgaagatggacaggtttccattgtagaaagcaatagtacatttgagtcccagctgtctcctcttacagtgcaccctggggaacgttagctcccccttcctatatgcaaagtagtccctaacctgtcctgggagatgtaagtctgtgcatctcacctgcacacagggcagtcttcaggaggggagttccccaaatgctcaaccagcaaccaccctatgtaatgtaaaaagccataatctctgtgaaaggaaattaacttaagggagatgattaagcttactgataaagtggactgaatctggacctccgcacacttttgacggggtgccatccttggaactatgttctaagttgcttcaccacagggctatcagatgggagacggggagagcacaatttttggttggagaattgagtgaagtgatggataaggaagttaaagagtaagcttccagaggaacacacacttgtcagacttttaacaatttttttaagtgatttacaataaggttcagccaatataattttactcaatataaatttgggcattgtgggcactgtgaaagtgctgtagttttaatagtgtgtctatattagtttcctagggctctataacaaactacataacactggttttatttcacaccactgcaataaaatgagtatcacaataaagcaagtcacatgaattttctggtttccaagtattaccgcaaaggggtcctgatccagaccccaagagaaagttcttggacttcactcaagaaagaatttggggagagtctatacagtaaagttaaagcaagtttattaagaaagtaaaagaataaagaatagctattccataggcagagcagccccatcggttgctggttggccatttttatggttatttctggattatatgctaaacaaggggggatttatcatgagttttccaggaaagtggtgggcagttcccaggactgagggtttctcccctttttagaccatgtatgataacttcctgatgttgccatgacatttgtagactgtcatggctctggcgggagtgtctcttagcatgctgaggctattattattagtgtataatgagcagtgaggatgaccagaggtcagttttgtcaccatctcggttttggtggtatttggccagcttctttgcagcatcctgttttatcagcaaggtctttgtgaccagtatcttgtgccaccctcctatcacatcctgtgactaagaatgccttaacctcctgaggatgcagcccagtaggtctcagccttattttacccagtccctattcaagacggagtcactctggtttaaatgtctctgacacaagttcatataaaagttatgtttacactacatggtaaactattaattgtgcaatagcattatatcaaaaaaaaaaaaaaccaaagtctatgtcttaattaaaaaaatactttactgctaaaaaatgctaacaaccttctgagccttcagtgagtcttaagagaccccatcatttttgctggtggaggaaaaagatgttagtggctgctaactgattaggatggtggttgctgaaggttggggtggctgcggcaatttcttaaaataagactacaataaagaatgtcacataattgactatttcttttatgaaggatttctgtgtagtgtgtaattttgtttgatagcatttcacccacagtagaacttctttcaaaattgaagtcaatcattccaaattctgccactgctttagcaactaagcttgtggaatattctaaaccttttgttgtcattttaacaatgtttacagcctcttcaccaagagtagattccatctcaagaagccactttatttgttcatccataagaagcaactcctcatccgttaaaattttatcatgagaatatagcagttcagtcacattttcaggttccacttctaattctagttctgttgctatttccaccaaatctgcagttactccctccactgaagtaatgaacttctcaaaatcatccatgaggactggaatcaacttcttccagtctcctgtttgatattttggcctctcccataaatcatgaatgttcttaatgagatctacaatggcaaatgctttccagaaggtcttcaatttactttgcccagacacatgggaggaattactatctatggcatttgtagacttataaactgtatttcttaagtaataagactgaaaagtcaaaattactccttgatccatgagctgcagagtaaatgtgatagcaggcaggaaaacaacattaacctctttgtagatctccatcagagctcttgagtgacctggttcattgtccataagcagtaatattttgaaagaaatcctttttttgttgtttatggacaggagttctcaatggtgggcttaaaatattcagtaaaccatgctgtcaacaaatgtggtcccatccaggctttattattccatttagagagtacaggcagagtagatttagcataattcttatggatcctaggattttgagaatggcaaatgagcattagcacttgcattagtccctaccaagagatacagcctatccttggaagctttaaagataggcattgtctttcttctcttctctacctctgataatcttagatggcacctattgcttagtgtagccactttcatcaatgatctttgttataccttatgggtaacttacatcagcacttgctgcttcaccttaaacttttatgttacgaagatggcttctttaattaaacctcatgatccggcctctgctagcttcaaacttttcttctgcagcttcctcacctctctcagcctttatagaattgaagagggttagggccttgctctgggttaggctttggtttaacggaatgtcgtgcctggcttgatcttctattcagcagctaaaattttctccacatcacccagaaggctgttttgctttcttatcattcacatgttcactgaagtagcattttaattttcttcaagaacttttcctttgcattcacaacttggctaacttgcacaagaggcctagcttttggtctatctccactttcaacacaccttcctcattaaggttaatcatttccagcttttgatttaaaatgagagatgtgccactcttcctttcacttgaattcttagaggttattgtggggttactatttggcctaattttgatattgttccatctcagggagtagggaggcctaaggagaaggaaagagacagaaatcattggccagtagagcagtcagaacacacaatattggtcaattaagttcattgccttatatgggtgcagttcatgatgccccaaaacaattagaataataacattagtgaccactgatcgcagatcaccatagcaaatgtaataataataaacaatttgaaatattgcagtggtggattcgtggctcttgccaatgttcaggctctaaggatataacaatgataataatataatataataacgataattataataataatatacataaattaccaaaatgtaacacagagacatgaagtgagcacacaatattggaaaaatggtaccgacagacttgctcaacatagggttgccacaaatcttcactttttttttaatgaactatctgtgaagcacagtaaagtgaagttcaataaaacaagctatgcttgaaccagagactgggtgacttataaaacagaggtatattttctcacagttctagagcccagaaatccaaaagtacctgcagtgccacacttcctgttaaacctgtagggtgaatctcttcttgccacttcctagcttttgatggtttgctcaatccttggcactccttcacttgcagcctcagcactttaatctctgccttctagagattgctaccctgccttcatgtgatgttgtcacgtggccttctcctcccatgtgcctgtgtgtccatttcttttcttcttacaaggatacccttcatactggattaagcccaccctaatggagtgtgacttcatcttaacttgtttacgcctgtaaagaatctctttccaaatagattacattcacaggtacggagggttaggacttcaatatattatctttctggtgacaaaattcaacccttaatagtattatttcagtcttcttcacagactaatcaaggagatgacacagcagcaattaacgtataaggacaatgacaaggtgtgcatagtgcttgttgggagctcacaggagagaccctaacctagcctggtgtgcagtgggaaggctactgggcagcagataatgcctctgaaacctgaataggagtagaagctggtcaagagctgcaggaaagcatttccaggaagacagaatgaagggcaggaacaaaggaccagcatccctagaacctgcatgtttttaggagtcaccaacccactgagctgacttgataggttggaacccagaaaatctcataaagctgtgactgaacagaagagaaaggatcaaattgacttgagcagcagcaagcaaaggctgttgaagctctgtaatctgaactagagtttcccagcacaaacatctgctgtctcagattcaacagaatagaaaaggaggaatggctttatcatagatagctcttcagcatgtgagactatttagctggccctgaaaaaaattaaaaaaaaagatgagcaacagactaagaggtagcaacaagatgtcctcacagcatgcatggaccttagcactgaccccatatcttgaggacagtggatctctcgtatggcttgttcaaattagggactattcataaaggtgtgaatatataaaaggaatttatagtgtagggactatagcacagagatactaacagagtgggaaaaaggcacatgttcagaagctgtgcctctggagatctgtggccccctgtgtgggaagcagccagctcaatccagtgaccactttgacctcagtctctcgttgctccttctaggctcctttctatgctcccctctgatgaaacccaactagaatcgagaatgcaggagtgcgtattgatagaatgcttttagtcagccttcctgcgcacagagaaggctggagatgtgcagaaagtggaactggtggggcaagtggaagatttccatattgacctgcttaaaggactgaccaaaaacgtctggggaaaatgattaaaattcataagaattaaggatggtggtgagggtaggggctgtaagtggaattcacaaaccatccaaataaatgaagcgtagacttgttaaatcaattttaacctgaacaagaaaagaccactctttatgggttaaatggcactaaggttagaatgaatgtaagaaacacacactgaataagatatttagaaaatgacctactccaagatttaatacaggtactcaatttataaacaacctagaaacaagtaaataagtaagaaaaactgtgacatgcttaaacgtaatattttgtcaaaaggtagttctcggcttcatacctccatcggatgataaaaatctggaatggatgcagagcatttcagccaatgatgtaggagtttgtgatcatcctttgctgcaccaatctaattgggtcggtagggaaagatgcatttgagacaaccaggagtccactggggactaagaattgggtttctggatgaaaatgcacataaggagaccttgcaggatgggtgagatgtcaccaggaagaaaaggagttcttggaactgggtcccatataaaagaaatggagaaagagcaggtcacagtaactaattgaaatccgtgaacacctgaggtggctgtataggaagcttgggttgataaaacagaagaatcggcttctgaggtggggcgatctgcccttggggtgatggttaattttatgtatcaacttggctggaacatggtacctaatatgtgaacatactgtcctgaatgtttcctgtaaaagtgtttttggatgagataaacatttaaatcagtggactttgagcaaagcagattgacctccataatggggatggacctcatccaatcagttgaaggccttaatagaacaaacactaacctctcccaaatgaggaggaattctgaaagcagatgtctctggtctggaactgcagctacttcctgggtctcttgtctgccagcttcccctgcagattttgggcatactaaaccttcataatccaatttcctgaaaatcaatctccttctctcactgtctcattcatatatatatatatatatatatatatatatatatatatatatactccttctctcactgtctcattcatatatatatatatatatatatatatatgtagtgcacacacacacagtttagtttattcaggtagttctgtctctggacaaccctgactcatccatttgggtgtctcaagatgggtttaatgcccctactctgtgttctgctcatgacattaatcacactgcattataatgcagtgtttacctatgtgtccccacagggctgtgagctccttgttggaaaataaggaacagggtgtgatgaatctttggatctacttttatacacacttgaatgagtctagtgtaaattgaactctgagaaatcactgccaaattgaagactaatttctatctttcccgtttttttctttcctgtttccataatctatctttgactcaagccctgttccattaaatcaataacagtttgggatgttggaaacagcctcagtatttaatcttgactgagcttgagtcattcctactctttgcaatgccttctataagtccaagagtacagagtgcccatctgttcctcactgccttcatgactgtttgttgctgctcaacctctctccaagttgctgtttccttcaaacatagaaatgactaatgggtagaaatatgatttggagtcacactggagtttaaattctagcacattctagctgtatgaccttggataaatcatctaatatttctagatcttggtttttctagctggatggccttggataaatcatctaacatttctagatcttggtttttttatcagtagtgtggagacaataaaaaattggtgacatgtaagattgtgagaattagcatatatatatatgctacacacacacacacatgcacacacacacacacacacacacacacacatatatatgcaaactttctagccttaaaaagtagatggtcatttaatatgctaatgtaatgtcatggtgtgattattaattgtgtctacaaccactcttacagttgacatagtatgaatgatattacatagtcattctagtcatgaaagatagctatcacctttgccagcgatagaaatagaatctttacttgtataggcaccatgagatttcagaggctcttggagcctggagagagcatttctgctgggactccttcaatattgataaaacagaattataagggtgaggcaccctgacaagattttccttgaaacttgacattaaactgattctactcagtttacattgtgccttttttaatgttaacaggacacactgtcaatgtgttaaaagatatttcttagctgtatactgtttttcctttgtacagtacaattgtacattgatatgcaaaattgtttgtctagaatcactagcaaaaacacatttatttcttatcttgatggattcaatgccaatttcatgcatgtggatctgtaaggcaatcatcaggcattacaaggaatttgcaaggaacatttagtcaaatctctaaagcgaaacttattttccattctcaaacagctcataatccatttgcaaaccaacttacaagtctccatatcttgtcactctggctattatgatgctctgtttctcactcctttggcagcagcctctgttttcattaaaactcatcaaagcatgcataatggagtaggtagaaagctgcaattgaggtctctccaatatttctgcacataattgtgcagtgtgattgcagtaatagattatcatcccaggtattgacataaagaaagaaatgtatccatgtggtttggcctaaattggtagccttgcttcctgaagttagagcgatgtcagtgaatttacctgtgggctgcacccaggtctgccagtgtaggggaaatgagaatgatccatgacataaaatgggaccactggttatgaaacatttatttctccccagccttcttaggatgttgttaattttgccagctgtatcatatagcaaagtaagtagaatttagttgattacgtgatttgtatctgtaatacaatttggtactggtatctccttgcagattcctgtttgaaaacactctactttctttttttttcttcaacttttattttaagttcagtgctacatatgcacgatgtggaggttttttacataggtaaacgtgtgccgtgatggtttgctgcacagatcaccccatcacctagatattaagcccagcatccattagctattcttcctgatgctctcccacccccgaacccccaccctttgacaagctccagtgtgtgttgttccccctccatgtgtccatgtgttctcatcattcagttcccacttgtagatgagaacatgtggtgtttggttttcctgttcctatgttagtttgctgaggataatggcttccacctccatccatgtccctgcaaagacatgatctcatttctttttattgctgcatagtattccatggtgcatatgaactatattttctttatccagtctatcattggtgggcatttaggttgattccatgtctttactaatgtgaataatgttgcaatgaacatacacatgcatgtatttttataaaaggatgatttagattcctttgggtatataaccggtaacaggattgctgggtcaaatggtatatctgcctctaggtctttggggaattgccacactgtattccacaatgggcgaactaatttatactcccaccgacagtgtaaaagcattcctttttctccacagtgtcatcagcgtctgttgtttttactttttaattgtagccatcctgattggtgtgacacgatatctcattggaaaacactctactttcaaaacccacacacactcacacacacactcacacatgcacaagtgtcaacttccattgccctacttcaggcttatacaaaagcaagctgagttcaagttctgaagtttgcttttttatcacaagttgggtaatcatcattgcaaaagtattgttaccacaaagttgtcatttgattacagactgtaaaatattgcacagaatatctacagggtaccaagctagtacaacatgcattatgatgaagtagctggaataatttttattttataagtgcacgaatgaggctagtaagtactagaaacaggataccaattatagctgtctagagatgaagcttctgccctgtatgctgtgctttttatcaaagggtagtaaggcatgggtggcaacacttcctctactatgttgaatcaatattcattggttatctgttctggccaggcactgacaagccactgggaatatagaaatgattaagatatggtcctgcaagttcacagactttataatctcatgtccttgtgggaaaaaatgcccatgtcttcagctttccccatcgtgattcataattcacacaacagctaggctgatctttaaaaaacacagggatggccatgtctccccatcccttccacctctacctgaataaattcccatctcctacccatggcttacaatgtttgaagggcatggttgtgaatctttataagtttatatgcatcaatgaaaactcttagaacagtgcccataatcactacaccttctgaattactatattattgtctaattactttgtggggacatgagtaaaaccctccatctttatactttagtttctctgtctgtaaaaggagggtgatgatgacagctttttatggttgccacatagtcaattgaatgagttaacatgtaaacaatgtcagaaagtgacagtcacagagaaggtgggaaagaaagcctagatccttctccttatcttcttttgcctttccttggaaacacatccactgtctttagggacagcaggtttagttcatcctagggaggagctcacaagctgagtcccctggtggcacaagcattgtttcctggttgagactcactcatgggtgacatatgtgctgtggctcactggtagtttaatcagttggaataatacttgtattgttgcttatatttcagagggacaatttgctttctgtaaatgaagcttttccagaggactattttaggctgaagaatagtaatttaacagcttagaggtgggaatttttatttaagtgtctctcttttctctctaatgggtttatgatgttgaccaaagtgtggtgaccacatagggcttccagaaggctggtctcttaggcgaagctctggagctgctctgcgtgtgttgaagggctgagctttaaagtggtctctctggactagtggcagaaggcataatctcctgctaaattgggccattaaataaaactactaagtcataaagctgtagtattaccctgaaattaaagcattgtcacctttgagttgccaagaattttaacaggcacttagagaaattcctttcacatacccgttttagcacggccagttgactccaacccacatggatggtagcaggaggctcaggtgattgcagtgtgattttaattcatttacttgatcattcattcatccatccctccctttactaacttatttgctgctttcttgaattcctttattatcttctcatttatgtattcatttgttaattctctcatttatttacttcctcatttattttttcaggtttttaattacttacacattattcattaattcagtcactctgtcaattattcagttggtaattcagaaattaagtaattcaaataaacttttgaatattgactgaacttgacatcaagtttacaaaataaataaatctgttcttgtcctcaaggaattcacagtttggagaagatggacattgtaaatggatattttgcacagtgtggaaaatagaatagaagctggtagatggtacagaaatagtacaaaggaaacaggggttgaaagtacacaaggaggctgggggtggtgggcagagaagatgcccttgaagagctgccctctgagctgaattttgtagtagaagcagctaacatttatccagcagctgctggtattaggcaccatgctaggtattttatattcaagatgttatttgattttcttagcaatccatgttacagagataggcaccatctggagagactaagcaactagcccaaggtctcacaaggagcaaacggtaaagccaggaatggaagctatgggtgaggttgtgaggctgggttattaaggccaggtgacacagtctctgaaacagagaaagcctcctgtgtccaaacagaattcccctctggcctgcattgccctgtctcttgttcacagtcccttaactcaatgccatggtggaaaactcctccaggaagtagccttgaagggtgagggctccattatacccactttacctccgtgtccgtcactttcctcatctgtaatgtgggggaaatcatacccacttttccaggttttcctgagtatcatatggaaattatataaagcagaggttcacaaagcttagttttctaaagcatgagctgggatgaacatttaagacgctattttctaggcctattcccagcaatgtttattcagtaggtatagcatagtatacttactacagtatacatagtatagtatacatagtatagtagtgatcagaaatagcatgtttagcaagcacctgaagatactggactttgggatatatctatataaggtgattagcacagtgctcagtgcttaataagtccccatccttatgtatctccccacttccgaggggctcaggccagggcctagaatcgctgctcttctaagcactgaacacagggcttatcctgactccttccggatgggtcttttcatcttttactgcagataactggtgagtctcatttttggcatcaggggattgggagacagtccagtcaacaaagatttattgaggcactgcttgcgtaatgtaagctgctggtccacacacaaaggacctcacactgtaacaagaaaataaagccatccatctcttacagcaattttagctaggccattttatttattcgtacaactatcctgtagcaacttgacaatggaatcctggtcaagttgcctaacttttatgaggcttaatttcctcatctgtataatagaaatgatcacttattcttacctcaatgagttgtacaaaattagatagaattaaataagcaaatgtacccaacacacccagtacaatatctgacatgccctaagacctcctaaaataaaagtaatcacttttatttcagagccaacatcatagaatgatctagatgctaaaggaatttagagacaggaatagtcaaggaagcattatgggagacactaggcttgggtttgaccttggaagacaggtatcctggggtgtgttagtccactctcacattgctataaaagttatacctggtaagaaaggggccgagatggcagaaaagaaacagctctagcctgcagctcccagtgagacgaatgcagaacgtgggtgattactgcatttccaactgaggtacccagttcatctaattgggactgactaggtggtgggcttgacctacagagaatgagaagaagcagagtgggtcatcatttcacctgggagctgcactgagtgggtgtacctccccgctgagccaagggaaatggtgagggactgtgctacctgccaagggtactatgcttttcccatggatttttgccatctgtggatcaggagattccctcgtgagcctacaccaccagggctctcagtctcaagcacaaaactgggtggctgttcgagcaggcactgagctgcaagagtttttacatacatcgggggtgccttgagctccagtaagacaggagaacagtccactcccctggaaagggggctgtagccagggagccaagcaatctcgctcagcaggtcccacttccatgggcccagcaagctaagaaccactagcttgaaatccccgctgccagcacagcagtctggagttggcctgggaccactgagttcccggtgggaggagtgaccatcattactgtggctttagttttcccctgacagtgctaaggagactgggagatttggactgagcagaattcaccacagtgcagcaaaggagctgtggcagatcatggctagatggcttctttagatccctcctcactggagagggcctccctgtaggaaatctagcagctatagtcaaagacttacagaaagagctctcacctccctgagacccagcatctgcggggaggggaagccgtcatctcaggttcagcagacttaatctttcctgcctgccggctctgaaaaaatcagctgatccaaatgaggaggattccccccagcacagcacaccagctcccctaaggggcagactgtcttctcaagcggatccctgaccctgtgcctcctgactgggtgagacctcccaacaggggtcaccagaaaccacagacaggaaaatcccagcggacatcaggtcagtgtccctctaggatgaagcttccagaggaaggagcaggcagcaacctttgctgttctgcagcttgtactggtgatatccaggagaaaagggtctggagtggacccccagcaaaccacagcagacctgcagaagaaaggcctgttagaagaaaaacaaacagaaagcaacaacaacatcaaaaaaaaaaaaaaaagaccccacaaaaaccccatccaaagttatcaccctcaagatcaaaggtagataaatccatgaagatgaggaaaaaccaatgcagaaacactgaaaaatcccaaaagtcaaaatgcctcttctcctccaaatgattgcaacgtctccagcaaggtcacagaacggagctgaagctgagatggatgaactgacagaaatagacttcagaaagtgggtaataataaacatcactgagctaaaggattatgttttaacccaatgcaaaggagctaagaaccatgataaaagattacagcagctgttaactagaataaccagtttagagaggaacataaatgacctgatggagctgaaaaacacagcacaagacaatcataatgcaaacacaagtatcaatagccgaactgaccaagtggaagagaaatggcagagcttaaggactatcttgctaaaataaggcaggccaacaagattagagaaaacaaatgaaaaggaacaaacaaagcctccaagaattatggtgctatgtaaaaagactgagcctactactgattggagtatctttaagagatggggagaatggaaccaagttgtaaaacacacttcagtgtatcatccgggaggacttccccaacctagaaagacaagccaatattcaaattcagaaaacccagggaaccccaataagataatctatgaaaagatctaccccaggacataatcatcagattctccaaggttgaaatgaagcaaaaaaatgttaagagcagccagagagaaaggccaaatcacatacaaaaggaagcccatcagactgacagtggacctctcagtagaaactgtacaaaccagaagagcttgggggccaatattcaccattcttaacaaaaataaattccaacccagaatttcatatctggccaaactaaggtttatgagcaaagaaaaaagtaaaatctttttcagacacgcaaatgctgaggcattttttcaccagcaggcctgccttgcaagagctcctgaaggaagcactaaacatagataggaaaaaccattagcagccactacaaaaacacactgaagtacacagaccaacaacactactaaacaactacattaacaagtctgcaaaattaaccagttagcatcatgacagggtcaaattcacatataacaatatcaacattacattaaatgggctaaatgccccaaataaaagacacagaatggaaacctgggtactaagaccagacccatcagtgtgccatattaaagagacacatctcatgtccaaagatgcacatagaatcataataaagggatggaggaaaatttatcaagcaaacggaaagcagaaaaaagcaggagtagcaatcctagtttctgacaaaatagactttaagccaacaaaggtaaaaaaagacaaagaagggcattacatcatgctgaagcgttcaattcaacaaaaggagctatttaaaatatatatgcacccaatacaggaacacctagatttataaaacaagttcttagagacccacaaagagactcagacccccacacaatgatagtgggagactttaaaaccctactgtcagtattagatagatcacggagacagaaaattaacaaagatattcaaggcttgaatgcagctctaggccaagtggacctgatagatatctacagaactctctaccccaaagcaacagaatatacattttttcctggcaccacagggcacttactctaaaattgatcacataactgaaagtaaaacactcctcagcaaatgaagaacaactgaaattataacaaacaatctctcagatcactgtgcaattaaattagaactcaagattgaaaggtccactcaaaaccacacagctacttggaaattgaacaacctgctcctgaatgactcctgggtaaataatgaaatgaaggcagaaatcaagaagttctttgaaaccaatgagaacaaagagacaatttatcagaatctctgggacacagctaaagcagtattaagagagaaatttataggattaaatgctcacatcggaaagtgggaaagatctaaaattgataccctaccatcacaactaatagaactagagaaccaggagcaaacaaaccccagagctagcagaagacaaggaataaccaaactcagagtggaactggagatagatatatgaaaaacccttcaaataatcaatggatccaggagctgtttttttttttttttgaaaaaaccaataaaatagatagactgctagcaagactaacaagaagagagaagattcaaataaacacaatcagaaactataagggggataccaccattggccccacagaaatataaccatcagagaatactataaacacctctatgcaaaaaaaaaaaaaaaaaaactggaaaacctggaagaaatggataaattcctggacacatacaacctcccattctgaaccaggaataagttaaattcctgaatagaccaatatcaagttctgaaattgaggcagcaataaatagcctaccaaccaaaaaaaaaagaatcccaagtccagatagatttatagctgaactctaccagaggtacaaagaggagccggtaccatttcttctgaaacaattccaaacaattgaaaaggaatgactcctccctaactcattttatgacaccagcataatcctgattccaaaacctggcagagataaaacaaaaaagaaaacttcaggccaatatccctgatgaacattgatacaaaaatctccaacaaaatactggcaaaccaaacccagcagcacatcaaatagcttatccaccacgatcaagttggtttcatccctggcatgcaaggcttgttcaacatacacaaatcaataaatgtaattcatcacataaacagaactaaagataaaaaccacatgattatctcaatagacacagaaaaggccttcaataaaatttaacatctattcatgttaaaaactctcaataatctaggtattgaaggaacatacctcaaaataataagaaccatttatgaaaaacccacagccaacatcatactgaatggacaaaaactggaagcattccccttaaaaactggcacaagacaaggatgttcttcctcatcactcttattcaacatagtagtgttgggagttctggccagggcaatcaggcaagagaaagaaataaagggtattcaaataggaacagaggaaatcaatgtctttgttttagatgacataatcctgtatctagaaaaccccatcaactcaacccaaaagcttcttaagctgataagcaacttcagcaaagtcttgggacacaaaataagtgtgcagaaatcacaagcattcctatacaccaacaaaagacaagcagagagtcaaatcatgaatgagctcccattcacaattgccacaaagaacataaaatacttaggaatacagctaacaggagaagtgaaggacctcttcaaggaaaactaaaaaccactgatcaaggaaatcagacaggacacaagcagatggaaaaacactacatgctcatggataacaagaatcaatatcatgaaaatggccatacttcccaaagcaatgtatagattcagtgctatttccattaaactaccattgacgttcttcacaaaattacaaataactattttaaattcatatggaaccaaaaaaaaagctcgcatagccaagacaatcctaagcaaaaagaacaaagctggaggtatcatgctatataacttcaaactatactacaaggctgtagtaaacaaagcaatatggtattgctacaaaaacaggcatatagaccaatggaacagaatagagaattcagaaatgaaaccatacgtctacaaccatctcatctttgacaaacctcacaaaaacaagcaatggggaaaagattccctatttaataaggtgctgggagaactggctagccatatgcagaaaatcgaaactagatcccttccttacaccttatacaaaaatcaactcaagatggattaaagacttaagggcataacccaaagctaacaaaccctagaagagaatctaggcaataccattcaggacataggcaaggggaaagactttatgatgaaattgccaaaagcaattacaacaaaaccaaaaattgacaaatgggatctaattaaactaaagagtttctgcacagcaaatgaaactatcatcagagcaaacagacaacctacagaatgggagaacatttctgcaatttatccatcgacaaaggtctaatatccagaatctacaaggaacttaagcaaactcacaagaaaataaaaccattaaaaagtgggcaaaggatattaacagacacttctcagaaaaggcacacatgcggccaataaacatgaaaataaagctcaacatcactgatcattagagaaatacaaatcaaaaccacaatgagatactatctcacactcatcagaatggcattattaaaaagtcagatgctggcgaggttgcagagaaataggaatggttttatactcttggtgggaatctaaattagttcaaccattgtgcaagacagtgtggcaattcctcaaagacttagaactggaaataccatttgacccagcaatcccattactgggtatatgcccagtggaatgtaaattattctattataaagttacatgcgtgcatatgttcaatgcagcactattcacaatagcaaagacattggaatcaacccaaatgcccatcaataatagactggataaagaaaatgtggtacataaacagcacagaatactatgcagcaataaaaagaaacgagatcatgtcctttgcagggacacgaatgaagctgaaagctgttatcctcagcaaactaattcaggaacagaaaaccaaacactacatgttctcacttataagcaggagctgagcaatgagaatacgtgggcacagggaggggaacagcacttattggggcctgttaggggaggtgggggaggggagtgcattaggggaaaaatctaattcgtgctgggcttaatacctatgtgatgggttgataggtgcagcaaaccaccatgacacatgtttatgtatgttacaaacctgcacatcctgcacatgtaccctgtaacttgaaaaaaaaaacaataaaatgtttgtttaaaaatatacctgagactgggtaatttatttttaaaaagaggtttcattggctcatagttccacaggctgtacagggagcatgatgcttctggggaggcctcagaaaagtttcagtcatggcagaaagggaagcagaagcaggcatgtcttacatgtccaaagctgggggaagagaggcaggcagggaagtgctatacacttttaaacaatgagatctcatgagaactctatcatgagaacagcactaggagaatggtgctatttaaaaacccaccccatgatccagtcacttcccaccagaccccacttccaacattggggattacaattgaacaggagatttgggcagggacacagctccaaatcaaataattctgcctctagcccctccaaatctcatgtccttctcatatttcaaaatacaatcatgcctacccaacagtccccctaaattttaactcatgttaacattaactcaaaagtcctcaatccagtgtctcacttgagacaaggcaagtccctttcacctatgagcctgtaaaatgaaaaacaaatttgttactcccaagatacaatggggttataggcatttggtaaatagccttattccaaaacagagaaattggccaaaagaaagggggtacaggcaccatgaaactcagcagggcagtcattaccttaaagctccaaaataatctcttttgacttcatgtctcacctccagagcacattggtgcaaggggctagctcccaaggctttgggaagctctgcccctccggctttgcaaggtacagcctctgtggctgctttcacagactcacagtgcaagctgttagtggatctactatttgggggtctggaggatggtggccctcttctcatagctctactaggcagtgctccagtaaggactttgtgtgggggctccaactccacatttcccctccacactgccctagtagagcttcttcttgagggctctatccctggagcaggtttttgcctggacatacaggctttccaaataatttttgaaatctagctggagtctcccaagcctcaattcttgtactctgtgaaccctcagacttaacaccacctggaaaccaccaaggcttatggctcgcaccctttgaagcagcagctcaagctatatctgggtccctttaagccacactgaagctgaataggctaagatgcagggagcaatgtctccaggctacacagggcagtggggccctggtcccgacccatgaaaccattctgtcctcccaggcctccaggcttgtgatgggagaggctgccatggaggtctctgaaatgtctttgaggctttcccattgtcatggatattaatattctgctcctctttacttatgcaaatttctgcagccagcttgaatgctttccctgaaagtgggcttttcttttctaccacatggccaggctgcaaatttttcaaacctttacactctgctttccttttaaatataagttctagtttcaggtcatttctttgctcatgaatatgagcacatgctgttaaaagcaagcaggccacatcgtgaaagctctgctgcttagaaatgtctttctccagatactctaaatcatcactctcaaattcaaaattccacagatcccaagagcaggggcacaatgctaccatgttctttactaaagcatagtaaaagtgacctttgctccagttcctaataagtttctttttatatatgatgcacacacaggcacacacgtgtgtgtgtgtgtgtatacatatattttttaaatgaggcacggtatcactttgtcacctaggctggagtgcagtggcatgatcttggttcacagtagtgttgacatctgggttcaagtgattcttctgcctcagccccccaagtagctgggattacaggcatgcactaccatgcctggctaatttttttttgatagagatggagtttcaccatgttgctcaggctggtctcaaactcgtgagctcaagtgattcatccacctatgcttcccaaagtgttaggattacagatgtgagccactgtacctcacgtaataaatttcatatctccatctgaaatctcatcagcctggatattattgcccatatgactcagaattttggtcaaaacaatttaacaagtctctaggaagttccaaactttcctgcaccttcctgtagtcttctgagcccttcaaactgttgcaatatctgctgattacccaattccaaagttgcttccacatttccaggcatccttagagaaattccccattaccagtaccaattttctacagtagtccattcttgcactgctgtaaggaaatacttgagactgagtaatttatcaggaaaagaggtttaattagctaacagttccacaggctgtacaggaagtatgatggcttctggggaggcctcgggaaactttcaatcgtaatggaaagtgaatgaaaagcaggcatgacttacatggtgggagcaggagaaagagaggttgtagggagaggctacacacttttaaacaaccagatcccatgaaaactctatgatgagaacagtattcgggaggatagtgctaaaccattagaaattgccaccatgttccagtcacctcccaccaggattcatctctaacattggagatgacaattgaacatgagatttgggtaggaacacagatcaaaccatatcatggggctaggcaaagaagggaaaccggaggaaagacaagccttgttgagctcagcaggatcatgaatgcagagatgcaatgagaaggtccatcaagtcctcctgacttccctgggtgttctgatggtctgatgttggctgaatgaatacttttcctgtttggaagtggaaaataacaaatgggtgtcaaaggtgtctcccagaaagcctgcttgctcttgttcacttttgttctgagccccagtttccaaggagagatgatgaatcaaagtaagtctagacattccaaagaataaaagggccaagattgactgtggtccttgttctgggaagtaggcaggccaagcaccccttgcttgagagctttttcttactattcctcctgagcaggctcacgtcacaggaacaccaatcagcctgcattctcagtgtgcatgtgtttgagttctcatatttatgtctatttgtaaagagaagcaagtaggagacattgactgattgctgtccatagggacaatttcaacatgggttttccagtgctagctgtgagtagtctaacttttatgtcttacaggaagttttgctctccctctttagagtatgctgtcattttgttctcatgtaaagctcctttgaaagtcacaatttttatgcttgtaattgaaaaacatctaccaagttagttatttagagtgtgggcttggtaggaatcccagcactcacatttcctacttttggcaaattatttgacttagttgagttacccagcctccttatacctcagtttcttcctttataattaatcatagaatctatttataagtttgttgtgaagcttctatgaggtaatcgatgtaaactgcaagaaaaaagacttgacattacatatctaatgcatggtagatactgttagttattattttcattattctgtccccagaaatatagactctggtttcttggtgtttctggggacatggtgataaaaataatgactagtaactttttttgtgtgcataacacctgacacaatgaaagcactcatgaaaattaattcaacagagtgaataactacttatacttgaacatgaatgatctaccataatgtaaatggttaaatttaataatgattgtaatttagtttaaatttagtaatagctttctggtcattattttgccaattactccttaactctgtgtgtgtgtgtctgtgtgtgtctgtgtgtgtatgtgttggtgctgttataaaagcatgtgcatgtgaattttttggagcttagaataattttcagcacttactacatgtgaaactttctggcaaactatcttgttttcccagagttttattcctaaatgtccaaacctacagaaaagttgaaaaaataatgagtagccagatacccttcacgtttacgattctgccacatttgcaaatttgtgccctcctcatctctttctctttttctcctctcctcattttctcagacattttaaaaaaatttttacggaaccatttgaaagtaagttgtagacacagcgataatttaaatcgaaagactttaggttttatcttctaagaacaaatatattcttctatgtaaccagacataagaaaccattcataagaaaataagcattaattaaattaattatccaatatatagtccatgcaccaagaatccaaagtcctacaatgtgttttatagcagtgtctattttcatatttttattcataattcaagcagtgtctacaatttggaattgattgccacgacccttcaacctcctttaatctggaaggcccaactccctgaccccttctttttgcttttgttgttgttgttggttggttggttttcatgacattgatcttttctggagattaaaagacagttgttaaataaaatatcccatactttggatatttctgattatttaatcagtgtagaacattttggccagaaagtctcatgaacaatgcttgcctttttagtgcagcccgtgagcagacacatgacatcagtttgtcccgatactggggatgcttctcgctatcatttggctaacacagctctgccagatcgttgcattgtgaaggcagtttacaaccagtgagtgagttatctgtagtattacgtgagcacactatgtgaatgccctgttcctcaacatttcctcccaatatggtagggatcctgactcttttaagttattacactggaatctgtgacgtgttgcttttctaattctacaatttcctttcatatttattgctgccattctgaagtcttacctacagaagagatttttttccctttccctgactccatctccccttgtgtcgttatggactctaattcatggtccctttaattctgctccagtttcttttttacatgtgtctattaatattggagcattttcttgtgttcttgcatggaaagatattctcaatgtcaactagaactttccctaccctagaaccagactcagctcttttcctaaagaagcctacctcttttttgtagcaaatggtatttggaaaccaagacctagatgtttgtttgctcattgtttctgggccctttcagtgggcagaactaaaattgtgtgtgtgcatgtgtgtgtgtgcgtgtatgtgtgtgtgtgtgtttatgagttcataaggttatttacaaaacaaacctagttccattagattcttttctcatcattctgtcttctatatatatatgatatatatgagatatatataatacatatatatgatacatatatatgatacatatatatgtaacttctctcacagtgagaccttgtttcagcaatgtcagtatatttacccatttgctccattctgcagtatgcacacaatcatttcagaattacttcagcaatatcacatcaataacaatgtaaagttaaagatttccttgaattttaatttttatccttagaatttattctgccaagggtatatagtgagacagaatactatttgaaagttgcttaaattaacttttttcttttttatagttattttatcaatttaatgtacagctaggctttttagtttctgattaatattcaacttttggacttgccttttctttatccttttgattttaacagtgtaaagcattttcatgttacaaaagtcaaatacagacaaatatgcacacactggctgatcagagacattttgctctcattcctattgccttcatcttgttcttatccaacttttttagataactatttatatcagtttgtcctttctgtgtgtattcatttttctcttttgtaccttcacaaaatgtatcatactcttttgtgcatcaataccttgattttgtcactttacaatatacagtggaaatcattctggatcagtttacagagatcttatgtattatttattatggctgcattgtactttactgtgtcagttaacaatgctttattcgatcagacacctatggatgtgtatttaatttttttccaatattccgctatttgcaatatataacctcggctgcacagcggaatttcaagtatgtatctaaacatcctttcccaccatgtgtcactttcatgctgatttcaaaagctgtcactgaagtggataaaaattctggtagtccgttaagtgtttagtagtaagtgaatacctactttaggccatatgttagagacacggagatttctgagacaggttttcatatgtagtacttgcagtatagcatgggatactgaggaaacaggttgttgtaataccatgtaaatgcgacgagcacgggatgttggcaggactggaaaagaccacccgttggagaggccaccagcatcacacaatctcattcatcttgtgatgagctccagagtagagatgtcagctgaaagaaagatgagtaattctgctcttgtctctgagttttctttttgtcaatcccctccagaatcagaatataagctccatgagagcagagtaagtagatgctctcacccttagagaaggcgtctcttcttttctgacccggtacaaggagatataaatgctgcctttggatatctcttcaaaagacaaaggctagccctttgcaatcagctcactagctcatgacgtcctctgagttcaatactggctactttagatcttataaacagagggacaacaagtactattatacttatactattacagcacaacaaacacaagaactgtttattatgaacttgtgttccagtacattatgtacttatgtgggtccccagtcttatcctcagtgtgcaccaaaatagtttctatgaccatgatactcctaatgacctcataaagctttctaatggcaatcaaaacacttatcaacagcctcacagtcctctttccatcaggtgacttagacttagggcttcttttctccttttcctttgccccaaatgccaatacactgagtatggggggaatggtatcttgttcccacccactcccccctttgctgctgcagatactcttcccaacaggaatgcaacacaaggcagtctgccttcctagaaccagctgtgaactccctgagctcagggtccagcctgttagcgaaacttgcacccctcatccgacccctttccagtccctaacatagtgctctgcatacactaggtgtctaaattaaataataataataaactagtgaacaacaaataaacaaatatgatacagtgcacatagaatccgttccacaccactaccccctaagaccataaaacaaatttcccaggtctctttgatcatacctattttaaagcaagaaaaaagagaaaaattacccccctgaaaagatacataaaaagtaaaggctaaagtgaagtgtgaatataaatcagccaagtatgttgtctggaagtcgtaaagtgtggcccacgcaggcaggtggaaggcagtaatggacggagcccgccacgctgcggtgtctgcatggcactaatgcagagcgcatggtagccctaccagccaccctgaaccggtaatgcgcacacctccaaacagctgaaacccagacactaaaagcagccacgtctgccgtggttttagtgaggcacggatggattctcgcacagacagctgggctggtacacatgggagggaaaacagctcctgggggatttctgaagccttttaaaggaattggaaatcactttacaccaattgtctcccttccttttaaaggtcgggcggggggaaggtgcaatgtaccccctcagtaaaggttcccagaagtgtttctaataatgaaataatctcttcacatcctcccggcttcgcttcaacagaacggttcatagcagatcagctttgacttggagtcaggtaccaggtgaagggttaggaaggaggagcaggctgggcccggtggctcacgcttgtaatcccagcactttgggagaccgaggcaggaggattacctgaggttggagttcaagaccagcctaaccaacctggaaaaaccctgtctgtactaaaaaatacaaaattagctgggcgtggtggcgcatgactgtaatcccagctacttggaaggctgaggcaagagaattgcttgaacccgggaggcagaggttgcagtgagccgagattacgccattacactccagactgggcaacaagagcgaaactccatctcaaaaaaaaaaaaaaaaaaaaaagacaaaaaaaaggacggaggagcaccactcagagccagcaccacgctcagttcaaccctatgctttctattcagtgtttatgacaacactgcacaatgagttatgccgtttacagaggaggagactgaggctgggggaggtgataggtctcttgcatgtccaggaatccagtgggtggcagagctggcattggaagccagccctaatgatgacaaagctcaagcttcccctcatcacatctgcctccatgaaccatgaagccctttccaagcctatatttactagcagtcattacctatgatttaaatggagagataagggagaaacatatgaaaaattaaataactatcaatgcaaaatgacaagagatatcacaagattgccaatgagtagatggaaaatgagaggtagagacagtactttgaggattatttaaactgtctttacccttggcatagaaaattcactttgtcaacatagataactacagcagaagtgaccctggggaccttaatatagacttgctctattacaataggagtataagtgaattggcacactgttcaaaggatgagaagcagctccccacagatatttcagttcaattaagctgggtattgacaatctgtaggcttcccttccttccaagcacattgatataaaaattgcagtttttttctggctctgcaaagagacagatatgtgtgtagaatgaggtcttattaatcagagttatttcttgtgtctccttttttactttccttttgtttgctatttcttctgagttgtgatccccatggtaacagatggaattgcttacagcgtctgtaattactattattaataataatgatcatcataatcagaccaatctgatatgatgagagaaaaaatatgaaagaaaattaaattgtggctctgtatgtaaactgtttacggcttccaaaatgagagccagaggaacaaggtaggtcacacagagatgcactagtgaaggctgtctgggagcttttctggggtaatgaccagggaagattttaccacactgatgcgaatacaaaatgtttcagaatattccaccattactactctgctggctctttgtacagcctctttttcttttctctttttgttattgttgagtgtgcgtgtgtgtgtatgtgtgtgttttgatcttttaacttgagacttcttttcagtttggactattacataatacaggcttaaaagagcagcttcagaaatgccgaaactaagaacctgacagtatacaaaggactaattagtttcttcacttgacgaagccatccagaagtgctaactcaggtgctcagtcctagcttaggttctggtagcctgaggatgaaagaccactcttgaccttggaagttctcaaggaaaagagtgcacagacttcactgcgcagggctctctaataacctctacccatgaactttgccccagacagatctctggaaagcccctcttcctttacttgtagtctacagagtatttataacagcctcagacatttgtcattcttgtgtacacaactttctccccagatgatggtaggcttttggagaagttaacatattttcctccagtgtatgtactctggtggatagcagagcactaactgggcacatatttaaacacaaaaatgaattatgcatttcatgtcctaaaagatctcatagctttatgaagaaatgaacttgaaagctcaaaatcacaatgcaacttgggaaatactttactggtttatatatcaatacacagtctgcctttggaagccatggggcacagtatttgatggcccataactcatagttcctttctacatgaagaaggcatgatagctgctctggatctgaatcatgagatcattgacactcatgccaacccactgtgctgaatgcaactttaaaaaagccaatatttcacttagataactattactttcagggaaccagaatgcttagtgaagtggccctatttcctttcccagctaatgatgaacaggttcctgcctattcaaaaatctccaaatgcagtcctctcctaagtaaaagaattgatctgggttagtcaatacatgtatgcctttgagcagtgaaagagaagaggctatgtgtctaattgtgggattgggtagtggtgtgcagtagaagtaatgaaagagaaaaacaaactgggtagcaaaaagtagtatcagagggcaatatttttccaggtttctggctccatgagtactaaagagcaaattatcttgaaggaatttcaggaaatgcaaaggacacaaataaagacagagatacatagggcaattctatagtggaaaaaaaaaacttaacaaggtggtaataatttagtatatacaggagcagctatattacaagaaatcacagtccatcgcacttgttaacctcatttgcagagtatgttccccatcgcagtcctctaaggaatgaagtccaagccctcactctaatgttgtagaaaacttctaatgcttagagtctttactcatttgagtgccagacagtctatgtgcaccaaatcattatgatacttctatggatgcaaagattggtgtaaatatgaccattttccaatgaggaaacctcagaaatgttatgaaacttgccaaaagctttactgctgacatggagcagaacatagattccaatccgaataggattgtttctaaagccaacctgtttcatggtcttattggtgccattgctgcttttcaaatatgaccaataagaaaactgggcattgaagaagtaataatttcatcagggttgctcccacagttagtgttgtgctggcacacaaacccagatttgctgactccagagcccatactttgttcactaacctccactgtccaactaacttgaccatcttgaacatttaagtttgtgggtccaattttcattgaagtcatgtgtgagtccacttaaaagagaatctccacctcctcacccatctaaaggatggtcaaaatgaattttgcttgttaaaaaatcattcaaagatgactgtcacataaacctctccagctcaaaccacccttccctagcctagagcaggcatcaggagtatctgtcaccacagctgactttctttcagtggcattaacacctgacctttcaatatttagtcaggatgcagggctaaatctacacaaccaccaatgcagctgaggaagaaaagataggaagcgaggaaaaatattatggcaataatattagtggctttaagatgaaagattgactctctaatacaactttattttctttattgccaaaaacaatatgatattggtaaagcaattcaatgagtaaatgaataaggaaatcaataaatgaatgtatgaacaatcagatgaattaatatatggatatgaaaatctatgtttacttagaaggaaatataaatctatatgaattagtaaatatggagaccaattttggaatcagattggatgcactgagactggggacaagtctaagagacagatacagatgatacaggtggaaaaaatgatatacatttacttccttgtttcagtctttatcctgctgtctcccaggagaacagtaatcagaggacatagggcagattcaaaataaaagccaactcaggggctctaggtttcaagcaatcatttctcctgtccctcgtacagtgtttgaagctaagggttgtgatgtcagttatatatatcatatgatcacacacacatacacacacacacacacacacactgtgtgtggtggattattgtgagtactggagataatatatgctaaatgtgctggaataaaccagtagcacaacatttagtattatagattagacagggttttccttgtcttctttgtataaacatcatggacatttcaaaactgtccatctttatttctccctctacaatgtttcattattgatggataagatttttggttattttatcagcatttgtctatactggtatgaataacattttaaaagttctgggttaattgtttttataatattattatctttaccaacatgaattatgtcttatttttgtttttaaagtcaaaagcaaataacatcaacttgtttagactttatggaaaatataatcttaggttggatgcagtggctcatgtctataatcccagcactttggcaggttgtttgaggccaggagtttaagaccagcctgggcaatataatgagagcccatctctaaaaaactttttaaagattatctgagtgtgatagtacatacctgtggttctagctacttgggagtctgaggcaggaggatcgcttgagcccaggtggccaaggctgcagtgagccacgatcgtgccactgtcctccagcctgggcaacatagcaagcccctgtatctaaacaataaaatataaccttgcctcagtgaaacactggggacatgtgggttatcaatgggctggttttaggaaatagtcttaagacaagtcagaatgtttgagcacagtttaattttttgctgtgtattaggccatttttgcattgctaaatgggaatacctgaaactgggtaatttagaaagaaaaggagtttgattaattggctcatggttttgcaggatgtacaggaagcatggtgatggcatctatcatcagcttctggggaggtctcagggagcttagaatcatggtggaaggtgaagagggagcaggcagttcagacggcaagagcaggagcaagagagagagtgaatggaaggtgccatgcactttaaacaaccagatgtcactgtcgcaaagacagcaccaagccatgagggatccactcccaagacccaaacacctccctccaggtcccatctccaacactggggattacaattcaacttgagatttgggcagggacaaatatccaaaccatatcatgctggaagaagtattttcttttatagaattggaaaatcctttagaggtaattaaaatcatactctctttttctcctgcttctaatatgttgaaactaaggtttggaaagatgaaacgacatgtcccaagttgtgtacagagctagtgagggagaaaggattaaccaagggcacccaagtggcctattcttttctcttttcagctcagtcatgccaactgctgtgcttctgccttgtagctgtgctaattaatcgtggtgactttcagtgtatgtgctcatcattactgtttcatggatgtgcctcgggtcatttctttactttctggaccttagtttctccatttgtaaggctaagaggatggggagggaagaaaccacatgatttctatgctagattccttttcagctctcagaatttatgaagagtaatgatgtaattatgcgggcaagattctcagatgacaaaagcttttcaagtcttcctatttcctcttttgctgtatttgagaggatgttcagaattaaattgcatgtccaattgcagtaaatgttttagcctaggttattactacagagtgtctgatacatcccagatagagccttgcaactttgtatttgtggttgcttttccatattaccagtgctaccagggtattgctctcttgtttttgttgcaattgttgttgttttcttaactgactataaaactaagcttcagaaaagagaagggggctgggcacgctggctcatgcctgtggtaccagctacttgggaggctgaggtgggagaattgcttgagcccaggaatttgaagctacaatgagttatgatcaccctactgcactctagccagggcaacagagagagaccctgtctctttaaaaataaaaatttttttaataaaaggaagtgatttatccaagcttgttcttggcagatacaggcttcaaatacagatctcccatgttctaatgcccaaatatctcccctctctcactgccttaccttctttcgcctattaggcaaaatatgtccttccgtcatgatttaaaggtcctcatctttcattgtaaatcttcccaaatatttttggcaaagagaggtaatacggggaataaatactaaacaaaacaaaaccctacaattaacttcattgcatgcagagtgtggatcacacaatctcaaccttgttctctgagaaaatggttctctgaaaacatgctagtgtttctcttgtgaggaagtgtgtcagtagctttggagtcagacatcctaggctcaagtccttgcttagtcacttattaactgtgggatattgggtgagttgcctaattttctttcacattttcctcatttttgacatagcggtattgcttcacttccaacttaggcattgtcaattttaactgagatcatgggattaaatgcttactgtagagcctgtgggaaaagggctccgcaaattgagctcttaagattactgacccccatcctaactctggtggagctccatggggaaacacaatttctctgtcctactctccatacggtaccggagtgttgattaatgttgcacgctgagtggcccatcacactgctcacatgctccatttttgacattgcttctaacgtctcttgctttgtgttgtgttgtctgggcagaggacaagatctggacatcagtgcagcacaacaatacagagctgacccgagtgcggggcgctaaccctgagaagccctatgccatggccttggactacgggggcagcatggaacagctggaggccgtgatcgacggctctgagcactgtgagcaggaggtggcctaccactgcaggaggtcccgcctgctcaacacgccgggtaaggcctctgcatgcatgaccacagtgggatagatgggaccctcagacctggagtattaggcaaaggaaaatttgccaagaagggggctatagttacagttagtcactgtgcactcgagagaaacacaacaagaggggtctggttatgtagtaatcctggctctgaaattcagcatggaagctagagtgagttctgtcacctttcaaagttttctcctcatcataaagaaaacgattccaacacccaccctgcaacagttgtgagaatgaagaacatctgaagaggaatgggcctcaaagagggcatttgagcttgacatagaaagtgtggccatgggaaatgctagtttggggagagagaatagagcttgataaggcaccaggatctcagcacacccacccgagagggatgagttatgtctggggtggaggatgcctggatgcctaagggggcagtgttaggcagggaggccagcaagataggcagggcaaacctgtgggttcatggcatgaacggagcctgagaaataggggctttaggggaaatgactctttttataagtaaagtgtgcttctagaaaaaattaaactaacactgcatatgaatttatttattttcccatggttattttttacagtaaatggatgatttagttattaacatgctttgaaaaggaaaaaaaacaaaacaaaacacaacaacaaaaacaacttctagaactgcttactaagactcaagagtttctgtaaaatgtaagatagggttcatcaaaatttacatgtttcctgggagtcagtcatttttttgtgaatgtcagttcatcatttgtttcatgggagaaaaaaggacaaaagatctgaagtatctaagaaagggtgttataatctctagcctcaagaaacttacattccagcacttagaagttaagaactttgaaaggctggggaaaaaatggagaataaaatatcaacaaaggggaaatcatagaaacctaactaaattcaacagaatgcctccttgatctaggatcttcagggaagacgttgttccacgtaattgaattttccaggtaactgtcacttatccttttaagcaccaaaaatctttccaaagaatttttaactatttgaaatgaaaatctttctcaaatggattacacgcttccatgccttcttaaccagagaattctgaacataaaatgtaacctttcttggtgactcagcatcagcattgtgaaaatcaattattgtactctccttagattcagccaggcttgcagggctgattagatcagacgtactggttcgtgtccctttacccagcatcctcagagggtgctgccctgccagagtcaatgtttatatttatgtgtgtttctctctccatgtctgtcaagcctgcacgtgctacctcagcacagttctcagggtgcctgtctccagaaatgcccttccctcttctcattgcgttgtttctagtttttgaaggtttcggtttggccgaattgtaggactaatggcggggcatgttcattctgactatgggacttcttttaggatacgcactccgtgatatcaatttggctacaccattgactttgcaaatgtgttcttttcctaactcagctgcctcactgtccctggccttatttgagtgggagggcacgggtttggcagcaagtcatattgggagtaagggcttgatgctgtcatttaccagttatgtgactttgtgcaagttgctcaatttctatagtttcgatttcaccacctgaaaagtttgcatgaaaatcctgaacccatgcagttgatctgaggatggaagaaaaaatttagtctgaactccttgtgctatgcctggtacataataggtattcaacaaatactggtgtccttattcgtagcttccattgcagcagggaacatccaaaattgttccataatgggaaacaagcacaaagggaaattttatttctattttaacaatgtaaatagaataattgtcataattatgtagtaacagaattgattagaaaactcaacgtagataatctcatcccctgaagatggcaactttaacattcagatgtgaatccttccagacattcttccatgtgtatattctcaaaggcacaaggaagacacaccatatttttgtgcatgagggtcttcattaatcgtctttccccatgtgctctgaatcaaaaggagggagataaaggagaacaatgggtatgtaggctcagtgtctactttcttcttgtgagctggcttggagaatgtagcatgaaccacttcatcctcttggcttccacctccagactagacactgcttgtggggcaagagagtcctcatttacccagacagtcccgtagaggtgtgatttagcttcacactttcactgccaggacagaagccacctcgtcccccatgcatgtgagctcaccgtctggaaaagcaggaatgggaaaaacaatatataacatttgtagccacatggattcaacagccagcatccagggcatacacctacatgaatgttttcctggtccttattattattaagccactcattcccttcccaagaggaagcccaaggacagaagcagaggaggatagaggccatctcctccttacctatctaagattctggaagaagtttgtgcaagtttttcctttatcagatgaatctgtggtctatgctgggaagagattcccgaccctgtgatactcttttacagcctgtatttgtcacacacaggaaatgtacaaatacctttctttatcaataaatacaacttcatatcatcattttcattaactatagagtattttattatatggagctactccaatgaacaaatctcctatttggacctgtagattgtttccatttttttctctgttacacgtaatgctgcagaacagttttgcatttagatctttgtgaacataactgattatatcctcaggacaaattccttgaggtgccatttgcagggcagcgagtatgcatatttttaagactcttgccacattgaattctgcaatgcatcaaggttgtaccaattcatactcccaacgacactatgagactgagtgcccgtttcccagcgatagatactattatcttccttcaactttggtaatgtgataagtgcaaaggtggggagtcaaagatgattataaatagttttgttattaatttttaaaagcgtgcaggctgattaccatagcctactggctattgctaactagtagccagggtgagtagacgttatgaaaaattataaattatggctgcaggtgcatttaaatcaataagagaatgtgggggttgccttgtgggcatagattctcctatatactatgcacaatggttaataaatggatacaatataagaaggcaaaatgaaagacaaagaaatatttaaatggccaataatgactgagatttcttatgtttgaggatatgtgtggggtgagctactggaattatctctaacccagacaacagatctgcaccataagagtcattgtccccatctgatatttcaggaaacagaaactcagagagaataagatgcttgtttaatgccacacagaaaggggcagatctaactcttgcaaccaaaatctcctgaagtcagagcaaaagtgctatttctgatacatcacaaaagcggccaagagccaagagttacaagtaaatgaaggagtcagaaaaaacatgattttgtataaatttccttattgtgtaggaaaatggaaggagagagaagcgcaccaagcactgtctctgtgaaggccacggagttgtcagggttgcctgaactgggcacattcctgggcggcatcagagggtttgcatcatcctggcctagactcatcaccttccatggctcacgcaccccttcatgggaaggcctgtgtatccctacacagcatccccagagcctccttctgcctgctctcggctccagcaagggctctggttccattcatttagcagcggcagagggagaaggaagagacaggcaggataaggtcgtgcatgggtcaccactgggcctttttcattcagttggtgactgaaccatgacactgtcattttatgacagtctccttggatatttttttcccagaactactgataagtgccaaccaatggaatgcatcctccatctctgtagctgaaggtttatactagaaactctccaatgtctcaccaggacatccgtatcccagggaaagtgtctttgtgattctcatggatctttgtctttcccctcactctgcttgctgctttctactctgagctttctgcagggctggaggccctttgctacagtgcagcttccagtacagagcccagggggggagaatcaccacagcctgccagtactcacagtaccttgtcacagggaaggagacaacacttatccccactgaaaaaggctaccttggttgagcccagaccttttctctcttgtcagcaccttcataggcattttgcctgaggctagagtcctgaaggcgacatgtgatgagcatacgaaatgaaacaggaggacagaaaaataaatatcaaagccatagtctggaagattcttgaatcacatggccaattagctctataacccataactttcccctggaaggaggacaagatggagaggggtatagcaagtgaccgcatggggaaactgagtgcccagatctctgctgggaatgggcattggaaggcctccctatcccacaattctcttgcaatagtctccatggtgccttgaaagtcccccgccactggattccgtcattagggtgtcagtatccggtgtaggcatcctcttgcactcaccactccaagtaatggaaatctgtttgtggaaaccctcttcagtaaagctgtgacctcttgcaggcagagggaagaagtcaatattgaaacacgtgaaagcactggaaattcagactccattactttgaaatctaatggctgtaggacagcctgagctggaatttactttgatttttctgaacagaaagcatttgcggagcaaatcagtcatggaagcaagattgccgtgaggattgtgtaagttcttcaggagccctaagaatccagagccctacagcatcacagaacctctgtttacctaccagtaacatgctggttaaaagccattcctattaattcattcatgcagctgagagtggtttctacctgcagtcaattgctttacctagtcatgttacaatggaatttaaagggacagcatgctatttattttaaagtattttaaaattctgaattttttctttaattactgatactttagtgagcatacagctaactgactatatataccatacataataatctagactatataatacatagtatatagtatggataaatatatatgtgtctgtatgatagtatatagtatatagtatatagtatggataaatatacatatatacaatatatgatgtatatactatatagtatatgctatgtcatatttgtccataatgctatatacattcatcacgtactctttatgtgtccaaacagctctgtaaatacacttgtgcatattaattctgtttatttgcaatattccccttcacatgtgaaaaattaatgatttagtttagaaatctgagtaaggaattgtgatgtagaaaagtcaaattacaggtagaaaagaaacagtatgtcaagatactctggggttcacaaaactaaaaatgctttcttctcaatacttgtaccacccaagatcaattagcagaattaacatttttctttcatacactaggcatttttgagtatctgttttgtgccaggcactggggagtgaaaataaaacactgaaaaaacagagttcttgcctgcatacttgtagtagggaagacagaaacatgcccccactgcccccaaccccccccccccgccacacacacacaatcagtgcatgttgaaagtgatgctgaaaggtccagaaggacaaatgactagagtatcagtggatgtggggagctgcatctcacatgaggtggtgggaaagtcctcccagtgtgcaggagctatccagcaggaccctgagtgaagggacaggatgaggcaggtgcctttttggggcagaagattccaggctgaagaatagccaaaaggccagtgtggctagaggaggagcaagggtgggaggaaaatgatggaaagtggtatccagaggccagattttacaaagcctgggactgcaaattttattctaagagtaaagggaagtcactggaagattttaagcagaggattctctttctgtttcaaatccaaagggtaatgtcagtttatgtaagtcaggctaaaccaggtatgaatattttcatatgaataatttgctaagcacatagacattttaagtcatctcctatgcctagtgaactggaaaaaggtatgagctccctgaaggaagaaacatgtcttatatcactctgtaacctcacattctaattcggggctgtgtgtggaaggctgtgaccaccttggatcccctctgattcatggtggtgattctgttctttctcacccaattaactgagctgcgattgctttggctacttcacccgctatgttcttgctgcggcccactttcaccatgctcacaaagcttggaggtccgcgtcagagagctgcaatctttgcagtctatggcaccacctctgctcccatatttctttcctttcttaattccctctttctttcatctttttctttgtccttccttctttcttaaccaccccccgcctccacagacacacgcctaaacatacacaaatatgtgggtagaactgatccccagtgtctaccgttcttccacaccagaattaaaaccacaaacttacatcatgacatctggaagacaaaatatcagggtagtatttgactttttttttttacttatttcttaaattatgctccctatcatctttttattattattattgttattattattattatactttaggttctgggatacatgtgcagaatgtgcatgtttgttacacaggcatacatgtgccatggtgtttttctgcacctatcaacccgccatctaggttttaagtccagcatgcattaggtatttgtcctaatgctctctgtcccctttcccctaaccctctgatgagccccagtgtgtgatgtttccctccctgtgtccatgtgttctcattgttcaattcccacttatgagtgggaacatgtggtgtttggttttctgttcttgtgttactttgctgagaatgttggttttcagcttcatccatgtccctgcaaaggacatgaactcattcttttttatggctgcatagtattccatggtgtatatgtgccacattttcttaatccagtctatcactgatggacatttaggttggtcccaagtctttgttactgtaaatagtgctgcaataaacgtacgtgtgcatgtgtctttatagcagaatgatttataatcctttgggttatatacccagtaatgggatttctgcatcaaatgattatatatatatatatatatatatttaccaaaaagctatttctactttatgtacaacaagaatataataaacccaggtggactgggtgccatggcttacacctttaatcccagagttttgagacgccgaggtgggaggatggcttgagaacaggagttggagatcagcttgggcaacaaagcaagaccttgaccctacaaaagatatttaaaaagttatccaggtgtggtggggcacacttgtagtcctatctcctctagaggctgaagtggaaggattgcttgatcccaggagttctaggctgcagtgagctataattgtgctactgcactccagcctcaacaacacgtgagacctcaactggaaagaaaagaaagaaagacagaaagagagagagagagagagagagagaaagaaagaaagaaagaaagaaagaaagaaagaaagaaagaaagaaagaaaaaaggaaggaaggaaggaaggaagggagggcacaccttggtgacagaataagactttatctcaaaaaaaaaaaaaaaagaaaaagtcactgccactagcccacattccaggggagggaaatctgcttctatcttctaatggaacaggtatacagacatgttttaaatgacaatgtcatcttcaaaattttacatgaatagtcaactaccctaagaaatgcagtgaatacagggcagagtcgagagtcaaaccaagctctttctaactcaaagtctaggcccttagactctggtgtctaagtcagttataattcatgttggaaatgggtttggccctccattttttcccgtgagggacttttgttacccttaaagtgatacagctaaaatgtgtttttaagcgtttgccacagctttcaaaaataaagagatcatcacatgaatcaagccagtgcaatttacagtgcatgaaagccaaagccatctttcctaatgtcctagtaatttactcttggtatttcactggggacttgaagtcaaaattagaagtgggtgggtcttaccaacaaggtggataacttaatcaagctaaagatgttgatatgaatctgaggaaaaataaaaactatcctatgtaaagtcaacagatggtatatatctgaccacaattgagttgctgttcagaccatgaattatttaaataatcaaagttgattgcccaagaatcaacactcagacactacataaaataaaatatgcatttttcccatcactttatgaaagcccatgtccacttcctttatctcaaggataaaggaatgcacatgtaggaagaagaatacaatgttctaatattaagatacggtacagtggcagcacaatggaaagaacatggattttcttcactgttttctcttcctttattaattgtgagaccttaagtaagttaaatgggccttctgagcctcagttttcttatgtgtgacatttaatgagacagatgccatgtctggcacagagtaggccctctggacactgctgttattttagccagtattttatcacattatccagcggcaaggagaacattaggtcccttaggtactgatagagggtctcccaatctcatagtgtggccattcaaagagttcagttgtggagcttgcctcttcatagcttgggggcacacctactttctaaattgcacttcatttatttgtaacttatggcatttacctactcctggtagcactgttgaaagtgtagagttaggtctatgttcctctccccatttctgccaaatacccaaatccactcatctgcttatctttctcatttcagtaaatgctaccttcatctactgagttttttaagaccaaaacctacgattccttcctcttcaccatctccattccccattcagtatattctccagtctcttctctctaattccacatcaaccacctccattcacaccctcatcatctcctcaccatactagacaagtgcagtagattcctgcttcctgtcttccaccatcccatgccccatttccccacagcggatatcccagcctgcagccagagtgataatcttttcaaaattagattatataaccatggctccaaacctttccctctggcctggaagcaaaacccagactcctaactgtagcctgcagagctctgccagccacaggcctctgccagcccctgttctcccattaatacagtgaacttggccccactttgctttttgttgcttcttgcccagcttgccccacctctcagacctgatacactgactgctctctctacccagaagccttgttcctctctccatgcttagctgtctctgattttacgtacaactaaagtattcacttcattactgttaactgcttcatccttcctgaatagtctgcattgaagttgtttctatcagataccttcttcttgcttatttgttcactatctgcctctgtcaatagaatgtgagcttcttgtaagaggggccttctttgtctcattctttattcccaaaatgcttagaatagtacctggcacctagggacaattgagtgaatagttgttgaatgaataaagggtctcttctcagtagtaagtatcaccagtagtcatatgatgtcaaaggacagatgacaacacacgtgcacttggccaagcctgtcacacagaccctggtgggaggagagcaacttcacagagcaagaggctaggcttgtggggagctgccctctgactcccagctttgccattgattctctgtaaccttgagatgttactgatgttttatgggccacaggtttctcctctttgatactagaggcttatatttaatgttctctgagtgtccttttcactctggcactccatgtctctatattcaccacacaaagttagttaaaacacatgtcagagtttattacttttttgtcacagtaaggaacttgtcggggttagtaaaacaaacaaaccaaaaaaaaaaaaaagacttttgtcagcctctcaagcttatgaaatgtgctaatatagttatgtaataggtgatattttttgacaccttcatacacctactctcctcagaacatactttccttaccgtggcatagattgtgcaaagaaggtatgaaacttccctagggtcatacataacaagtcaagaatagcaagaaaaacaatttattactgtagcatatgtttgtgtgtattaccgtagaatatgtatgcatgtattttctttataaacaaacatatttggtggcttacggggtagatatggaaacgaaattataccaactacacagatgaggttaatgggtctgcataggtgttaggctataatggcacctctgagcttgcttttcagggggccatggctagatactagactttcttcacacctgagtcctcactggaaccttcccaaagagaaggctccagagttctggtgatgagctcacttacatgttgcatcagttgctttggttcaagcacttgctccactcctaccgccatgtgaccttagatgaggtactcaccatctctaagcctcagtttcctcaactctaagaatgaagatgagaaaaataacattaatgatacccacatcattggaagaataaaaagtgtttgaaaatttcactcttcataactttttagtttacctaagttgttttgaaattacaggggtgcctttctgaacataattttcattgtcttattatttgctgagaagagggagtgggttttctgtgtgtgtgtttacgtgtgtgtgtcagatcagatgaggaaataccaaatgtgctttctatatggtagcggtgatttcacagcgaagatatgaagcttcctaaaactggtaaatcattatcttggaaagagacagtggaaatgttttagcctctgaataaaaaaataaaaaaataaacacaacataattcccccactctgccacttatttttggagtagccatcatcaggaaaggtaatctgaatctgcatttcattttcttctctgcgaaatagctaacatattgacctcacttgcatctcattttcttctctgcgaaatagctaacatattgacctcacttgcatctcattttcttctctgcaaaatagttaacatgttgacctaacactatgcatgcgtagtatggggctggactagtggctattattatttaaggagcctatccccctacaggcagaactagagactatatgtacatgtgagcaaggtatacagggctctgaaaaggagaaactacttctagttaggtgaacacctttccagaggttttctatggaaaagcacctcttctttgtggacacaacatgggtagaagtcattctgagttgagggaagtgatggggaaaggcatgaagggaagactgaccctcagagaatgggggagacattgtaggaataaaacagttaaaagttcttgctgcttatttcagataaggagtcacagaggatggaaagaaaaaaggaagaaaggaggaaggaaggaaggaagaaaggaaggaaggaaggaaggaaggaaggaaggaaggaagggagggagataggaaggaagatggagatctttctatgtttcagatacttcccagcatgctcctatagattaactcaccttctttcactgaatgaagacatttgaactggagaaggttaaccatgtggatggaggtagagagaacgcactgagtctgaaggagagcacagagagaggctaggtaggcatctatcttagcggtctagggaagagttaaaaagcatggaggtgatgcgtcataggaatagaaagataaagaaagacactaacacttagatgaaagcactagtacaggctggtgagttactggtttcaatgaaccaagtagtatctaaaacagtgctgtccaatgaaaatatagcacaagccacatgggcaatttaaaattttctaatagccccatgttaaatataaaaagaaataggtgaaattaattttaataatatgttatttttatgccaagatatccaaagcaataccattttaacatgtaattagtaaagaaaaaccctaatacactgttttacattattttttataccaaatcttcaaaattgggtgcgttttttgcatttacagcacattttaattcacagcctgttgctgtactgaatactgtaggcaactataatacaatggtaaatatttttacatctaaacatacctaaatatgaaacaggaatagtaaaaatacaagacaaaagatacaaaaatgagctgggcactgtggctcaaacctgtaatcccagctactaaggaggctgaggcacaagaatcacttgaacccggaaggcagaggttgcagtgagccaagattttgccactgcactccagtctgggcaacagagtgagactgggtctcaaaaaaaaaaaaaaaaaaagaaaaagaaaaaaaaatttacgctgtgtagggcacttaccatgaacagagctttcaggactaaaagttgaaagttgctctgggtgaggcagagagggaatgatgtgtgaatgtgaaggtctaggaaattacaaggtgccactgtacactttataaacactgcacacttaggctacactacatttaaaaaaatattttttcttcaataacaaattaacattaatttactgaaacttttttactctataaacatttgcatttttaacatttttactcttttataataacacaactgaaaacacacattgcacatctgtacaaaaatattttctctcttctaccttcattctataagcttttttctatttttaatcttttaatcttatttttactttgaaactttttttgttaaaaataaagacaaatacacatactaaactgggcccgcaaagaatcaggattatcatcatcactgtcttctatctccacatcttgtcccattggtaggttttcagaggcaataacatacatgaagctgttgtctcttattataacaatgcctttttctggaattcccccgaagggcctgcctgaggctgtttcacttttttttttaataagtagaaatggtacactctaaaatactgataaaaatagtataataaatgcataaaccaggaacatagtcatttattattattataaagtattatgtactgtacataattaaatgtgccatactttcataaaactggcaacaaagtagatttgtttacaccagtatgtacacattagtaattcattgcacaataacttgaaaaggactactacatcactgggcaatacaaattttttagctccattataatcttttataaattttatagctccattataatctttttttaatatatatattatactttaagttctaggttacatgtgcagaacatgcaggtatacatgtgccatggtggtttgctgcaccagtcagtccatcatctacattaggtatttctcctaatgctatccctccccttgtctcccaccccccgataggcctcggtgtgtgatcttcccctccctgtgtccatgtgttctcattgttcaactcccacttatgagtgagaacatgcagtgttttgctgagaatgatggtttccagcttcatccatgtccctgaaaaggacatgaactcatccttttttatggctgcatagaattatatggtatatatgtgccacattttctttatccagtctattattgatgggcatgtgggtttgttccaagtctttgctattgtgaacagtgctgtgataaacatacgtgtgcatgtgtctttatagtagaatgatttataatcctttgggtatatacccaataatagggttgttgggtcaaatgatatttctggttctagatccttgaggaatcagctccattataatcttatggggccacccttgtacatgagatctgttgttgacccaaatgccattctgcagcacatgactgtatacatgtatttatataaatgtgtgtgtattacaacagccgttaaatatgatcttgttagtccagttatataaatgaggaaatggacacttagaggtgaagtaaattgcctgaagtcttacacaaaggatgggattctaggcagatctaatttcaaagcccatacaaagtcacagacacatgtcaagagagaatgaaggtaaagcaggatcaggagaccttgagtccaaatacttttgctctatgtgatggttctgccaaatgaggagggagatgtttgccaactagaacatactatacgtagttgattacaaatgtcatatgtatccacatgtcaaataaactcttacctatatattattgcatatgatacaaatatatgtacatatatgcactttacatgttttttctggttcctaaataatctttatggaggaaacacttaaaatatggaaatagaaaaaggaaagctgttaacattagcccagcttttgattgtaacagctgaaatgggccaggctttgtggtaagtattttcagttcctagtacacacaaattacaaaaccatctgagttaatccttcgaatcccgtgaggtgtaggttattaccaaggaacaaacgcatgttcaaagaggttaagtaaagtaagaaccatgtgaccctatctgtaactgtaggattacacaccaatctagtaaaacctgttacggttaaatcccgctgcatggaaagacaaaaacaatccttgcttaaatcagccatgtcgccagctgcccagacgccagttagacattcgcttgaactgtgccaaacctagactggattttagctagtaaactagtattatatagacataatctgaagtcactcaaaagctatctgagtaatcattccataagttgccccccaaaaataaaaagctaaatatttctgtgaatgcatcattgacaaggaaaaggaataagataagaagaaaatcagaaacaaagttgccgacactgtaaaaatttatctgtatattcagcacaatttttgcattagaatttagaaaggataaaacattaggatattggagtagttgcagaatccattttgggagtatggaggttgggggctagggagaaagagagagaggaaaggagggaaaatcctttggggaattgcctctgagttagaaacctgtactctgcttcattttttatcttgagtaaatgaagagagattctcaacatggagacatgatcttaggtacataaccctttgtgatcttcccaagggccatacattatgatgctgaaaaacaagagtccatgataatgacccacagctatttaaaatagcaacattccacaatgaattcctcccttcttaaaggaagacagggatatggtggcaatgggagctcagagttggcaatttcttggcagctaagaagctcaacagggatgaattctttggtggtaaaattgaaatacaaattcctttttcaagtggaacttttctaactctctgagttttcaaaaacagtaactgggtcatatttatttctgaatacctctagagccattttagtgactggcacaaagtaggtctccctcccaaattttcttggatatgaaaatcctgtgagaatatgatccaaaaaagtactttgaagacaataattggaattctcatatgagacacaaaaaggtgacagggcttggtggctcacacatttaatcccagcacttcgggaggctgaggtgggatgactgcttgagcccaagtggtcaaggctccagtgagctatgattgtgccactgcactccagtctgggcgacagagtgagaccctgtctcaagaaaaaaaaaaaaaaaaaaggaaagaaaaagcttaagtgtggtgcaataacaacaaggtaaaaacaaacaaaacccagaaacagaacatcttaatggcttaaaacagcatcctttcatttctcaagtaggccagatatgtttcatgaattggcttggggctctgtgttaagttttctcctcccagcacccggagtgatagagtagcacttctctcaagtgttactggtcaccttggcagatgcaaagagggctctggagtacgtcaaacctgctgcagtctgggaatgacacatgtcacttctgcttacagcacattgccctgaatgaaatacatgcaatccgcaggggacaaagaagttttgtttgtttgtttcttttgagacggagttttgctcttatcacccaggctggaggacaatggcgcaatcttgtctcactgcaacttctgcctcccaggttcaagcgattcttctgcttcagcctcccgagtagctgggattacaggcatgtgccaccatgcccacctcatttttgtatttttagtagagatggggtttcaccatgttggccaggctggtctcgatctcctgacgtcaggtgatccacccgccttggcctcccaaagtgctgggattataggcgtgagccactgcacctggccaggaagtttaatcctaccgtgtgctcagaaggtgacgagacagaagtaattggtgcatagccttaacgtctatcagccagtgagaacacaatgaacaaaccaacaaacaaaaggcaaaaacaggaaaaaaagaaaaaaagaaaaatatcatacccaatagaagaattgaaatcaaagggtatatttacaatattgtctttccctttttatcttctatctactataaagtgaatcgttccttaatgcatggcacaccaaagaaaaatccatcagacctctgaagtactatgaactatttttaaatttgtaactctatttatagatcctcatgtaatcatgaatatgaatatcctgaattttagtttcagctaacatcaaatatttggttaacgtcaaaattagctttactatttagttaatattatagtttcagtgttagttcaagctaatgtcaacatcaactgacgagcaaatatttggaaagcattattttattcccttttttagaaaaagcaaagcaaattttcaaaattaactttgtgattagtcacaaagccctcacatacgtgtggataaaactgtctccatatatatgttgatgtgtagctaaaaaatattggccaggcgtggtggcttatgcctgtaatcccagcactttgggaggccgagaccggcagatcacaaggtcaggagatcgagaccatcctggctaacacggtgaaaccccgtctctactaaaaatacaaaaaattagccgggcgtggtggcgggcacctgtagtcccagctgcttaggaggctgaggcaggagaatggcgggaacccgggaggaagagcttgcagtgagccgagatcaagccactgcactccggcctgggcgacagagcaagactccgtctcaaaaaaaaaaaaaattatacatatttattgatacagcatcccatttaatgctgcttttataaatctgtggcctctgaaatagtgttcatacatgtgtttttgtgtacatgtatttttaaaggaaaaaacaaactgtaaaatactttaaagagatttattctgagctaatatgagtgaccgtgacctgggtaaaatataacccaaagaagccctgagtaagtagtcctgaagcggttgggttacagtttggttttatacattttagggagacagaagttacaggcaaacacacatatcaatccatggaaagtatacattgatttggcccagaaagttggggcatcttgagtcaggggcttagaggttataggtggattaaaagattctttaatttgccatgggttaaaggagtaaagctttgtctaaaaatttggagtcagcagaaaaaaatatttaagataaggaggtctgttaaccagtacactgggtgagagtgacttgtagaggtgtgtgacttaacccttgtctggcagagccttaggtcttatttattagtatcttattgtcacaaagagtttgttttgttagtctttgtaatattaatgctggtcagctgtgcctaaactccaacagagaggtgtcatcacaaggcatgtctgatctcccttcccatcatgacagggaattcgctttttcagatttctctagagtccccttggccaaggggcgaggggtctcttcagagatgaggggatcttagggttttatttttgtttacagtataaaatggtacaccactatgcactgttgacatatttttcctcatcccctaaatactgtcctattctctggcagctggccagtgagggccatcacctcactctgcaagtgcccatggctgcaagtattcttttgagccatcctgcagggagcgcatcccagcagcttgcgtttctttcccatactgacctcttctgctgctgcatattttgtgcttgaaattgctgtttggattcctcaagactttcaaagatgttcaggatggtgcataactacagcaaagaactaaagggagactattactctggacattaaatacacattttatgatagcttgatgtgctttaagaagaacgatgggggaaacatgagcaatgattgggcagttagagatgggtagaagtccattgatattataaaggactttaaacatcttggtagctgggaaagattaaccaaggaatgagctagaagaacagattgccccagggcagtttatgactgcatgcaatttgaatgcacctcagtagggtgtgctaagaccattatagtcctgattgattagcaccagaaaagtatttctacttcctgctaaatggaggatggctgctctgtgcaatctcagaggattgtttaatgtacacgtgtgtactccaggtgccacagaattctacagccttgatttgacaactcaggtctgtgctatcttcctgatattactcatttcacagtctgaatatgagagtatctttgtcactgaacaacagtgttcatgtatgtaaacctgctcattgcacctgctccttgccattttggtcaaggtaagtataatgcctcttgcagtcattcatcagtaccgttgggttttggtgggtgtgttcttccctgcctcagggcaatgctaatttcatttctcatcctccaccatgcctgaatacacagtttacctaaaggttaagaattgagtccaattaagaggatggagcaattccactacattaacattaatagtgcatggaaaacactccctatgtcttcattttttaagcagtagccattttcctgtctattctctctctcttattttttcttcctgcaccacttaatgaaaatctaatggtagcaatggcacctttgttgatgaaagagaaaaagtgataatcgttcctgcttgtctctttctcatttctcccgtaagggaagctaagagtggcatccttgagacaggtttgctttactgatcaaagacagtccttgggagaaacgacccagaggatgaggaattgtcaagaaagctttgccacagacgaatatgatggaactagttcatcaaatgataaaatgtgaactttcctttcatcctggaatggaaaagtcattacaggaaagagtgaatgttataaaggttaaacgtgagtgactgatgatgatgtatcagggaattccctggccctgtaaggctgtctggtatcaggctctcttggcctgtttcaatttatacacaaccatgagggccttacatccatctgttaaagcatgctgtagtcatacatttagctaggaaaaacctttggcatccggggcttctgcagggagcaggccaagagattccactaggttatggatctccttctccctgagggaggcataagtggcagagaagctgagagatcttaagcagctaacggaaaggtttgggaccagctgtttagcatgacaagcattccagaggcattgaggggcaaggaggaaattgagcatgtgttgaatcattactgtaaagaaataaattgccctggaaactgtgtatcagggagaggccttcataattactttatttaccaagccttgccaagctccatcctatcttcacacttgtttccctccacaggccctccctgctactctgtgcttgagtgcaggaattctcaaggtatgaaacacaggaaaggtttatgtgatgcatggatggaatttttgaaaacatcatttttttctattttaatgtgttataaaaaggtataccattagcacttaaaatttataatttcaaatctcttattactaagagagtagtgtaagttaaaaagaaattagtaattcacgtcaattaacttaaagagatttgaagtaagtggtcatttgggtagaaatggcaacaaactggaagatgcttctggaatgagggaaggaatgagggaaggttaggaagtgctagggcacttttccttcctcagacacatcctttaaggatgtggtgctatacctttaagccttactcactcactcctcttcccacttccagaggtgccttcttcctgcagtcctattggtaacattacattttgctttaccagctctgcctcctctgtgaagcccaccctgatttattcagaataattcagcatgtgttctttctgctccctttttatgtggttcatattttaattgcattattcactcactttcatttcagtcagttgcacacctaaagatgttatgcaaatggtattcatttttatatcctcagggacaggacctgcatttgggagatattaaatgattagttttgagcaaacaagttattcatatcctttcttatcaaagtttcatcaagctctacagccgccaaatcccatggcaatactaggagatcatttcttgattagtggcatttgacacagttgaccatgtcctattttgaaatacttgctttacttaacttctagaatgtgataccctccagtgtggtcttgcctctgactgtacttctgctaccttgtttgttggctccttccacgttaaacaagaagaaggtcttagggctcagcccagggctctcttcatcatctatgcattcttcttggattgccattcagtcacatgctggagaatctcaaatttagatctccagccaagattccttttctgaatacaagatgcatatatccacctgcctactggtcttatgatgtcccaaaataatttcctgatcttcttcctccaaatatgctcttccagcattctttcccaaactttgtaaatagcaagtcattcttccggacactcagaccaaaaaacctatgagttatccttggttcctctctttttcccatactttctgataaaaacgttcctaatccaactggctatcattgaaacagatgcaaaacttaagcactgtgttcgctaccttggccattcccaggcccaagatgcatcacctgtctttttgattactacgattgcttcttctcaaacacctctcagttatagagggacaaactgctcacaatatctatgtgtttcctcctgacttcagtgatccagtgtccatccccatccccatttcactactcacagcgagaccaggggccctcttagaccttccatgttctggaggcactggatctctctatattgtgctgacacttgcctgcctgccttcctttccttttccttccttctttccttccttccttccttccttccttccttccttccttccttcctccctctctttctctttctctctctttccttctttccctctttctttctttctttctttcttttctttctttctttcttaagagttatgttggtgaatatgaagcatatgtcattgtggttttgattttcattctctaataattaatgatgtcaggtatcttttcatgtacttgctggccatctgtgtgtcttctgtggaaaaatgtctactcagctcctttgaccttgtataattgagttgtttgtctttttgttgttgcactgtaaaagttctttatctcagatactagactgttatcaaacatatgactgcaaatatttttcccattctatcttttcactttattgacattgtcctttgatgtaaagtttctaattttgatgaagcccaattgaactattttcttgttgttgttgtttgtacttttgatgtcaaagctaaaatccaccttagaggtgttgcacttgttgttgttgtttgtacttttgatgtcaaagctaaaatccaccttagaggtgttgcacttgttgttcccctgattgcaaatctcttttccaatttaccacatgccttgctcgttcacctctttcaaaattccgtataaatagaaccttcttagcaagctttatttctgttcactctatttaaaattgcaatcttttctggacacagcaaacctgggccccttttttccactttatttttcctcagtatttattttcatatgatataatttactaacttatgtaagcatgtttttagacttaagcttcctaagtcagaggttagtgtctgttcatgtgtgattgtattttccatgcccagagcacagcttgctacagaggaggtgcccaatatacccaactggcaggggagttcagcctgtcgccacgggcctcattcttcctgtgtaaaagcagttttatctgcctttcctcacccatccttgacctcaactgttactttatcattggtataattattagcataatcatcactaccaagaaatgtttagaaagtttccacctcttcatggtgttaagctaagcataggcatagaagcacgtatctgggatttcccaagacaatcctgatttaaaaataagtttattagagaatgtaatctaatttttgttttcaaaaaacaaaggcataagaaacagcaattctacatttttgctcctgagctgagtgacattatagcaatggcatggtctttctgaaccacagttttctcacctgtaaaatggggttgttgtgaggattaaagaaaattatttttttaaagacaaaggaggaaaaaatgtaataatgtaatactcatggccctataatttaatttaagtgatctttcaagactttacaaaaagcagaattttctgaattctttgcttatctcttttgtttcaggaatgtgctatgaatgctaactttaatcttagagactcttatttttatttttagttatttatatttttgagatggggtctcactctgttgcccaggctggagtacaatggtgcaatcttggctcactgcaacttctgcctcccaggttcaagtgattctcttgattcagcctcccaagtacctgtgattacaggtgtgcaccaccatgcctggctagtttttgtatttttagtagagacagagtttcattatgttggccaggctggtctcaaattcctgacctcaggtgatcctcccgctttggcctcccaaagtgctgtaattacaggcatgagccaccatacctcgccaagactcttttaaagaaagcccaaaggccaccactttagatatacccagtgagacttgtgttcatgtgttaacgatgccatcacagggttccacaaactggtagcttacacaagagaaatttgttttacctcctcacatttctgaaggctggaaaccaagaccaaggtgtgagcaggattggtttattccaagacctctctttttggcttggaggtggccaccctcttctggtgtcttcacatgacctaccctctgtgtgtgtcactgtcctaatcttacaaggacaccagccatattaaataagggcccacccatttgccctcattttactttaattatgtctttgaaggctctttctccaaagacagttgcattctgaggcattgggtattagaaattcaatatatgaatttaggaagacacaggttagctcataacagtgaaaaaatatgcaggaggaaatttttgtaaaattttttactttattaatgcactgaaaagaaagaaatactgaaagtcaaaaaaagtgtaggagaatctaaatccatcattgaggttggcttctaccttgacagcatgtgcctaatacaggtgatcttgacctttggtcctcaaggcctttagggccccaaaagaagaggacatttcttagggcacagctaaggcaaggagtttaatgagagatgttaacttctcatactttataaaactgaaatttaaaggagaaacttgaaatcaattcccaagggaacacacggaaaatttcctgtaccaatcaggatggaataaaaatctctcctataaatatgttcaataagttggtgtacatgttaaaaagactaaaatatgagtaggaaactatttcaagtgaccaagaagatttaaagaaatataaataatttctcaaaattaaaaatgtaataattaaaactaaaagcacaagggataaacttaagagataattagaagtgactaaaaagagaattacagaactagaaaatatttctgaaaaaaattacccagaatgcatcacagagcaaagaaatagaaaacagaaaaaatatttaagtgatggagaataaaattgtaattgctaacatatatcaaattggcattttggtaagaaaatcattcctgagatgctgtgcaaaatgtaaattgtgtgcttaattttatttgctagtaaacctggcaaataatactttaaatggtagctattattagcagtattgagcttactactaacaataacagttctgtcttaagagtcgagtacacaatcttaaaacactacattctcttaaaaaaaacacatttaaaagcactaacatgttctcagaatgtgctttcctaatgaatttaatctggtgattgcagttgcagtgatggcactgatgacgatgactaaaatgagcaataatgaatgaggaatttgcaatttttgatagggcggtagtaacaccatgtcataaaaaatgttaaggtacttgagagttacagtttctttttttttttccctagctctcatcttgatttcctaggtattttagataacttacgtttcttgaaggcctcacacatgagggtatatgttaatatttccaacaggctttgtttttgggactcacttttgtacataataaattatctaccaggacaataaaagtggcatccttttattaaataactactctgtgtcagaaagccaggcctctaactatgggcattacgtaatttaataatcacgtattatttttctgattttatagagaagcatctaaggcatagagagaataagtaatttctgcagagtcctacagcattaaaaaaaaaaaaagagatcctctagacaatttttctgactccaatgccctcaaatattttcacgatgataaggtactcatttttaagttttattaagatatatttaataagacattaaatgtactcacaaaaatgtataatttactgtttttagtatattcagagttgcaaatatcaccacaatttaattttagaatactttaacactcccaaataatatcttctacatattttcagtcattccccattcctgctcccaccttgccgcattcaccacaatgtcccaaacccagcagtgatatatcctctttcatccctgttttagtgattttagtcttctctcttttttcttgctcaatcaagctaaaggtttatcaaatgttttgatcttctcaaataatctacttttagtcttattgatttttctctatagttttactattatctgtttcatttatttgtgtgtaatctttaatattccttctccttgattttggcttagtttgcgcttcttactctaagtttttaaggctaaaggtaaggttgttgatttgagaaccatccttccctccttccctccctccctcccttcttccctccctccctccttccctccctcctttgttctttctttccttccttccttccctccctccctcctcctctcctctccttcctttcctttcccttccttcctttccctccctccctccctctctccctctctacttcctttctttctttctctttctttctttctttctttctttctttctttctttctttcttcctttcttcctttctttctttcttttcatctcctcctactccttcttcttcttaaatacaggcatttacaacaatagattttcctctaggcctgttttcttgcatcccaaaaagtttgggtatgttctgcttttgttctcttttgtttcaaagtttttcttatttccattgtgatttctttttgaccaattggttatttggaagtgtactgttaaatttccacttatttgtaaccttttcaagtttaaattgttgatttttaatttaaatttaagaattttgggtaacatacttttaatgattttaatcgttataaattcattaaatcttgttttatttttaagcatatggtctatcttggataatttttattgtgtacttacaagattatgcattctgttgctatttggagttttctattgatgtatactgttttttaaatgttctatgttcttgatcttctgcctacttctatttatttttaacacaagagtgttggattctcaaccattattgctaaattgcccatttcttcaactttttttgtgcatatgtctcattactttagggctctgttgttagtcgtataaatgtttataatcgttttattttcctgatgattttctcttattattataaaatgtccttctttgtcattagtaacaattgatttcttaaaatttattttctccaacattattttgtggctaaaataatgttagctctcttttatagttatgcttgcatggtgtatcttttaccatccatttatttccaacatatttgtgtgtttgaatatgatgtatatctcatatagacaacatattccaatcatcatttaaatattctccattttttgtatcaatctctaccttatgattaatttaattcacttatatttaatgtaattatagatctgacaggattcccacttgccatttttctacttctttattggagtctatttttcaatttggttatcctgggaattacaattggcaccttatttttaaacaatcaagtttgcattaatcctaactcaatttcaatcgtatacaaaagcttttgtgcaacatattttatttcttctttcctccattctatattcattacaatgcaatttacatctgtatataagcccactaatacagtttagtatgtactgctttgtgcagttagttgtcttatttgtcgagatattgttgtcatattttcctttaattctttagagatatttttatttatttatttgaacatatttatgacagctgatttaaagtctttgtctaattagttcaacatttggtcttctttaggaacagtttttgttgacttttgttctgtgtatgggccataatttcctgtttatatctagtaatgtgtttcttgaaaataggacatttcagataatataatgtggaaattctgaaatacagatacaggtttgttttctgttgtttttattgtttctgatgatgtttaattgtttactggactaatgataaaatatctgtattcatttttgtgtgtggccactgaagattctgcttaattagcattgttttcagctaactattagattacatttcttaaatgccctgaaccaataagtctttcaggctttgctgagtgtctctgacttgtgttgtaacattacttaaatgcaagcagtttacaactcctccttagctttcacatcctgcttctgcaagtccttaagattagtgggatgtaagaaactaaggtttttttggttattttctgagcatgtgcacagccctgcacatgtgcatagcccttcaggtttaccagaaatatgctgaagcttatcaaaacccttattgtcataccattccccaatttttcctttaacagttttagtcaacttcttattcccaattggcatcactgcctcaggcagatgtgatattaaacaattgtcactgaaagatttcaacaaatgctatgggaatagggctgctcccatggactgatatctgagtgagactctggaaatggagcttcttagtgagatttgagaaaggtcaaatagtaaacattctctgtagctggggcatttgaggaggctaccaaactcattctgctcccttgcatagctgttaggctactgtacttgtgagggtgttggttttcgaggctgccatggagctaagtgaagaaggaagggagcagagcaagttaaagcaccataataagccttgccattcttactgagattcagctatttttattaaagactccttggatggttaaaagcctctattattttccagacatttgaaaaagttaatttttgacaattttgaatagtgctctcattgcttttatgaaggtgtagatttttggaggcccttcctccaccatctggaagtgcttctgttactgggaagtgtggagcatctcagttcttgacattttggaagacataatatgtccggaattgattccttctggtgggttcttggtctcactgacttcaagaataaagctgcagaccctcgtggtgagtgttatagttcttaaagatggtgtgtcctgagttcgttccttcagatgttcagatgtgtccagagtttcttccttccggtgggttcacggtctcactgacttcaggagtgaagctgcagaccttcacagtgagtgttacagctcttaaaggtggcgcgtctggggtagctttttcctcccagtgggttcatggtcttgctgacttcaggaatgaagccagagaaccctgtggtgagtgttacagctcataaaggtagtgtggacctaaagagtaagcagcagcaagatttagtgtgaagagtgaaagaacaaacattccacagcatggaaggggacctgagcaggttgctgctgctggctggggtggccagcttttattcccttatttggccccgcccacatcctgctgattggtccattttacagagtgctgattggtctgtttttatagagtactgattggtgtgtttacaaacctttagctagacacagagcactgattggtgcatttttacagagtgctgactggtgcatttacaatccttcagctagacacagagtgctgattggtgcgtttttagagtgctgattggtgtgtttacaatcctttagctagacacagagtgctgattggtgtggttttacagagcgctgattggtgcatttacaatcctttagctagacacagagtgctgattggtgcgtttacaatcctctagctagacagaaaagttctccaagtccccacccaacccagaagcccacctggcttcacctctcaataattcagccgagagaccaattagtaaagtaagcagaaaggtttattaagggaataaaagtacactccaagagaggagtgggctgacctggctaaaaacacccccaagaattctgcgttgcagtttttatcatgttgggcgtttctttaagttcccacatgtcttaagtctctgcctttttgtttgtctagttttccactgttgtcttacatccccatctttgttcccatctagttcccacccaggtttgtgggatcctcccttactgtcatttggtgcacatgcctggggtccagtgatcaataggaatccaacctaatgatgacattgttcatgactgcctccccaggaaggttgcatagcagttaaaactgtactgattgtgcctgagtatgtcaggaatttcccctttatcctttctcctttcttgtcagcatgtagctggctacattctgacaatttaaccacagaatgagcaattactgggtgtcttaagcggcatttcaggacgttcctgtctacataggtatcaccccttctctctgctaatacctaactacatgtttcaggtggtctctgaggcacaagattttccagagcttcctcaccgagagcattccttttctgctcttgtctgcctgcctgctctaaaaattccagaatgtgagggtttggacctagtgtaggacttgatgctcagctttattaaatgttatgtcctatgatgggagctgactggcccaaaaaggattcccgaggtgagggtagaaaagtgggaactacagcaaatggaaccccctgttatgaaaaggagaggccaggaaaggaatgcaccatttttgtcatggcctccttctccaactctccttgggctagatatttggcttctctgtgctcttccatgctcatacttatctttattccagatccaattgcctggtagcttaactgttgcttctgcttcttcaccagaagataaattctctcaagggcaagacaaatgtctgattgcctctttgcatccttgtggcttagcacaatgcttggcatgctataggcactcaataaatgtttatgaagtaaagtcaaccacaaacacctttcatttcagaatctcaaacataggataggcagggcatagtaaactctgcaacaaacctgtttcaggcaggaaagcagaaagggaactgtcagctccacccatatcttctttattagagggatgaatggccagagtcaaagtcacagaagacaggcaggcattgacaaggcagagaggtatgcagcaacttctggtttgagaggtgcctctgtggtaagcgagataaataaaactggtaaatgatggatctcctcaaggagatgaattgagccaagagctagccttggctgctggtgcacacatcaggaaagcagtatttgagatccgggagtcttgttctttattaataggaggatctggctatgcctcctcattttcattgcattgaaagtaatcactaacatcattatcatctcatcccttctgattctgaaggactttgacatttataaaacaatcacatatggtgaccctcatagaggacagacaccctttaatctctattttacaggtgaggaaactgaggcgctttttccaaatcactaattatgataagtgacagagttgatcctagaacccaaaatgctggctaattgtcccatatcttttttttttttggagcggggagtgggggacagggtctctgtcattcaggttggagtgcagtgatgcaatcactgcagcctccggctccctggctcaagttatcctcccacctcagcctcctgagcagctgggactgcaggcaccaccatgcctggctaatttttgtaatttttgtagaaacagggtctcgacatgttgcccaggctagtctcagactcctgggctcaagtgatctgcccacctcggcctccctaagtgctgggattacaggcatgagccacctcattggcctcatatcttattacggtttgtcttgagttcaaagcaaaatgcatttctttgctaatttctttgggtacatggctgtttgtcttctcaagaagttcgagacccccgcccccacaactctgcagcagtctctgtatttccatcgattttttatcctatggataccctgttttccacctttgtttgaaggaatagaaattataacctgaccctcaaatgagtatccagaaaaaagtgtaccacttctagtcagattccctcaaaagttctttgtcagattttaatttgtttgaaggtcaaccagattcctctttatccctcaaggttcagcataaatgtcatgtactctggaaggtcttcttgaattccccaggccaggttaggttcctcctttggaagtttccatggtattcagtacttttctttacagagacattagcataaccctctgcaaccacttctcaaaacagtgcatgtactgcccctctactggtctaagtcacctaagtgagtaccatgtcaaggaaagcgaagaacaattgtccccaactgcattcctgtggcttgcccaaattctgacacacagtgggctcccagcattttccaaatcacagactctgattatttcagttctcagacctgggtcccagaagggctgccttcactttggtttctctaggccagcagcttcttgtataccaagtccaaaatctggatctcctcaggggcatattctgttggctatatttccccccacccactatgtatagggcagaatttcttctttcactgcatgtctcataaatttttgttggaaattggtcattcaatttgcaatatactatatattattgtcattcaatgtcagtttgagataatgacttcttggtctgtacatataaacattgttgtaaggatgatgctaatgatgaaagcgcatgcaatatatatttttacataatttgggtatgaaccttttttgtgggggttggctaacgtagtaatagttggtaagattaaggggatgagggctattatagtagtggaagaatacatgtttgtaacttttatttggagttgcaccaatatttttgcttcctaagaccagtggatgactctaatcctttaaaagttgagaaagctgaccgggtgcggggctcatgcctgtaatcccagcactttgggaggtcgaggtgtgtggatcacctgaggtcaggagtttgagaccagcctggccaacatagtgaaacctcatctctactaaaaaaaataaataaataaaaatacaaaaattagccgggcatggtggtgggcgcctctaatcccagccactcaggatgctaaggcaggagaatcgcttgcacctggaaggcggaggttgtagtgagctgagatcgagccactgtactccagccctagcaacagtgtgagactccatctcaaaaaaaaaaaaaaaaaaaagttgagacagccatgttgtgggcatgggggcatatattatacagataatatcttgtaacaactcttttatcagatttctccacagcccagtgttcatggctgttgctggtttgttgctgtttttcttgttgttgcgtgttcatgtagtgaccttcctgaattaattctgtctattctgttttcctgggagtttgcagcttctaagttctcttctagctcttatttgtttttatttttgtttgtttgttttcttctgttttgagacggagtttcacactgtcgctcaggccggagtgcagtgctacgatctctgctcactgcaacttccacctccctggttcaagctattcgcctgcctcagcctcctgagtagctgggactacaggtgcatgccaccatggcaggctaattttttgtatttttattagagacgggtttcaccattttagccaggatggtctcgatctcctgacctcgtgatctgcccgcctcggccttcctaattgctgggattgcaggcatgaaccaccatgccaggcccttgtttttgttttttagttcttgtttttatttttcaatcctgattcctagtgattatgtctctgtcagtataatttagtggccagccaatgagtggtcagattttaaaaaatgctttgctatgtgtcttcctccctttgccaaagggacctatgtggataccttgaacttcaagcatcttacaagacagccttagcttttacttcctgcttgtgcagggcctcaaggtcagtcataggtgagtgattggtgctctcttctttccgaggtctttttcggcatgtacacatccatgcacatgaatgcaaccttgaagattcccaggagcatgtaggagattttcagagtctctctgatcttctccaaaatttgccattaaattccacaccaagctcttctttgctccagctaaaatcgcaaccttatgcagctgagaggtcatcaacaatgtgctgtcgttttggtcatgcgctggagttagccctgcttctccccaaaccagctgaggtctgacttcaattaaataaccaccacactgtgagaacagagatttgtcagggcaacatgactttaaacaaagtgttgactgtgctctaataatggtgcttttttaatggaacgtcaaaagttctcagatctttcaattgtctgcaagactgcaggcttctggccactggaccactggaccactggactgggaagaaggggaaaaatggaaacatcaaataccccacatcttcccgaggctcagtagtttctctcgggtagacaattttcagttcttcaatggcttaggttaattgctagaactctgaaatggttgattttatttattttgcctgtatttatgttgttttagagagagagagaatctaccaggttcctcaatctgcaattctggaagaggtagtgaatgtgtagttttgaacttgtgagtgttggtgggattttgaatgaatcgtgccaccttaccagctatggaaaaggatgttggctaattagtggcacaaaaataggatacaagcaatctaggaacttaaccaaaaaaattgttttaattactctgcaaatatttacttacacgtaaacaactgcagtgatcatcacacatttttcttatctatctaaagtgaatttttaggtttgtgttgttgcagttggtggccatggtaatgagttgtgtatgtcttgtgaacacttttttggggtaaagtcaactatttttagaaactgaaagcaataattttggtgtttactcctgttaatctcaattattgaggagtacacagagtgtggctgatgtatgaatctcagctgttgggggagccgtgtgccccactctcccatatactatgtagattcttttcagactgctttgttggcccattgctggattttattttttaatgttttattctgaagtaatttcatgacttatttggcattacaggaaacaagccagtggtaagaatatttaagtggttaggtaagcaaagctgaactgtaaaacttttttttattaaaacagtttttatttcagttttttttggggagaaaaggtggtatttggtttcatggataagttttttggtggttatttatgagattttatggcacccatcacccaagcagtgtacgctgtacccaatgtgtagtcttttgtctcttacctgcctcccacccttccccttgagtccacaaagtccattgtatcattcttatgcctttgcatccttatcattgctggctttttaaataagggaatctatgaggcatttcttactaattccattgatgtttatttttctgttccgttaatcactagaaacaagggaatatttgtggctttgctcatgttaacttttatctctcactgaattctggacacgctaagttatatatgtgctgcacttcacttttctaccctcttcaagacaaaaacagaaaaaaaagttttctagtcacaaaatgttaggcaactaacgtttattgcctgactaatcattttactttattgactgagtaatcattttatctacatgatgccactgggaggtagtaatttgtgaaataccaccttggacaattcattttctttctccgcacaaggcctggggatgcttcgagccagattgtgctaaagaatgtcatgtttccaaaggataaggtttatcttccatgaaacagaccatttgcaaaattaataggtaaattagcaaagtgcaacagcccattagacccactgtcagagtttagaatctgagttggggaaaggaagtaaaagctaaatgtgtaaacagaagtaccctgaaatgacagcagctgtcattctgtggtggagggttgcagctgcttaaacaaagccagcggagtgctgttaacatgcagtcctgtcaatatctgaatatacactcacagggcaaatgcatgggctataagaccagagctaggaatcatgcttactcagtgtatgttaaaaacattatactgcagggaaagagtcagagcttatatctaccaaccatttcttcatttatttgaaaagtttctattgaacactagctgtgctgaaattttaataatccttactctataccaaagctctgggtatggccatccttttctccctggagagctgactttctcttgtaaactggaaacagctgccttgatagccaaaaggttattgactattttggcttaagcatggactttacaatcaaatggactgtttgaaagctgtgtgaccttggaaggtttttgaggctttcattgtaaagtgaggaggatcccaccttgcggagtagtcttgtgatgattaagcgagaaaaatctatgcaatactcatcatagatagctcttatttaattattagtatgtgccaggcagtgtgctaggagatctacatatagcatgccatttaattctcacaacaaactgtaaggtggcaattattatgatccacagcttacatttggggaaactgatatttaagaggtcacacaagttgtccaaggtcactgagctagtgagtggtgaaagtggacttgagatccatgacatcaggccccaaagccttgacttttaatcaccaggccttcctatgcttacagatggtagccctcaacagatgctgggttccttctttgtccttattacccacttccacccctcatgcctgccataggaattaaaactcttcaaagtacttttctagatagcctctgaggtacacaatcttcacattggttaataaaggttgttgatcttcaaaatgtaaattgcttgtgagccgagacacccctggatgaaaatcccctcggatacttcttgtaattctgactgcaaaagtgcagggggttcatttcccttttccttctcatataaattaaagaagacacattatttccattttcctgtctcagatcttgccttctccactattttggaggctgtgcagaataaatactgtaaaatggctcatttctgcttacactttatttcttagtacccacatagatcatctcaatcacctatagaaatatttgtgtcaaaggctaaggcagctgataaaatattttccttgtaggttatgcatctgagtatcccagcatctcttcattgaaagaaaaatagttacatttggtgattgtgatgacttaaggtagtgaaaatatttttactgccaacaaaagcagttttatggtgctcaatcctgaatcactaaaatctggattttcagtagagcaaattgtactgcttataactgaggttttttaaaacgaatgcaatttattatctaggcagtcttctgtggcagatttgtctatgtggttaatgcctctaaagagtctgtagacacccaatatctaaagtaagtgtgtgtgtgtgtgtgtgtgtgcgcgcgcgtgttattgagcattcctgtgatagcgagggaatgaatggcacataagctaaaatgctgagctcctaatttatgtaagattcagaagcctcatgttataattctcttgagtcctcattttttttgctgttttttccctccgctttctaagtttcttattctataattaacttttcataaatttaggtcatcttcacaattttattatgaagacctcacagttgttttgaagcaattgaggtaatagaatgttggacatagaatttaacccttggcccatctaattccagaatttcttgtcatactaccttctgtagaaattggtgaacagtctcctactcttaaatagagacagtagtgtctggggtgagtgggagaattcaattcaatcttttatttattagtggcttactttttgctcagcactcagctgtgagctggcaactggggagaggtacacagacactagatagttcagacccaattcctttccttaagaaaattatcatatattttggaggagtggagtaaagaaggcagcatgatctcaagaaagatttaaaggacaacatgacacttatttgaacagcagaattctggaagcaaattagtcttgtggaaatttagaaaactgaactgaaggggtaggaggatactttgtggtagactgtgatttaatggatgtgctaaatactccccaaagatggctcacctatagaagaaaaggacctggtaccggagagagggaaagatccagcttcccctttgttccagatgagcccagccttgtcaacagtcctttcccacatgacagacatgggagtgaagttatcttggacattccaatcccagctgccatctgactgcagaagtttgggaagctccaagaaaaactagaaaaagaacatagtcaacctgcggagttgtgaaaaataataaaatagtgctttaaagccacagcatatttggggtggtttgttatgcagcaatagatatgtggagctttgaagatttgatataatctagacaagtcgaccagaattataagcaccagaagttgtgagaaataatatgaaatttattgacttccgatacaagttttaaatacatttttaaaaatcccaagtaaattctataaagcagcactgcccaatagaacttcctgaaacggtagaaatgttcttagctacactgtccaatatggcagccactagccctgtgggtgtagagcacttgaaatgcagtcattgcgaatgatctttttgcaatccacaagttgagttgataggagagaaattaccagagtttgtggctatgttccttctaggtttggcgtgtgattagttgggtacctggggctagagttgcaacggagagaagggccatagtgccactaattctctccatgccagtgtctctcaaatcatggtatgtaagattgggatacctgttaaaaatctcccacacaagttcttctgcttgaagagcctgagcactgcattataagagggagtctggattaggtagtgcaggtgcagtctctatactcaggtcttcacttaacaaccacccaatttatctagatgactgtgggtggtgttaacagctaggccttcctgaacagttattaagcatttcattagatatgtttaacattctttaagaccttttaaatattacctgttttttctttaatctgaaatgtgctactctgcaagtttcattatggttcatgggtttccttttcacacggaattacatttttcttaacttcctctcttgagtgcttggagaatattgatgtgaaaggtggttggtaatcacaggaagcaacttctatattcagaaaggatggtacttcctgatcatggaaactatggagaaacttgtacgtggcaagtagagagatctgattgaactacaaaaagtctgtaatgaaaaatagctattttcctttagaacatactttctctcaggcaaaaaccctgattttaatgaatatagaataatcatttgtaatattagttaccatgtacataaaattagggtaataaaatgtggaggtatgttatgtgtttttaatagattaaatttgccctgttttgttatactgaggtagacatttacttatcaaattatgtattcaaaaattgaagaatttattcaagtacattttactagtactaattctgaattgatagtgttcaaatttatgaaactcctgtagtcatcaaaagcaggtgagaatcctagggtcacaccccctccagaccttgctttatttccttgtagacattgaaggaagcattgctagctataagatagtctttcctgggatttttccataaattctctactgcaaatttcatactataacttaactctgtatcaattgccaacaacaaagacggcaagattctctaattggactttgttttgttgaaatacagctatgatagattcttttggcaataatatctttggaaatgctggaataaagtttttttaaaaaaacgaatagaatcctgagggcatatggggagtctagaccttattttttccttgaagatattggaggaaacattgctatctatgagatattatttgctgggatgtttccataaatcgctaccacttgaggtattattttcataaatttgctaaagggggcaaaattcagggaaaacatcagttagtctggatgactattttagaaaaaggaaaatgcagaggagtgagtcagatagaatgacgtagaattttaggataagtcatagaatgttgggttcatgaggaagcacatgataattcaattaatacaaaaaggaagaatccattgtacgattggaaatactatgaggctgagttcactcggggacatgcagttagctagcaagtgtctggggaaggggaggaattacaaagcagagctgtgaaatatctaatcagatggaccttttaagcaataatgtattgccaaactgatgaaaagtcattacctttgaataatagcccacatctgagagttaattattacagggtgagactatgggtgcctcatgcggacaaggtcaattatcttatacctattaaaatgtattatgaataattcacaggtaaaagttagctgtaaaacacgataaaaataaaaggtgaggaaaacattgaattcagtggtaatgtattttgataatagcaggcagataattatacaaggataatgttcacacataggatatgaagaattactagtcagattggtcttcttaaatgaacacaacaacccctgccattctcctgcttcagagaactgtcatgttattgcttttaatgtcactactgtttctactttgcatgccaccacgcccagctcagtagacatttatcaaatatttactctttccttgggtttatgtcaattcctggggattcagtggtaagaccagagcactgctccttggaaactcacagtctgatgcaggagataaatcagtaaacaaataattttaaacaaattaaccattatcgggatgaagatatttgtagaggcctagccctgggaatggattcttgagagagattaggactgagcaattcttggatcttggaaggtgaatgggaattgaccaagctaagatgaggtcggaggaggcatgtggctagaaggtgaagttgggtcatcagcaaaggctctgtaacataaaatagtatctggtatttgcatgtgtgtctctgcatgtatacatgtgtatgcacacatgtgtttgcctgtccacatatatgtatatgtgtgcacgtgtgtggatatgtgtgtttatatctgtgtatatgcatgtgtgcatttatgtgcacatatgtgtatgttcagatgtgtgaatgtgcatgtgtgtttatggtgcgtgtgtgtgtttgattgggtggggcaatggaatcagaggtgagtcagtatctctgcagcataggtcaaaaaacacttcaatctctatttataatcttcataatatttttattcttagttcagttggtcttgctgtgagcagaagtacagacttctgtaagaagtaaaattagcattacttcttttctctcccattttgcctgtgtgcccaatataggacaatgagtctttatacttttgtagaacaaagggaaagggggtgttcagaaggaaattgtaagagatgccaaaaggggaagttctgttctccctcacactctttctgttttacaactctttcatcttcacttacgggaaatttttttttgtaatgaatatacattacttttataacttgagaagaaacaagggatgctttaaaaaccttatgttaagcaccagtatgaattctcacttggagtgaaaagtaaaaaaaataaaatcatctatatctattaaaaacacattaagtatcagcacaaggtctattatagaaatgtgaaactattcagttcttgaatattaaattaattatttagattcattcagagtgcattttgattcaagtggtcttactacaagtcaacatgctttgtattagttatttatttgaggactcttcctcatgcatagtttttcctctaaaccagtctccagaagcagtgtttcccctcactgagcaacatgaatatacagacaatattcaaacgaattttttccccaaatcaccaccaattcttgtctgcaatacttaatagtcttctatcagatgtccctgtttccagttctttgtttcaccaatatctgttatgcaatgttgcttaaattcttacctaccaggtaaatgatagacatctgcccaagtcactcaaggccctctgtgaccctgctccctgctggctgggatctccagcctctctcctgctattcctctacacttcccctaaccatccaagctctttctagcctcttcacattttcacactgctccctctgcctagaatacccccatgtctggtacatcacttcaacccctccttaggcattaagatttcattctaatatggtctcctcctcaaagccttccttaatgtctccaagctaaattctcctgaatatattcccatggctctttgcttattcaaaaatttatcatgtcttagtgtaaaatttatcatgttgctatacgggcaaagggaaaacttcccctttaccctcaaggtttgcagaaaatcaatgacaaaaggcagattaataggagaaaaggcaaacaaatttacttgatcatacttttacacaatacagaagccttcagcgtgaaggcccaaaggtacaggggaaactccatttttatatttaggctcaacacaatatgaacaactgtgcagaaagatgattggacgagaaggctatgatctaatgcaaacagactgagttggaaaactcagaaaagcctgtctgttggcttttcagaagggtaagaatttaagcaacatttttcttggcttctctgcgtagcattcttccttctgggtgtaggggttttatgacctataatcatacaaggtaggtcagatcatttctttatggccagtttttatacaaaaagttggtgggtaaagttagagtaatgcttttaggttttatggctggctttggagaaaagggattctgatttctattgtctgccttgaggaagagggattctagtttctatgcctagccttaggggagaataagaggccagaaacagcagggcaggagatggtcacaggacaatgttggctttctgaggacttcatttcatttagggatatcgttttctgatcctcagtattgttgaaattattttgtttcaggctcatttatctcatattgtcttgtaaattcaaagaggaagatgcttctgtgtttgtaaccctggcaccatagcacagtcgctggcacctattgaaaactcagtcagcgtttcatgggtgaattaatcattccatgcgctcagtggtcccagttttcttcaattagaccatgaacttctgtgatctggaacttctgcacacactattgtactagataaaacatgtgatgtgataaatgcaatgaggggttgtctgtgaggatgtccaccagcaattccttccatccctgtctgtgcactctgctcttcttattaagagacaaaatcgttttccttccccatgagcctaggctgccttgccactatgatttgctttgaacacgtagctctgggccagtcctctgtcttggcattaggagatatatcggcttttacttttgtgctcttggtatctaacagccatgtaaagaagcacgaattagattattggatgataagagaccacatgggcaaagaaaggatgaaaaagttctcagttcttccaactaccctagttgaggtgccagacacatgagtgaagccctttggggatgttccagcaccagatgagtgtggtcacagtgaatatcacattagaaagcaacagcccaggaaattctgagaaatagttaactattttcaaccagaggtcagcaaacaatagctcatgtggcccactgtttgtttttgtaaataaaggtttattggaatacagctaagtgtattcagttacatattgactatagctacttttgcactactgaggggagttgagtagttgtgtctgagaccatatggcttgcaaagcttaaaatatatacaatctggccttttacagaaaaatgtatggactctgttttaaggcactaagtttgatcaagtttgttaaacagcaaaagatcactgaaacaactgctctcagatttcagcttatccatggaggttggaagggggaaggaaagatgtcacaagtgatatgaggtcaggccttaatgtgcatgcactgatgagagtccaggacatgaaggttggtacaaacagaaatcgatctctttttagctccagattttttctccccctttcttactaattttgagaaagaaaatactagcacagactaagcaaagttaagtaaaacatattccccaattatatgcagatgatgggattagagttgctgaaggtattatcttccctcattaccaaaagaaactgcacagtgaactgttgaaaggccaggagaatgagcgccaatggtctctgggggaaggtcctggctgatgagttggcctcttcttgttcagcttctttaactccctcccagcttgtgattccccaaagggcacatccatctgttcttcagaaatcaaagaattctttgtgttttttttcctgtgacatatgaatcttttctggtaaattctgaaatttttttacccacaaatttcagttaatagaaaggtggcagcatggcttggtagcaagagtgtgagtttcagagacacacagatacgggttcaaatcttggcttcactatttttttttccccgtttgggcctggaccaagtgctttaaccttcctgtgcaccactttccacaaagtgtggacaaaaatggaaacatagttggcacagaataaatgcctttttgttatttttataatcaaaatgtattctttgactatgctctgagatgatctcattcaatgttcaaaataaaaatcccaggaatatcactgcttacccagaagagtttaacagtaatcaccatttgtttgggaacataatgtgtccaagacattgtgcaaagttctgaaataacaaagatgaatatcataagtcatagaaacctctttagtatgaggattcagaggtgttaacagtcagacctactgggatagagggctaggctgagttttattcgtttttctgaaattagaatggtaaccattgatatccattaagtgcttaccatgtgcctaattttaagtactttacacgtgttagttactctgttcctgacgcccctgtggaggccgtggctgagacacagatgtaccataatgagctgtcctttccctactgggctccactgccctactttaacatcgcaggcatgggccagtttatttttcaatagagtggaaatgtgaagatgtttaagcctatatcatattaaatggtgtcataaggcaaaataaaacaaaagaaaaaacaaaagaaagcaaaaaaaaaaggcaaaaaaaaaaaaaaccaaccaaccagcttgactgttgtgtttcttcacagctggctctaaccagcacaagctgacaaggggcagtgagctttgaatgtccattatctgacctagctgaagacacttgcctgacccatgaacaatgggatttcgtataaacaacaatgggatttcgtataaacaactgtgtacacacttatgggctcattctgttttgtctgagtgctggtgttcattgctgagttggcacagctccatgacctcccacttctaactttaaaactcctgagcttccccctctttagtgacctactcagtaagtttcttcaaatgaatgctttcaggcctaggtagtaaacaaacttgacattttaattatttaaaaaaatagttttgtcttatttttaaactctagtcatttttatttagttctttgatgaggcatagagtgaataagtaatttgctgactccagcttgtagttggcaaagctgacatttgaacccaagcaggctgtccctagaacctgcattcctgccatcttatgctgctcgcctgcatagagtcaaatactgagcaccaggctcttttctatagtgaaatatcaggtgcttaaacatagtctgaaatgatcttcatagctgtgtggtttggcagaatattggtaaagaccttaatgatataaaaaataaaaatcactgattataatacatgtaaacacataggcacaggtttttagtgtccctagtgttttaatggtaatgtttaataacaaggtctccaaaaaaatgtgaatgtgtctagatacaagcttattataaatttactggcatagaggatgcagagcaatttacaaataatagtaaaaatgcatgctattcttactgtacattccacatgggcattttattctcacagaatgtattcattgattttttttccaaatcctggcattcatagtcaacctacagttaacaattgttgaaagcatataaacacaagtaccagtcagtattttcatttacatcagtgagtaagacaaaagtgaaacaatgaaggcatatgctaaagctttgcttgtttgtcaatgatggaagctgcttctttggcgagtcaaataatagctttagaatactagtagaatatttcctaaattgtgtgtgtgtgtgtgtgtgtgtgtgtgttacaatgtaatggaagcaacatgacacacttttaagtttaaatctatattactagtattttctccatcgctttcttcagtccagagaatcgataaaacaatacatcaggccatgatttgtataataacagtgtatagtttctgtggtgtgaataatcgcaccatggccaatcttaccgtaccaccatgcagttcctgaaggtggacctgagcagaagtgtgcagtagcacagcacttgcagttacaatagatataaacaatctcaagatcacagacatttgtgaaatgcagtcaaaggacagaaaatcatgagttgagtattgtctttgtttttaatatgattcatcagttgtaagtttgtgtaatttatcttttaataacaactatgtttcacagccaattcacaaaatttctgaatatttagcaagcagctcccctgaactagtataagctgtctgcagaacaccaatgggtgtacatgaagaatttgtgtacagggaaaatacaatcactgttttgagttagacttcaaaatatgcacctaaactctcagacattttcatatcatttataatagaggaaatgtcttccaaacttaagtgggatgcaaagggtatgttaacatatctcaagaaagtctgtgttaatcgaaaggaatctggtcagctgaagcagcagcaatctacattgggtccagatggagggagctaggactgatagacagctcataccgatgtccccattgcccaggctgtcctcatacagcaggtggagagaagcatcactctgttgtcttctgggtgatcattgcagagtgaagagtgctcggcacctgtcccaggttccttgtgcatatttttgcttgtaattgttaaaacaaatttcccctaggtagtagcattgcttctagttttaaaaccatgaaactgaggttgaagacttgtgaagtaattttctcaaaatcacttgtctgttaagaggtggagtcagaatgtcaacctggagaagaaccccaaagctttccctcttttatcctgaagattcaaataaataaaaaatacttagagctgagaatcacctcggatgttggtaaaggtcatgatgctgctggaggttgttcagaggatccagacaatgatggctggaatgattcctattaaaagtgaagaaatgttactggagtgaagtttggaatatttcagagcatatgttttcccccagtagcaagaattcttttgctggtaagttaaagaggcaggaaacaatgcagtgatattttctgctttcccttatgccttctgcacttttatcccagaacttcaagtgcaaattaaataaaaaggcttgtgatcttttctatcctagagaaataactccttaaacatccattctcttagttttacttatcttttcttaccttctgcctctcagtgagaagtagtctttaaatgaccagtgaaaggctgattcctgtctagtggccatagtcagccctgccttctctccctggagctactcggtgcctgtctaagtcactgagtcatatgtccctgaaaaggaacaaggaagttatgttcatttaataatctcttaaaatatggccttcgtcaaataaatcaatgaacttaagaaaacccagaactcagggcgacttgccttctgactgtgtgacttttgaagcatctaaggtgagcgtgtcaaataatacatgacgatcttcaattctcaaacgtatgcccagtcctgacaccatcaccactaaacacacattcacacacacacatacgtatccataagtacatttttcttgtaacttccaggttaagatttggttcaataaagcagatctggtatagctagtgtatcacttatggattggggcttttatttctctttttaaattcatggaattttataactttgtgggaaagtaagttttgtttctttcagccttttcattgcatgagaatacagtgtctcaggaaggttaattgacttcatttgagtcatacaaacatggatccacttaataataaatctgcttatacaactcagatgccttgatttttttaaaaaaaatctttatttgttttagaattttttaaatttacggaaatactgagacaatactatggagttcccatatacactgtacccagtttcttcattattcacattgtacatttgtgtggtgcacttattgcaattaatgggcccatattgataaatggtcattaactgaagtccagagttacttggattaccttagttcctacccaatgtcttttttctcttctgagattccatccaggatgccatgttacagttacatgtcatgcctccttaggctcctcttggctctgacagtttcttagacattcctcgttgaaaaccttgacagctttgaggagcactggtcacatgttttgtagaatgatcccctcatttttaatccagtgttatctctctgtttattcaatacttgactttttttctctaggaacttcaacaaggccttatcttaccttaagtgagcaatgtgaatgagtaatttgatgaaaagatctgaaaggacatcccttagtttgaaaaaaaaaaaaaaaaagctgtacccttccagaagcctggcataaggccagcacatccttcactagagacttcttcatgcaggagtgccctccggagtgcagacgctgcctgagcagaagcaacacaccaatgcttcatcatctgttaatatccttgcacaattactttatatatatatttgcaaacatctacctgctatatactaggcactgttctatgaacttgcattaattaattattacattatttcagcacccttatcagatagattctattattatcctcattttgtataagaaaaccaaggtacacaattaggatgtaatgtgcaccaagacccagaggggagacagaggatggactcatagaaaagtagaagacattttagcatgaagaggtgtgagtggtatatgatggggccacatcctggaagccctttttggccatgctaagaccatagattttttccccaaataatgatataatacagaaagattataaaaaggggtatgatctgctcagattcatattttaagggaattcctttcctgcagcatgcaaaatgggtttgaggtggactagactggatcagagaggctgttagatcttatgggtgagagagataatctgcataaaggctgaggaaaggggaatatttcttggtctctgaaattttgcttcaaacaggcctcattctctgcagatactcagagatgcaactgcaaaactcaagattttaatatgcccaagtagacgagaggatacacacacacacacacacacacacacacacacgtttgcttatttatatgtatatatttagttatttatcataaattgattggtagcaggtactaaatcttttttcttaaacttttgtaagcaagaaatagaacatttttgtattttgttcctatcaaattgaatctgaatctgagctgagatgcaatcttggtgatgattgggtcattctacctgggcatgaggactctggaaggctcacatagtaccctgaactgggggaggtcttctatgcttctgctcatcatggtcgacactggcattcccattgtccaggcaggtgctttccactgctgactcctgagagatgtaggccaaagcccttgtctctgccccaagtgccaaggtgtgtggttggccatcctagcccctggggagcctcccactctgaggatttcccaccccctaggccattagaaaacctgcatgagagactcactctgccctctttccacagagggacacttcctctcttttcctcagtgtctctgcctctgatccttcgaagagtggcagcccagtgtgaggaatggaattctgtatgatgatggacatgttctattctgcattttccagaattgtagccactaaccatcatttgaaatatggctagtgcaaatgagcgatttaatatttaattttatgtaatttaaattgaagtttaaatagcctctatggctgacagctacaatactgtatagtgagagagagggagaagccaggaaggaagttgatttaagcagctgtgctttctgccttgcaatgcaaatcacccctaagaagattacgtgcacaggggctttgtggtctgcttagaatggggagggaaatatacagaaattcttatctcaatacatcatcctgacacagatacattcactttcatgcttatatgctttggatgcgttgcctgtttgtaggttgcagggaggggctcagattggtaattgaagcaatactggaaaactcccccagaatattttctgctttcctttctcaccctacagtctacccattggaagcatggccaaagtcagggaggttcaggacattcaatgctgagcgaggtcagcttcagccttgcttcactcagcagagtcaagtgaacaggctgtgctgggaaatgggatttctcagactctcaaggttgtgcggatgtgccaccacccaccaacctctcccttggctgtccctcactgcttcagtaacccatacttagaaagcacattcaccatgaatgctcttagcaatcctgggaggttaattgatggaggtggtcaagacaaagaggcatttggtcatgcctagaagtcactgccaggctctcccacaattctcagtttcagagtcctataatttgttctttctcctttctttcttttctttctttctttctctttctttctttctttccttctctttctttcttctcttcttagatataattcatatatcataaaattcatcgttttaaagtgtttgtttcagtggttcttagtatattcacaaggttgtacaactatcaccactatgtgatcttaaatacgttcatcaacccaaaatgaaaccctgtacttgttagcaacttctctccattctcttctcctctaagcctttggcaaccattaacactaatctattaactttctgtctttatggatttgcctattctggatcatttatatgaataaaaccactcaataaatggtcatttgtttctggcttcttccacttaatagaatgttttcatgatttgtccatgttgtagtatatttcagtacttccttcctttttaaggctgagtaatattccattgtgtatacatatcacattttgtttacccgttcctcaattaacaaacatttggattatttatactatttggatcttatgaataatgctgctatgaatatcactacaagtttttgtaaatatgtttttaattttcttgagtgcatacctaggagtggaatggctggatcatatggtaattctatgtttacatttttaagaatcaccaaacttttttccatagaagctgcaccattttacatttttattaggagtacttgaagagtctaatttctccacaaccttgccaacacttgtcattgtctttttattatagttatcctagtgggtgtgaaatggcatctcattactgtttgatttgcattttcctcctcaccaatggcattgaacatcctttcatggtaaaggatttgtcattttatttaaattgcattacttttctttgtgttgttgatttgcaagaggtttttttatgtaatctatatactaggcccttgtctgatatatcatttgaaaatatgttcttcaattctatgagttttcttttttgtatttttacaatatatttaatagtatatatttaaggtatacaaaacatgatattatgagatacatatagatattaggttggtgcaaatgcaattgcgttttttgccactatttttaatggcaaaaaccacaaatacatttgcaccaacctaatagtaaaaaggttattatactgaggcaaattaacgtatctatcatctcacatagttacgcattttttttgtttgtttttgtggcaagagcagccaaatctactagtttagcatgaatcccatacacagtacgctcttattacctgtatggtcctcataatgtaccttagatctctagacttggtcctcctgcatggctgctgctttgtgtcctctgacctatatattcccatttcctatgcattttctaccctcctctgtcaaccctggtaaccaatgtgttgttctcgatctctgtatatttgaattattattttttaggatctacctataagtgagatcatgcaatagtttcttttctgtgtctggctcatttcacttaccctcgtgtcctccatgctcatctatgttgtgacaaatggcaagatctcactcagttttagggctgaataatattccattgtatatatgtacctcagtttctttattcatgccttcaatgatggatgcttacgttgttttcatatattgggtattgtgaataatgctgctgtaagcatgggagatcagacatctttatgagatggtgattccatttcttttgggggtatgcattgaatagggatcactaggttgtatggtagttttatttttaatttcttcataattccccatactgctttctagaacaatctacattcctgtgaacaaggtacaagagttcccttctatccacacccttgccaacatttgttattttttgacttcttgataatagtcatcttaaatatgaagtgatatctcatagtggttttgatttgcatttccttgatgatgaatgatgctgagcacctttacatatgcctgctggcctttttatgtcttctttggtgaagaaatgtctatttacatgtttttgcccatattttaattgagttatttgttttttcttttactttctcttatgattgacctaagggggattttttgtcttatttttttcccaacattttactggaaaattttcaaatatatataaaatttaaaaattgtgtagtgaacgtcaatatactcattacctaattctacaattaatattttctctttatgacttatcagatatctatttttattttccttcaacttttctgagtatttctggtgcaacctccttctccttaaacttcaaaaattctttttctcatcacctaccaaggctttgatccattcagggctagcggaaaaagaataacacaacaaaaccaaattcttctgcccaaaatgaggatctttatatggaacatctgtatttgagtggtcaaatttgttgtcatccgatttacattaagcataagtacttctgttctgcaaatcatttaaaatgaagaattatgatgtccttctgtgaaactatgaacacttttttttttttttttttttttttttttttttttttttttttttttttttgctagtgaagaacttcaaggaggacaaatgcctttaatgccactctcaacttggtgtgtcctcaatagatatagtaatcctttagggatgtggacattgctttccccctaagacttagtgagtgagaggttatcttctctattgccttattttatgtccctgagtttaatagtgccaattccatggctgttgagtttacctgctttatttgctctaaagagaaagttcagcagaatttcagaaggggctggagaattgcatgccaagcagtgtctgccctatatcaattttgtacagcacgaggaaaagagaattgaaaccaaatttcccattatgtaaaagtagctattaaaaagatacaactgaatttaagatgattgtcaacagagtgggatacagcattaaagggaggtagggacacagttaaaggatttatttgcccttttctctcattttctgttcctcattttgtcatttacttcagaggacatcaaaaagtactattttaagaccaatctgaatttctggaacataaccatctgatatgcttatttcaacacatgaacatgaacagatgtttactttataatgttaaatgtgccagctgttctcatgtcagaataagcatctaggcattttgtttaaaagtgaaacaaagattttaaacctctgttcataaacctccatatgaattcagctttccttccttccttcctccctccctccctccctgtctccctccctcccttctttcctccctttcttcctttagccctttcttcctcctctccttctttccttccttccttctccctctctttcttcttccttccttcctcctccctttctttcttcttccttcctgccttcctgtctgccttccttccttattttgaaagaatcattggtttttagaacaatatttgctatttctggatgtatcatagcatgaatatcatatatattttattggctaatatcttcatgtcatatattacaggtctatacttgctcagcttgcatatcttctactttttaacctctgatccaatagtgatactttaacaatgaagaaagtacgagtatcataaaagaagtagcataaaaatctaggcaaagttttttatgttcaaacacctagatgctgcctagctttgtaattaattaagtcaacccttagcacatcgcacttaactacctggtcaccttgtgcgatggctagtttgaatataccataggcatttggtatattcaaaccatttggcttcttccctctaactactgatcttcccaggcaaagggaggctttaagacatcattctgcccaggtctcatctcttctacctgcattgcagctgctgagccccaaagacgataatcatagaaggtcaatgcctgatgacatcagagaagtcagtgaatgaagatcataatcatagaaggtcaatgcctgatgacatcagccaagtcagtgaatgacacactcttatcattgagcacaggactaaatggggtttaaagaaagtgtcctagatttagatatgagtttttaaatttccatccacagatgtaagaggctggctacattccttttggcaaacatccatgaattttggtagctgtcaccattcgaacagcattgcctattaggctttttattttttcctgttgtggcacaaaaacacagaaggtcaaggatttcccacattaaattgctttagttctgtattctttatgaagataacataccggatttaaatctgtactccaaagattgcactgggagtggggcgacctaacccacaaagatagaactggtggcctcagcttagacttttctctattgttgcaagcacaggtgctccccagggggcccgcagaggggctttgccatctggacaagtagatcagccttgaaaaaatcattaacacctaagtgaagtgttcttttttttctttcttctgattttttaaaagagattaaacaaacataataaaagagtgtttggacataaggtgtgaaactcgttatatcactattccaggaacatgccaggaactatatctgtttacttattcctgtccattggaaggaaaaatagaatagtatgcagtccttaaatatgtttatgcagaatgtgttatatcatagggaagtgattttaaaatatcattaattgatgagacagagtacttcttatatgtttaatgttatatcaactctttaaaaatgtttgcctatgtataaaaagaaaaaataattctggaggaaaaatgccagaatgtttacagctatttcctggttacagtggtctttgcaggagcctgtaaatcctgacatcatccggctgccagtctccctacccccaacttctaccacctcacctccccctacaccccagttaaaccatgtgctttctattccccatctctcagcttagcatctttgtgccagctgatgccactgcctttccctgtattcaactgcttagttaattcccttaccccttcaagtttgactaaaataccactttttctaggaggcctgtgctcatggagacactcctatgtagtcttgctgctgcctattcctttccccatgcccaatctccctcagtgtctcctatttttgctttttttcttagtactttccacttaattgtgtactttataatcatattatgcaacatatatatagttaaatgtatacatatagttatgtattacacacacactttttttaatagagtgtagcgtatgtacaagcacatgtgtctgtgtaactctcctttccataatgtaaattccatgagggcaaattacatttgctgtatttaaatccaatgcttggccaggtgaggtggctcacacctgtaatcccagcactttgggaggccgaggcagggggatcacctgaggtcaggagttcgagaccagcctggccaacctgatgagacctcgtctctactaaaaataaaataattaggcgggtgtggtggcatgtgcctgtaatcccagctactagggagactgaggcaggagaattgcttgaacccgggaggcggaggttgcagtgaaccaagattataccactgcactacagcctgagtgacagagagagactccatctcaaaaaaataaaaataataaataaataaacaaatccaatgcttacaatagtatcttgcatatagtaggcactttaaataaatgttgaattaatgggggttgacattatggatgatttataataagaagaacataatacaattccataaaacaaatgattttttaatagcaaagagagtatgaatagcataaaaatgagtagcgtaaaaatctgagcaaagtattttagcaccataggaaaagtaaaaaaaaaaaaaaatctgaataaagttttaagatgttcaaatacctagacactgaatggtcttgaaattaataaagcaaactgttaaatttcaggttaacccttggttcatcatgctttaccacctggtcaccttgtgtgatgtttagtttgaaaataactgtggacatccactgtttctccttcactctaggcctctgatcatcacaggcaaagggaaaacctaacagctcattctgcccaggtctcatctctcctacctgaattgctgttgttgggtccagaagaaactaatgaatctatgcagatttgaccttggcactagagaattatgaagtagcagctctgattctaggttactgctccacaccatctccagcaaagggacttacccaaaagacgagtgttccctttccaaatgttagaaataattagttttgtaaggcttggggtcaatgtccattggtttgaaaagaaaaaaaaagacagaatttaaagatttctgcagtgtcaactcttttgtgtcttgcagccacagctaaagcatgatgcaaaatattaattcagggaaattttattttggaaaattttacattgatgtgaatttctgataatatgtgtattttctcccaaaacatttcttattagttcattgcttatttgtcatgatttctgtgtccctcagtgtatcctgaggctgggcatggtggctcgtgcctctaatcccagaactttgggaggccgaggcaggtgaatcacttgaggtcaggagttcaagaccagcttggccaaagtggtgaaaccccatctctataaaatatacaaaaattagcggctcatggtggtacatgcctgtagtcccagctactcaggaggctgaggcaggagaatgacttgaacctgggaggtggaggttgcagtgagctgagattataccactacattccaccctgagtgacagagtgagactctgtttcaagaagaagaagaagaagaagaagaagaagaagaagaagaagaagaagaaggaggaggaggaggaggaggaggaggaggaagaggaggagggggaggaaggaggaggaggagaaggagaaggggaaagggaagaagaagaggaagaggaagaagaaggaggaggaggaggagaagaagaagaagaagaagaagaaggaggaggaggaggaggaggaggagaagaggaagagtaagaaggagaaggagaagaggaagaagaaggaggaggaggagaagaagaagaagaagaagaaggaggaggaggaggaggaggagaggaagaggaagaagaagaagaggaagaagaagaagaggaagaagaagaggaagaagaagaaagaagaagaagaagaggaagaagaagaagaagaagaagaagaagaagaagaagaagaagaagaagaagaagaagaagaagaataaacaacttgggatcattcactgacactgaggagagggcgagagtccctgctcagaggtaatgcccagggtcacctggaggtctggcaagagagaaaagatgaggcatggactttgattccttcaaaaatttccattagaacttgaaattgagttttttgtttgtttatttgtgcaactggcattttcccaagtaagtgggaataaaaatacctctagaaagtgtggtacattttttgaactacatcacattatttcattatctaaataaatccagagtgcaataaatgttaataaagttttaaggaaaaaaaatccttcacatactccacccatcgcatcattgtcatgtcttagccatttaagagatcaatatcccaaacaaaataatcacattcctcgatggccagaaattgctagattaggagggatttgaaggtgggagcctgaattctaagtccagttctgcagtggctcaacccatgacatctaacaaacctaacacctctctacctcactttctatttctgtaaaatgggcatctcttcctttatttttctggattcaaaaagaattggttgttaaaggaaaatttttgtcatcagcctcaagtatcgtaaatttcctttcagtgcaagctgaattacatacaattattattccaatttggacatcttacagtaaaagtgacgacaaataacttcatatatacaagcaatgcttccaggataaaacttttaaaaaaaatcactatcaatgatgtaacagaaactgctgaagtgaatacagggaattaatatgtcaagtaactagttggacctacatgatggtgttttgttcactgttgctttctaaatcatttgagtatttacaactaggcttatgatgttctttgagttttaattaataggctaaaaactcaagtgaactttttttcacatttattactgcataaaccagactttaactcaaatagtcaaaatggagaggctttactgatgaactgcttacgaaggtgtcagtaggaatggaggtatccacaggcaaaatgaaggcacctggatgctagcaaaagtgggaagtcatcactaagcctggtactgaggaggaaatagagctggagcagtggaagagaagtgcccagtggaagctagagtcaatgaaggagctcaatcattggtagttctcaaaagcagagaggaatccagaaggaaatgtcatgatctcgctgtcatctccatttcctgctggtgcttctattggcgggcggacatgggaacctggcagtgcaatctgcagggacaaagaagccaaacaaaggcggaaaatgtatctcgggattggaggtacaaggaaaacactgagcacagagggatggaaattacaatgccgtttagtgttgtgacagacattggcatttatgtgtctttgctggagctgcagttctggaattccagagtaaggatgctacaaagagtttccttgctactacctttatcctaagaatgagtctgactatgtttttggtggcggtggattcccccatcatcacttagtggtcattaattgtgggcactaattgctgagttctctaagccagaattgctcagcagttgataactgtggtgaatcagcaattgtttatgtccatgctatctttggtgaaatcttacctgactacagagaagcttgagaaatgtgttttttctcctctgcaacctgggcagagggcccagcttacagcacccttctgtgaacactaaatcacagtgcaaactcactcaccgtgcgctgtgcttcattccacagaatatggagcagagcctctctgggcaaaactgtgcagtgggcagtatctagcaccatttgtattccatattttttcctgcctcgggcccataaaagtagcaagtttctttggacaatctctgctgcaatcagaactctcattcaaactgaaatgtgagataacagttgaagaggaactgcaagcttcctgggggagggagggtgtgtgtgtgtgtgcgtgtgtgtgtgtgtgtgtgtgtgtgtgctctttttaatagacttataaataaaaatgtctatgagggccaagcagtcacataaatgaagacattatttctacaaagacccatcttgtctaagcaataaatattaaggaaaactgccttcctgaaagatgttaaattacaaattttataaagttgaaaaaatgagtcttacataaatatagaatgaatacaagtagaaaatttgtataaccaattgaagagggaaccattaatgagttatataagtaaagttggttcaaatgggaagtaaagttggttcaaagaatgcttgaggaacagagatttgtgtagtcagtcaggacagcaatctgctcagagacaaaatagttaatatcttataagactatgaatcataatttttggagttaaaattatttttatccccactggacaaaatctacaagttaatacgtggtcctaatcaatagtaaagtgcacatcaaacaaagataaatcctctaaagggataattaatccaccagataattaaataatcttctagaaaattaaattaaatattgaatagatctgttcaacaatgcttcatatgacattgaaagggtatcagtcattcctttgtcctattcccaatcttcagctaacttttcttaagaaaataatatagtagcttctatttttctcagagtacaccatggttttcttaggtttctcaatgttgatagatttaaatgtaaaaaagtaattactttaaaaaatttcctacaaaattacaaaaaaagtggtcccgggtcttactttttgccatctgtagtgactgagtagatggtcatcgaagctggaattcagagtttgacaatgttgtgtttatgccgagatgatggtgagcagtgaagagaaaacccaagggaccccttacaggagcagctggttagtgggaatgtgggacccagtgttgccaagacttctgactttctagaaagccccaagaaactctttataataaatctcttgatttttaaatattgacaaattaattcagaagattaaaagcactgtatgggcaacaatttcaggctacctctggtcagagagtttccatcttgcaaatttcttcataagcaaaataaaacaagctttggtagggaaattctagtttctcagatgcttttgtacgcaacctgtaatagaaaaccaatagattttctctatataaatttggatcctagagcctagaatgtttaagtcttctcagttcaacaagagaacctatcatccattgtcggtgaacccatcagtcaatccaccactccatccagcaaatgtctgcagagtgtagacaatacaccatgtgtggtgctgaagatatggcaatttgcttccatctttcctggacattttgcagccaaatttcccagtctccagcttttgatcccaggctgactccttaattcactgcagactgactcctcccttcaaaacttttctgaaattactgttttcagagcaatccaggatcacttcattgtttaattcagcaaacatgtcttaatcgttatccagcctgacttttctgtgacagtgaaatctgttctgattttcctgaaaacctctctttgggtgttctggaaagttttccactgcttctctccttgccattactgtgcattcatgttgtagtagattcttctttcttcacttcttgattttttgaatttatcatcccttcattttacaatctttctcctataagctgggcacggtggctcacgcctgtaatccccgcactttgggaggcagaggcgggtggattacgaggtcaggagttgaagaccagcctggccaacatggtgaaaccccatctctactcaaaatacacaaattagccaggtgtggtggcacgcacctgtaatcccagctattcgggaggctgagacaggagaacagcttgaacctgggaggcggaggttgtggtgaacagagttcacaccactgcactccaggctgggcgatagagtgagatcccatctcaaaaataaaaaataataataataaaattaaaaaaatatatatttctcctataaaactcatcagagggaatggcacccacacacactgttccatctctccatgcccccaacatccaactagtcactgactcctttatatgctacttccataatagacttcaaatgatttccttctccctgtctctatctgctttagttcaggctcttcttattttgtactaaatgtaacagtgaagatgctttcgaccataagtaacagcaaacaggcaacatggcttaagcgatatggatatttattaacaaaaataatttgtatttgaggctgaagcaggtggatcatgaggtcaggagattgaggccatcttggctaacacggtgaaaccccgtctctactaaaaacaaacaaacaaacaaacaaaaaattagccaggcagggtggcacgtgcctgtagtcccagctacttgggaggctgagacaggagaatcccttgaaccagggaggtggaggttgcagtgagccaagatagtgtcactgcgctccagcatggacagcagagcaatactctgtctcaaaaaaaacaataacaataatttatatttggacagttctagtattgtttaattcagcacctcatcacagataagtaatttctattttttactattttccttaagcctgaccctagacacgtgcagaagatccagcatctcaacagaaagaattacatccattagcagaaggaagccttctttacaactcactttaagttcttggcctgatatccttttatgtcttattggccaggagtgtgtgatatgtctgtctaaaacaatcactgcaagagaaatttaagcacgttcattaatttagaccagttatgatttacttttcttctgggacttacctcccttcagactcatgttgggtggatacatgaatcaattagtagcagtagtgtaatcataataataactacaaataaggctaaatctgagcaggccagatgctgttctaagcatttacttgtattgcctcatttaatcctcacaacaaccatatttgctagacagcataattattctcattttacagcaatgaaaatgaaaggttagaatggttcaggattttgacaaaggtaacacagctgccaggactcatatccaagctgcctgatttggagctctgctcttgcccactgatgttctacctaacatgggttttattagcatgacagaagtatgtggagaaggagctgctgctggtgtgtcagacaattcaggctgctacaataaaatatcatagattggatggcttaaaaataacggaaattaatttctcacagttttagaggctgggaagtccaagatcaagttgtcagaaggttcaatgtacagtgagggctctctttctggttcactaacagtgccttcttgctgcgtcctcacatggtggaagaggccagagcactctcagccttttttttttttctttttaagagacagggtcttgctctgtcacccaggctggagtgcaataatgcaattgtagctcactgaagcctcgaattcctgactcaaaggatcttcctgcctcagcctcccaaagctctgggattaaaggtgtgagctgttgagtctgtccttcaggcctcttttataaagggcactgatcccattatgaagcctctgttctcaggacctaatcacctcccaaagggaaacctcctaataccatcatcttggaggtaaggatttcaacatatgaatttagagaagtggaggtcacacacatttagaccacagcatttggctaccaagcatctgctgaatttctactactatgggactgtaacaatgtcttcctttcttccttccttccttccttcctccctccctccctctctcttttcctccttccttccttcctccctcccttcctttctttctctgtttctttctttctttctttctttctctttctttctttctttctttctttctttctttctttctttctttctttctttctttcttctttctctttctttcctttctttctttctttctttctttctttctttctttctttctttctttctttctttctttcttctccctctttttttgagatagagtcttgctctgtcacccaggctacagtgcagtgatgccatctcggctcactgaaacctccacctctccggttcaagtgattctcctgcctcagcctccctagtagttgggattacaagtgcatcaccaggcttttctaatttttgtatttttagtagagacagggtttcactatgtcggctagggtggtcttgaactcctgacctcaagtgatccacccgcattggtttcctaaagtgctgggattacaggcgtgagccaccacgctgggccataacgtgtttcttatttccatccttgctccttttctcacctccctctcaaaccagcttccatactgctaccagaaggtccattccaaaacagaaacctgatcttctcttgtgctaatcgcccaatgcctcacagttacctttaggagcaatcccaacttctttatcaaggagcatgaggctcatcaacacctgactccccatctctcctccctagttcagcaaacatctttccttgttctctgtacttcaacgttgcctaatgaattacagcctccagataataccatattcccccatactctcttgactttgcacatgtggttattattattatttggccaagaatgtctttaggctctttttttccccccaaacatagtatgacatttcctctaggttttcttcactgacatcattctgagtttgctgagcttcatttttgctcccatggtgttccatgcattatgaaatacttgtttgccttctcaagagtcgcttgagtgtaagggccttgtaagctgcttgagaacagtcattgtgatttttttcacctctatctgctcaatgaatcttggtataaacactgaaaaaatacgcagaatgaccctcaaggagctcagaaattagtgatgtaaaacaaatatttgaaattaggtatttgtagttcagaaaatgttataatagataattggctcaaagagagaccctcatcacagctaaatacaacctcttaatttatgatgagttttatttgctatgaaaactagcccttcagttttgagtattgtagtggtttttaggtgaggttccatgtgtctcatagtgttacttcaaaggcaaaggcattaccttcaagttgttatccattatccaccattccctaatatttatggaaagcctttgtctgttcagagtaagcccagagtagctcctagttagggaattctaaatgcaacactgctagtgagttcaataaatatatattttataataatacataacacgtgaattatatattgtactttatactatatattgtataataatatttatggatatatttatatggagctacctacatattaaatatataatctatattttactggggccacatacatatacattttttacttgctaaacacaactaggaatccagagtccagagataatctggaaaaacctctggtctatcaagacagatttgcaaagtcatgtttttgacttgtagaaaatactctattgatcttttcagcagaactccagcaattttgttaattacctctaagacaaattagaaagtacaatttcacataagggatgagggaagacaggactaccatgaataagaaaacaagacagtaggacattgcaataagaggcaaaagtaatgctattgcttggatcccagtaatgcggagtgtgtttaatccttggttagttacacaaggcagctgaactgagtgggcatttcactgaagagaatgccatctgggcaccaagccttctgcttcaactattcaagcacttactatgtgtcaagcattgggctaaccattgaggatatagaaataagtaagatattagacatggctttcctgacatttagatcttgttacttagaaaacccatttgacggcttagagtcaaaatagcaacatcttgaacaccatatatttatgcctctcacatgatgtttttgggttattttggttcagactcctcactcattgctctctgtcatccccccaaagctaaatttattatgatcctgaatgtcttaccaccatgttcccactgaggctggaataccaaagaaaaaaggagggtggaatttttatttttttctttatactttaagttctagggtacatgtgcacaatgtgcaggtttgttacatatgtatacatgtgccatgttggtatgctgcacccattaactcgtcatttaagaagggtggtatttttctttaaggaacatgtatcatttccatttatataccattgatgagaacttagtcacacggctttaacttgctacaaagaagccttggaaatgcaatcttcatctgggtgacaatactctcccgaaaatgccgttgctatagaaagaaggagattggatatgggggaacagctactagtctgccacctcgtctaatagaagatggatgcttgaataaataagcagacaaataaaatgactaccaagtccccttctcaaaatagagattttataagcttaattcttctcaaggtgaccctcccattgaaatataccaaaaagcgagtgtacaactcctctaaaactaattctactgaggtatatgtttacataagtcagaatacaggtgaagcttcaagcccaggtgcaccttgattaagttacttttttatttcttaactttttaaagcctggattgcatttttttccaaatggacaattatcttaaaattatttttatatttttgccaagccccctacaaggccactatcaatatgaaaaaatgattcgtgcaaagtaaaacaaaaagttgaaataactccaaatatttaaataaacactggcacatacaatttttctcatggtaataaccctaaatgtgtggcaccatcatccatttaaggaagctgaggactgtttaaaaattgccatcaacatatatcgttatccttatttttctcaaaatgcatgatgaaaaatccacatgtactatttggaagatttatttatagaacacctgcttctgtgaaactgctggataaataaagcatagcagtagtaatagtacaagctataacttatataatactttttatataattatattaaaaattctaaatatctttaatagaatattatcaatgtttattgtttttaaacattttgcattacactgtaaacaatataagggcattgaaaaactttatatttctctatactccttccatacttaacaacaaccaaacacctaccatgagtaaagattcatgcttgatatcgaggatgcctaagagaatagaagacaaaaacacatatttttagaataggcaactgctagatgaagagtaaatagaaattgattaggtgatagatttttctggcatggtacctgcttaggatgagagaaaataaaattaggctgttgttccctttgcagtttccaacaacctgtggaaatacccatctcttgggaaatcatcctgccataacatcgggctggtctggcaaaacttctgtggtattcaatgcaagtgattctttgcctaatttcttcccattactcataatttccctctgcctaaatatcccgggtgcttatcctcttgaatatcattcttaatctctggatgatcatcccccgcactttattttcatttggccatgctcccactatataattattttaatcaggagcaccatcttttttaactgtgatagcaaatgatgccatttccagagtagggtggaaaattaaaattgttagaattgaatttgatttgctttgtgatggtgattcagaggtgacggaggagcaggggagtgtaggctgtgttgggccatgatgaagatcagaggctgcgtgctgccagattggcatcctttccaccctatgaacggttttcatttcagaatggaattgtggaatttgtatcagtttaatgttcagggaatacttgagaattgaatgttgcactttagtgcatataaccatagcactttagtgcatataaccatagcacctgcctagaggcattcaataaatattggtttaaatagattgaaacacagacaattttaaaagcattgacttgacatcagtgttcccccaaaccctggtgtgcctacaagtcatttgaagagtttgctgaaatgttgatttctaagccctatttctagaaactccgatttagtccatgtgacataaggacctggaatccacaatttaaagaattgaacgatgcatcacacatgattctgttgctgctggtatgtggatgtcaactaggcagaatattgggaaatctgacataaatggtgtaagctatattggcctgaacgatgtttgaaagttaagggaattgaggatggaatttttatggattgctctaccttcaatagaggtagtctattcatttctcattaaattcatatttgtttaactgacagatacaaacacaaatatattaataaaatgttcaaaggagtcaataaagatgaacttttccacaataaaaactagatacctattatgggcaaggacacctgaagtccaaattgcttgctcactcctgaaaacaatattaaggttttattgtaagtttattcatgtctatgttacattaattacaagatgctattatactctacccacaccagttcttacatttctttctagaaaataaatgagaagactaacaaatgtaaagaggatgactgtttgattgattttgcctacatgtccaactttctactccattcttaccaaatgagatgtgggacataaaagctttgaattataaaaaatataaaaatacaaagataaagtattattattcattaattacctcctctttgcttaagaaagctgttctatctgggtagagggcaatgaagaaagataaaggttcctatttctgtttcattagtccacttttccacctcgtaaacagtgtaaaaactcaatccaacaaactccatttttcagtaaagcctatcatcagttaatgtccctgacctttatttttcctatttctcttctgtggcattttgtaagtgtttcgtgttgtgtcaggttataaaccatggaaggaaaaaatggaagagcccaaactgcccatttattggaaaacaatcaaataaacccactattgcctttaaatatgctactgctgttgctgcaacagtgttggtgattatgtatgtggaactgtttctcttaggtgtgatgggttttaaaatcctgtctctttagtgaccagatacttagtgaccactggccacattaagaatgggaagtaaggccgggccaaagcgagcagatcacgaggtcaggagatcaagatcatcctggccaatatgtcgaaaccccgtctctactaaaaaaacacaaaaaattagtcagatgtggtggcgcatgcctgtagtcccagctactcgggatgctgaggcaggggaatctcttgaacctgggaggcagtggttgcagtgagccgggattatgccactgcactccagcctgggcaacagagcaagactccatctaaaaaaaaaaaaaagaacgggaaataagaccagtgcctaagtgaatgccatagactcatttaaggtcaagccaagccagtgactttactaaatgcagaacactgagtgcctcttcaatggaagaggcagtgccttgtcatggatcaaagtataagtagtctgtcaaggccaggtttaaatttaacttattttccttatactttgtattaattgtgcaaccctcttgggtttcactctctccagctataaaatggcataataaaactctcttcatgggatattgaaaggactaaataaaagtgcatatctacatcacctcctacaacgaccagcaaataattcatgtttaagaaatgtttaattcctcattgtctcttgtagtatgcacacaaagatttttaattctgtggctgacatactgtttggaaaatgaatgaaatcaaagttcccgtctctggctgcttacaatctaaaaataaataaaaggcacacaaataaagaacagctgaaccgagtagtaagtttatcacaggatcgggaaggaagagattattcattctgagatctggtgtataaaaaaaggggttttaaaatgatgcctacttttaattttctttctgattttcaacttcaccatataaatttgaaaacctccttgcacagagatttccactggctacgtaatagtttctcttgtggtcctgtgactattttatactttctctgttgaaggcacttaaactatatccccattttttttaactctcaataatactgtaattaatcttttttattatgaaatcttaagaaacatctttataagaggaattttaagacttttaataaggccaaatgcctctcgagaaactttgccttaacatttgtatcaagagtgtagcagagtgcatggctaatattttaatgtgatgtaatgagattggtctttgaagcaagggctcagtggtcctagtcttggtagtagatgatttattttgcctaaaacagatgatttccgtggggaaagccatggagaaagaaaaaagtgtggataatctggctaccaagattctctcagaattgaactaagaattagggacagccaagccagccagtatgaatgagacagaagcgagactctgagctccaggacagttttgaatgaccttttagcttaatattgccttggtccctccatcatcccagcatctgaattctcacggtgaccccacactgtgagaccattcccataaactgggcttcaattccttcatctataagaaagggttttgtatagcctgtatttttgctgttgactaattttattagttgttttcggtatgtaactgaagtatttgagctgccaaatattgtcattaaaactgttgaaaaatctagtggcttccccctttgactattttctgaaaacatgtgttccctttttcccagttgaagctgtagacacgtctggttgcttctctcacttcccattctgctctgatgagtttaaagtgtacaattgatttaaccagaaataacttagcagctgatcatatttccaaaaagaaccttctttgcatcccaagaaaaaaaaatgactcagaaaatcactttttaaatttgattttaaattttcaggtgactctactgcgttaaaagctattttagtagagttaggcatggagtgagaaaaggtagagccaggaatttcatttcctctgaatgagccttgctgagatcctgagaataaaaaccacaacactcagaaattaaaatgtcaactttgaatcaatttgctatagcaaagacagttgtacttttgaaaatttaaaatgacaaattgattattagtgtacctataaccctttagctatgaaatggagtgctacatttctttaaaggctgataattagtttatatttcattggatcagacggagaatataatttatggccccttaatttttttcttctttagtatactttaagatggtaaaattgttttctttactatgaacctaaataatgctggtccatgctctttggcacattcctctgcttctgtttccatctttcccgtacctcctgaagtgtggaaagggcaaatcccattaatcagacagaggaagatagtgtaaaccaacactcacctttgcctctgtccagctccctcactacactagatacagggcagatcttacagtactcagaactgaccagcagatttgcaccttgtttatttacaagaattaaatgcggctgggcactgaggcttatgcctgtaatccctacagtttgggaggccgaggcacgtggatcacttgagttcaggagtttgtaaccagcctgaccaacatggtgaaaccccatctctccaaaaatacaaaaactagccaggcgtggtggcactcacatgtaatcccagctacttgggaggctgaggcaggagaatcaattgcttgaacccggacggcggaggttgcagtgagccaagatcatgccactgcactccagcctgggtgacagagtgagactccatctcaaaataaataaataaataaataaataaatacataaataaatattaaaaaaacaaaaaagaaaaaaaattaaatatagggtgtcagaagcagacaaatagacatacaaaaatctcaggagacattaaggtcagcaggttctgaaaacaaaccagcaaatgtattaccctatttattttcacaaatactacttttccccttaataattaagggaaagtatggttttccttcaaagtgttggggattttaaaattcaaaattctgatatatcaggaggaatcctaaacagtactgatttagtttgctagggttgccataacaaaatgccacagattgagtggcttaaagaacaaaattttattctctcacaggtctccaggctagcagtgcacaagcaaggtgctggcagaaatgttttttttccaacacctgtcccctgagtgtgcagatgcctgccttcctgctgagccctcacacagcctttcttctctgcttgcacacccctagtttatcttctgaagatgaggccttataaggacaccagtctcattggatttgggccccacataaacagtcctgttttaccttcattttttaaaagaccttatatcttaatagagacacattctgaggtcttcagggttagacagcaacataagaatttgggaagaacacaattcagttcataacattctgctctttggacccctcaaattgctacacttcttacatgcaaaatacaatcactccatcccaacagctcaaaagtcttaacccatttcagcaccaactctaaggcccaaatctcattaaaatatcatttaaactaagtgtgagatccaaagtatgattcatcctgctgcagaatttttctccagctgtaaacctgggggagcagacaagctatctgcttccaaaatataatggcagacaatcaccagatagacattctcctgccaaaaaggagaaattgagaagaagatggtgtcataggtcccaagcaagaccaaatcctagtatggcaaattttattagattttaaggctccagactaattctttttggcttcatgctcatcctccaggcctgctggtaggtatggtggccttatattcaaggcccactgaagtggcagcattacctcctgagttcctgggtggtagccccatccataggagttgggtaatggcagctgggctgctgagattaagggggtagcctcaacctcagaaaatgaattggaggcagccttgacccctgagcctgtgtcctccaggacagtggccgcagtgacagcccttgcaatctttgagtcacctttgagtccttcttccctttccttgaatgaaaacatgtgcttgcagctagatagctctattttcccatcctgccacatcccagaagtctgacagtcttccttcctattgtcttctctctgtcaccttcagtcaaggatggcagtgtgtctcccatttctctctattcatagcttcctgggaggtggctgattagatccaggagccacatctataatctctttaccaaataattttccagccatacttactgtgttctctccagaacccactttctactttttggcaatatggacaggctgatacttttacaaatcatgaagttcttgtttctttttgcttgacagttgctttaatgtatctcttccaatgacatttttctataaacagtcaaaaaatctaggccatagctttgacagtttgtgtagaattttctttgctaaatattcaagttcatcacatacaatatgcactttccacaaaacactagaatacaattcagcctcttttttttacttttataacaaagatcatgttccttcaatttccagtaacatgctcctcatctctgtctgagacctcaaaaatcgcatttaacattcattgtattcctaccaaaagtctcttcaagacagtgtaagatctttctaacatgtatttcaaaacttgtctagcctttgcatattacccaattccaaagctgctccacatttttaggtatttgttacagctgcaccacacttccctgtatcaaatctggtttcctttgctaggactgccttaacaaaataccatagactgagtgacttgatcagcagtttattctctcacagttcttaaagttagaggtccaggatcaaggtgtcagcagggttggttttactctgaggcttcaattttgacttgcagatggccaccttcttgatatgtccccacagagtgcttcttctgtgtgttcccatgcccagttcatcttccattcttacaaggacacgagccaaattggatttgaacccgcccaaacagcgtcattttagcttaatcacctcttttaagatcttatctttaggccgggtgcagtgtctcatgcctgtaatcccagcactttgggaggctgaggtgggtggatcacaagggcaggagattgaggccatcctggcaaaacatggtgaaatcccatctctgttaaaaatataaaaattagctgagtgtgatggcacgtgcctgtaatcccagctactcgggaggctgagccatgagaatcccttgaacctgggaggtggaggttgcagtgagctgagattgcaccactgccctccagcctggtgacagagggagactccatctcaaataataataataataataataataataataatgatgatacagatcttatctctaattcagaggcattctgaggtgctgcatgttggcacttcaacattttttttgttgttttgttgttttgtttaaccatgtggttgattataaagaatactgcaaaggatacagattaagagatgtgtagggtgaagtacaggtgaaggaccatggaggttccacaccctcgccaggggcatcaccctccaggaacctccacgtattcaggtgtctggaaactggcacttcaacataattgtggtggcaaggcgcacaagtcagcccatagaagataccaagttaaagataaatatacatgtgatcaattaattcaccaatattttctgatagcctatgctcaaatcaccataatagtaatgtgtgtggagatctaaaagtctgaagacacagttgagtccagctttctccctctctccctggccctgcttgaatacattggatggacagctgcatccttatctcttctgtaaagcatttgaccataattccaagcagcatcccacatcacatgcccttaatgtgctctctatcaagaactcacccaaagcccagctcaaaaaagtagtattagtgggagggagggtcatgggaagacaatgctactcatctgttctgaattttagtctttacattaagccagcaattcgaaggcaactcctttactgtggtacattaatccctcagcttcaatccctcagcttttttcaagggaaattcccttagctttttttttttttttttttttaaaggagattccactatatgaatttctctaagaaattcttccccatgaaattcaacgtactgactttttggagggtagtctattgaggacattttccggcaaactgctctgtgttcttctgtacagggtctcacatacacataaatttattttccaactcaatgtttaaaaaatcatttacttctcactgatttgtaaaatctatttctgtgtgtaagaaatgtgtgatgatgatttttttcttttattgccaaaattgaattaaaaatatttccataattttattttttgtttttactaggacagtcttcatttatactttataacagatgcagggattgttatttttttccagctttattgaagaataattgacaaaaattgtatatatatggtatacatgatgttttgatacagttatacattatgagatgattaccacaatgaagttaactaacatatccatgacctcacatagtttccctccctttactccccttccccttccccttcctcttccccttccccttcctccttcccccttcctttcctctcctctcctctcctttcctcttctctcctcttgtttccttcctctctctctcactctttctttttctgtgtgtggtgagaacacttaagatttactcttttggcacatttaaagtatgcagtacagtagtatcaactatagttatcatgccacatattaggtctccagaccttattctgcataactgaaactttgtactcttcgaacgacatgtctctactttccctactccccagcccctggaaactaccattctactctctgcttctgtgaattcaaatttttaggttcctcatgtaagtgagatcataaggtatttgtctttctgtgtttggcttttttcactagcataatgtcctccagattcattcatgtcattggaaatggcaagaattactttttaaaagctgaataacatttcattatgtattgtgtatgtgtgtgggtgcatggtatatatgcgtgtgtgtatatatatatgatatatgatatatatgtatgtgtatatatatgatagttccatttaaattattttgtggaacctccatactgttttctgtaatgacaataccaatttacattcccaccaagagtgtacaagtgttccattttctccatgtcttcaccaatgcttgttaaattttcccttttaattacagccattcagacaggtctgaggtgatagctcatgtagttatggtttgcatttttctgattattagtgatatggtttggctctgtgtccccacccaaattgcatctcaagttgtaatccccgtgtgtcaagagaaggacctggtaagaggtgattggatcatggagggagtttcccctatgctgttgtcaagatagtgagttagttctcacaatatctaatggtttaaaagtgtttggcagttccccccttttgttttctctcccctgtcaccatgtaagatgtgccttgcttcccatttgctttcccctaagattgttagtttcctaagttctccccagccatgaggaactgtgagtcaattaaatctttctttataaattatccagtctcaagtagttttcttatagcagtgtgaaaacagactaatacaattagtgattttgaatagcttttcatatacttgttagccatttgtacgtcttcttcaaaaaaaagtctattcatttcttttaaaatattatttatttatttattgctattgagttgtttcagtttcttatggattttgatgattaaccccttatcagatgtatagtttgcaaacatttcctcccctgtattccataggatattttttcactctcgattgttgattttttttaatttaagcatatttttattttgatacagtccctctggtttatttttacttttgttgtctgtgcttttggggtcatgctaaaaaaatgttgttcagactaacatcatgaagattttatccagtgttttcttctgttatttttacaggtacaggtcttttgtttaaatttttaatcaatttttagttgatttttacatattgcatgagataagggtccagttttatttttctgcatgtggatacacagttttctcaaacatctttattgaaaagactgacctttcaccatgttttgtcctttgtactcttgccaaaggtagttgactctaagtgcctggattcattttgaggttatttattctgtcctgttggcctatatgtctgcttttatgatagtaccatattattatgactactgtagctttatatttgaaataaggaagtgtgatgtctccagttttattcttgttgaggattgatttgactattcagggtcttttgtggttccttataaattgtagaatcattttttccttttttgtgtgaaaaataccattaaaattatgataatgattgcattgaactttgggtagtatggtcattttagcaatattaactcattgaatccatgaaatggcctatttctctatttatttgtgtctttcaccatttcgtttatcaatgttttatagtattcagtgtacaggtcttacgcttccatggttacatttatttctaagtaaattcattcatttttgttgctattgtaatgagattgtcttatttatttttcagacaattcattgttcgtatatagaagcactactaaattgtaaatgttgatttcattttctgcaactttaccgaattcatctattctaacagtttttggcatcatctttagggttttctatgtataagattatgtcatctgcagagacaattttacttattttttccattttggatgtttttatttctttctttattttatataattgctctggccaggactttaagtactatgttgaatagaagtggtcagaatgggcatcctttccttgttcctaatcttagaggaaaatctttcaactttaaagattgagtatgacgttagctgtaggttagtcatatatgacctttattgtattgaggtacattccttctacttaatttgtggagagtctttatcatgaagcaatgttgaattttgcaaatatttttttctgcatatatttagatgataaaaaggttttcattcttattctgctaatgtggtgtatcacatttattgatttgtatatgttgaacaatccttttatctcacttgatcatggtgtgtaattctcttgatgtgcttttgaatttcatttactagtattctatcgaggattcttttacatctgtgttcatcagcgatgttggctgcaattttctttgcccttgtctggctttgatattagggcaatgctggccttttaaaatgagttaagaaatgctccttgctcttcaatttacggaagtaagagtttgagaaggattgacactagttctttaaatattgcttagaattcaccagtgaagccacatgatgctaggcttttctttattgggtggtttttgattactgatgcaatattcatactcattattgatctgttcagatttattgatcatgttctcattgaaaaccccctgaaatcaaagaaatgaacagacacaagtaatgttgttctttatttcaatgaatgtaaaatatctttaaatattttaatacatatgcattattttaatgtaatacatatacattattttcaaaaaagcctgaagtaatagttattcatagctgatttgatcaaaaatgcttcatgggagaggtaatatttgtaataaatatggaatgaggcatggaaaaattggcttaaaacctttaataaaattctgaggattttttgcctttttctgaatgacactattctaaaatctggcaactccacaaataagatttgaatgagtcttcataatccaatttgtaaactaaactcaattctaatttataatcaaatatataagctagactattttctattatctgatgtgaatttccaaatgtgaatttccaaatatgcttaaagtcttataaaggccctctcactttgttggctggtatgcagagagagacagtattttaggctctcaggatgtaatcaacaagggcctttcatggaattataatccaagaactactggaccttaccaggccttttagtatcccacctgagaagtcatgtaatgtcacatcaatcctgatctactggctgcaggagtcagcccactcagattcaagaggagacacaaaccttatctcccaatgagaggaatatcagagaatttcaggacctcctttgaaatgattccatgtatatgcatttcttagttgagaactctaatcttcaaatatttttattaatgtaatacaatgaaatacttgtaataatgtctaatttttgcaaaaaagtagttattgttcataagaaaatattaatagaataataatgaattttttattattgttttctttgttaggcatcattctttatccttgtcatatgttcaataaacaattctgagcaatttttctgactaggtaaaaagcattaatttcagatgcaatgaattataagaagtttatatgtgtaaatacagtcaaacgctaattttgttttacatttttgatatctctgaaattgaaatgaatcttagaatcaatggggtaagattgttgaactggcagcagttttccttcttagcaatacaaaaataatggtacgaccaattatcaatgatgacctattttatcatctttgatgaaatatgatagttgttactcaaagttctggagtaaccagatactcaagataaaataaccacaccctctattttgagatattttctctataaccagaaatgagtcctaaatcttagatactgcttgaattacactatccaaaaaacctgttcacattcatttttttataatgtgcttatttttctaatttgattctagacttctaagagagcagccaacaatgcattaactatttctgtcagctgaaaggccctttaattgacttgttcgtattgactgagatcctagaaggcagcctctgttaatggtgtatcctgatgagagacaaggaataggtttgctagcatcagacttgagtgctaatgtagtatatcatgttatttccaatcacttagctttttctcgtgatagcaacaaaatgacttcttgaaaaatgaagacttgcaccatgttatctgaaaaaatgcatagctgtctttgaccaatatagctacaagtttttcaataaaaatcctgtcttaaatcttaggtaaaaaatgtgtctttagggaaactgtattgcagttattattaagagtgtttgtatcagtacatcttttaatgagaatggtgtttcgtgtagtatacaggtgtgcgcgtgtgtgtgtggacatgtgtacagatatatatatatatatatctgcaaacagatatgtatttattcattcaattattatttaaagaattactgaacttataaaatatgctggcatgtaatgactaccaatcatccctgcccttaagtagattacagtcaacctctcataaattcaattcttcttctctaccttttatgatgtggaaacatagcaactagtatgttgtaagtcttgtgtaaacactagccaatgttttcagtatttttatttagaaaataactttattttgatttcatctgttttttgttttgattttatctagttttataagacacaaagtatatttttaaatggtacatttttgcccagaaaccaaaattgccaatttcatatattttatgattgtagaatatctttcagaataattaaatgacctttgtggggtattatggaatagaaaatcctcaaaggcaagaaatccatagccttattttattttttgttatataccctgtaaataatcataaacaggagagtggttaatattcttcagatatggggctgtgaaataggagatacaggcatgaaatcctatttttattactatcgttatgctgatgatcctctggccacttctttctagtctgtgtaattgcaaagttcttcatattttattcattagaagagctgctctgtgcccattcttcttatgttgctgcctcgtgccgtttccagcacttcctaatgggtgtgatcgctgggctccatcaactttctgtctatgccttgctcagacctctaatgaatattagacttgcagccatcagtcatgtttcaagtgcagacatacatgaatagagaatttttgtttgttcattagcattgtgaaaagcaaactcattttgtctccttcctgttctctttgatgtatttgcccacctactataatgaatttgaagggaaacttgatgcatgtaggtatttatttaaaaggttcttgctggctcttttctcaccttttttcacttcttttttttttcttttaccgtaagcagataatgcttattaaccatcaacaataaaatactgtagataggattgtgataaattcttgtcgaatcgattgtgctaaggcgtttaaaaaggttgcctttcaggaggggatcaaaggaaggaatatggggagatcagagggaacaagaaaggtaaaaataatttggggagaggaggaggagaaagggagcaagaaagaaagaaaggaaggagggagagagagacaaatgcagagacagagagaaaaaggagaaccaggaaagaaagaaaaaagaaataagaaagagcaaagggcaatcttgggtaagaaaaatcatataggtgtttatgtgtaagaatgtgtgtatgggtgtgcatgtatttgtgtgtgtatgtgtatatgagtgtgtgtttctgggtgtatgagtgtgagtgtgtttatgagtgtatgtgtgagtgtgcatgtatgagggtgtatatgagtgtaagtgtgtgtatgagtgtgagtgtatgtgtgtgtgtgtacatgtgtgttgaaaggaatgcaatacttaattgggtaagacaattcaagagtttattatataaacacagcataccctccttccatttaggtctctttgttcatcatttgggtgaaaatttattcttttactcggagcaagtttagtttttcatcttagtatattttacttagacaaagaaatttttaaaaatgtattacaatgcaaaatagcagcttgtcagggatcagtgttatagcttttttgagtgcactgctggaaatctgattcttttttgttttataatgagtgagctcaagataaaatgttgatagagactagataattttgaagagaaaatacataattgagtctcagttgctcaacttattttattccatacttcttgtttcttttcagcaaccaggttctcttagaaaattttaatggatcaataaaattctgtcatattcctatggtatgaatatttttattcctccaaaattcatacattgaaacgtaatcaccagtgtgatggcataagaaggtggagcctttggtgagggatcagaccatgaggataaagttctcacgcataggattaatgcccttagaaaacaggcccaagggagaccctaagcccttctacctcgcaaggacacatcaacaaggcagtttccctgatccagaaagtgagctcccggtagacatgggaattgccttcattttggacttcccagcatccagaattgtaagacatcaatttctgttgtttataagctatccagtttatggaattttgttatagccggccaaatagaccaaaatgcataccaaatttatttttcataagaaaaatgcactgaatttcacattttcaactaaagagtacttatttcaaactttaatttatagtaaatgtgtattaattagttgatgaagctatagaaaataccgagttccttacataagagttctcaccctttgtgacatgttttcaaacacaaaaattccataaaatatgccatcaccatgagggatttccactttgattaaaagactcagaatataaacaacagtggattagttgttgtcttgataaatgaaacagtgacttggaggtgggtctattcacatgaataattgcaatggcattttgattagcaatgcaacatttactccctgttcactttatttaacacaaaattattgatttattgaacaccttatttaagaaaagattaggagcttttgggggaaatgttaatacctccatgtgtatattctaaacacacacacacacacatagcacagtaggtaataaatattcttcaaactttgtaaagaagtatctggaaaatggaatattatacatataattagtcttgatattgtataaagaaattgcaatttgttaaggaatttaagagaaatagcccgatataagatagtatgcagtcagtcaataattttcattttttttcaaagtgctatacaattgagaagaggaaatgctttcaaataaaattgttagagaagacttcttatgggaaaaagcatttaaaaagggctttgaaaaagaagggaagtagaatttacatatgtcaaaatgtggaagggtggaagtcaactattcctgcaggaaagaattatgttagcagaaattcaaactaaacgaacaagattttttttttaataaaaaagagtaacaacccaatttgattgaggaagaacatctgtctaggaaagtagaccaatatgaaaagtagcttgggggctagggagtagaggtattgaagagcagattgctagttttttgtttctttaaattcatttgcaaatgagatactattgaatgttttgctggcagaaagcattgtaatcgaatagttagtttaagaaaactagttgagtgcatgtgtgcagagtagattgcagtgatgtgcaggcaggacacagtgagcccacactgcagatttggaaagaaatctgcaaagaaagctttgatgggggagagtgttaatacgacatgcacaggctttgctgtcttgatagttaagagactagtgtttgttgaatagagtattaaacttctcaacctaaggctgcaaaaaatgggaaaacatgtgtgaagcctgagtaggaagaaggacacaccacatagcaatgtgctactcgtttgaggtactcatggagcagctctccatcaaacagctcagaaaagcatgcagagctggagaaccaagactttttaggcatttgtgtataagcaatagataaaatatctatgacaaaggacagagaaaaacaccccacatctccaaagtcctggtctgctgaagggtggtgggatgggaggaaggctggtaaaccccgctacatggagacacaaatgaacacagagagagagagagagaatgaagagaggaaaaatgttatcatcttcccatggaaacaaatgaaaagtgagcatgagagaacgtttgacacaggaattgggacctagtgactttgtgtgtgtgtgtgaagcagggtaaacaaaaatcacaagaaatctaactgaacctcactgatattttcaaatgatggaacagagtttgctgcagaaatgaagcaaaagggaatgggaatgggggctagcgaagaaagagtaactgtgggagatgttcttttgggactcttgtagcaaatttgtgagaaaagtagcatcatcacatgcacactagatttatagttgaccaagacaaaagcaaagcaactgcctgtttttaattctaataagaataaccagaaatttggtgaccttctctcatttccaagttaacctttattttttctctgtattttatttgtctccacttatcatcctacctttctttagatggatctgctgtaacctaacgcatgcgatttggtaagagtaaaacctaaaactaagtagctcattagtgtttagcaatccgtggtgtcatcgaacaagaattcctcataaaagagaggggatagaggcctgaaaattttaaataaagttcaaaccttgtaattagtgattctaaaatttaggtgtgtaaacttgagtaaagttttagtgtcacctgataagtgtgaagtaaatgaagaatcttgggctgtactctccaagtgtctgggaagttttcaaaaacccatatcctgggtaaaatgcattaatgtatggctgtgtgatatccattttaatgttgttgacagctttgggcagagaattctagctttcccctctctatatatgtaccccctttcctccacaataattaatttttagttgaatcaatgactgcccatccaaaaaacaaacaaacaaacaaataaaacatgtccgtaagacatcccagatcattctgattcaagtggccagaggctatactttgagagatgctgatataagacttctaaggaaaaatttcagctgattcccagttacatgattagcctatcactcctaggtagctactgagaaaaaatatagaggtttaggccaattagacttcatagaaaccatgatacttattagaacaattatttctacaagacttttttttttttgcttttctgttaatttgttttttagataaatcaatagatagactaatacagttggaaagacaatatatttgggaatatccccaagagggttgaggatacatactcaataatgatctgtagttttaccaatgtaatgattatttgatttatactattttaatattgattcaagaacaagtgctgtgaaaatatatagtactcttttattcccttctctaataggaccaggtttcacataatatgtaaaaatattgggatttggagccataagatctaaattcaagatcctttttattttctgtgtgattttggggaatttgctaatccattgttagctaccattttttatctgtaagatgagaatgagtatcttcacagctttgttgagagggttgaatgagttatgtgatgtgaacctcgtttcgaatgttagtgttacggatatccaactttcctcactggtttgtaaactgaaatggcaggtgtattcataaaataaatgactttatgctgggcacggtggctcacgcctgtaatcacagcactttgggaggctgaggcgggcagatcacctgaggtcaggagttcgataccaccctggccaacatggtgaaactctgtctctacaaaaatacaaaaattagctgggcatgatgacgggtgcctgtaatcccagctattcgagagactgaggtgggagaatcactagaaccagggaggtggaggttgcagtgagcagagatcacgccattgcactccagactgtgcaacagagaaagactctgtctaaacaaaaggaaacaaaacaaaacaaaacaaaaaatgactttagatttttcccctgacactgtactctccactaaatagccatttttcttccttttgctttccacatattgcttaatattgtacgtcaaatttatttcattctaaattgaattaaaaataatgtttaacattttctttcccttatcctttcattgtgaagaacttgatggcaggattcataagtgttttgccttttatactaaccaggttcaatcagacaagagtcttgaccattgcagatgttttatatcggtttgtttaatccatgaatgaactgatatgtgaaaaccttactgtatggtggtctcattctatgccacacttataggaagcatttattcaaaggcttaatagatgtctctttttggagatgtgactaaaatggaaaaaaagcacttgatttcttcaatgataacctaaaatggcaaagatgaatgcacctatatagaagctaaaggcatcataatcatatatatttctgcaaaacacattttttaatgtcatctatagaaaatctttctgggttgtttcttttttttggcatttggtcatttgttcattcagcaaatatgtagttagttcttagtgcaagcaaggcaccattctctatgttggatatacagtcatgaacaagccataaaatgcccttttcctaattccaatggggaatacattatacaaacaaagaaaaataaacaaaaataatgatttcaggttgtagtcagtactcttaagaacaataggctgggagcagtggctcacacctgtaatctcagtactttgggaggctgaggcaggtagatcatgaggtcaggagtttgagaccagcctgaccaacatagagaaaccctatctcttctaaaaatacaaaaattagccagacgtgattgtatgctcttgtaatcccaactactcaggaggctgaggcaggagaattgcttgaacctgggaggcggaggttgcagtgagctgagatcacaataatgcactccagcctgggcgacagagcgagactccatctcaaaaaaaaaaaaaaaattgggaacgatagcgtgatgttggagtgctttggatagggttaactggaaataattaaatggttaatttcaggacccagtgaaagacatcagcctctatgaagacccatgggaggacgggttcaggcagagagcagcaagcatcaaagagcatgtgcgagggctggcaaggaggccagtacagctggagggcagggcacaggctggattgtggaataagacgtaaggctgagaaatctgcaggaccacatgcacagggtttcatgggccatggcgagaaggtgggatttgtttcttgttgcaatagggaactattgggaaatttcaatcagaggtaaatcaagtgatccttactttaaaagtcccttttggatgctacaaaaataacttttggaggatggaacaaaaatggaggcaagcattttacttttgagtctattgtaattacccacggaagagatcgttatggctgtggctagggtctgtcgtcgactagctgagttactagcaggtaattttacctctatctatgcctttgttttctcatctgcaaaggggaaataaaggtatttacctcatagtgttgttgtggagagtaaataagctagaacattaaaaaaaagcatgaatctgcttggaatattttaaatgctcaattaattctggatgtttttattagtatcatgagtctaaatatacacaatggctttagtagccagatttattgcaattcttagtttctagattgtgtgtacatatcagatattttacttttccaactctgcttttcattcattattttttttactgtgtgaatcggtataagttaaactatgctgaggtcatgaacatgccccacactaaatctctgaggcttaacacaatagaggtttctttattacatcacagcttgatgaagagttgagagtcctccctctttcttttcactctgcatttgaaaactaatgcttttgtcgtatcagggaaattgtgtagtaaactgaagatcttactccaatgctgagttgttcctttattgttatcagttcctaaagatttataagagtgtctcaaaatgttcatttttatctgtaagtctcgtgttatttcatgatgtttccagcacattggaaagtatcaaggtctgccgggcaaggtggctcacacctgtaatctcagcactttgggaggttgaggcaggcagatcaactgaggtcaggagttcaagaccaggctggccaacatggtgaaaccccgtcctactaaaaataaaaaattagccgggtgtggcggcacacgcctgtagtcccagctactctagaggctgtggcaggagaatcccttgaacctggcaggcagaggttgcagtgagccgagattatgccactgtactctagcctgggagacagagtgagactccatcaaaaaaaaaaaaagaaagaaagaaagaaaaaagaaagtatcaaggtctgggagtctttgtgaaggtggatgttcaggacaggagctatgcaggttctcagatgtctggagcctgtagcccacattttgctcagtcatcgtgttactctgtcatttaaccttactgggatccttcaatgaggcacttagcaaaaaattgtacaataaacaaaagtatttttatattctcctacaaaaactcacacaatgcccaaagaatcatttaagttaatcacgttgtccatctctttgtctaaccatgaaggatccccatagtccattctagagagctttgcctagtccagcttgaaatgatcccatcaaaatgacttttatcatttgttttgagaggcggtaccattaatcttttctgtttccccctctctctttctggctcacttcaattcaacaggcagggagaagagaacattgaacaacattataaaaatgttaattcctaatgtcacggactagcccttaatcacactattagacatatgttctgaattaacgatcttgaccagcaagcaggaagacgaagattgactttgatgagtgcctgccattattttcaaagatggatgaagttgtttttctttctgactaaatgttttctcagaaacggtattctatttagaaagaaagagcatataaaacactttcttttgttggcagagtcttcttttctaaatcagcattttgatggtgtgtgttttgttcatatagtgagacatgtgctgcaatcactggtaatctcttggccttataactttggtggcctcgttctctagatttattttttaagcccccagcgcttaactgcaagcaatgaaataaagcatgtttagtatgtacagaaatctcattatcccaaacagtcatttcctaaagacgactgcggtgaaaatcagatctccttttctttgtgatctttacctgcacaaattctttctccacggcacactttgtcgaagtcctcctcaacaccaagtctctgagcctctgctcaaatgccatcatttgcataaaactgttcccacgacccctggtgagaagtcatattttcttactctgggcttttctagaattttattaactgctctctttggcactgatctcactctgacttccattactcttagctgtgtgcgggacctccttcctataaatgttatgagctcttttagggtagcaaaagttcattaaagtttatatcactcacgtattacaccatgacctttcacaggatacagttaaaccattgaatataatatatgcaattcacatcattacatttaattatataattttatgaattatatatttaatttatatataaattagtaattttatacaatatgaatataatatttaatttacatataattatatatgtgtgtatacacatgcacatacacacacacaaaacttgcaactttgcatcattctatgggcagaggctatgagaaaactgtacaagatctggtttcattaggttacagttaagtgaccagttgtgagaatagtttcttcaaagttctatgaagagtttttaactgaatgcatgggtaagtggcatcgagacttaaaaagatgaggcaggaccattactatcatggaaaactgctatctgcattgcagtgacagccaagcaccgtgtttgaaggggacaaaggcatggaagtcaggttacactgccaatcattggggctgggttggcacagactccaggtgaacccagattgggtttatataaatcacatgtgggacggaagaagggcagatgggaaagacactagcggtttctaaccatattgcaaacaccttgaaattagagccatcattgatctttctatgtacttctttataacccctacagaatttattttcacgtgatttatacctaatttgtattttatcagttattattgcaaaaatgctatataaccagttgccaaagctcagtgacatacaacatgcagtccttattctcacactcactcatctgtgcatccactgggtaactgtgcttcctgagttacattctggggccgtggctggagaggtcatgacctgctggggcatgttcccagggtcatgtcaaggaagctctggaagggcaggtggaaacatgcatgcctcttgaggtctacactggaactgaaccatcatcatttctgcacacattccatggagctacacaagtagcaaggccaagcctcacatcaagtggggcagtgggtttactccacccctaaacccactgccacatgtatttgctcatcagtgcagcaaatttcttttactcctgcaacttcaaacattgtatgaataaaagaaatgagaactaaaactcttcttgttggcatactgagtttgccagaatctaaggctatgagaatacattacatctaaacttagaaaaatgtaaagagaaacaataaccacaaaggcaacaacagctcaacagagcacagtctgtatacatctatggaactttctagctccattctgatattgtctggaattttgcttggactgttcatagcaacgggaagaggccagattctcttggccgtagctgcagttatcaccaggaagctgttgtgtttactgtttcccagttgtcaaaactttaattgaaacaattgcaagattacagagagatctccagtttgaattatgttcaacagctcccaatgattaagccatacaattgtgcaactaacctgtttgaattctcttcaatttcttacaatataaaaatcatcatttgaactaatcatgtacaaattagatttgtgtttaggtcttctataaaacatatatattttctctgtctttgaaccatttctctgcatataatatatacatattctacttgaggaaactttatggtcaggatagtgtggttattcactcattagcaaaatccctagacttgatctgctggaatgatttaaattcaagtataggagtctatataggctgaaatctctgatttaacaaatgaagatgcaatattgtttcccgcttttacttcctctccctcctcctccttattctctctctttctttctctcacacatacattccctccccaaacttacactctctttataagacattctagaatatgcaactttattttttatttctgtctttttgtggctcaattgagataattcttttccaagtttatgatgcattatcctgtttaggataattagaaaaatagaaacctgcagctggcaatctaaattggaggtaaaacacacctagaaatttctgcagtggagaaacagtgaagatatttggactttacatctacactgattaagaggggaagaggctcactgtgttgaaatgactgggggaagttcactggcaaggagttttataggcagacctaagacaacatacccttatgcagtctgctctgccaaatgggttaaatagtagttttgcaaacttttttcttttaatttgtttgtcaaatactctgctttaaaattggggaagaatttaggtccattaaaacactttgagtaaaaactcagaaagacactgaacatttgaaaagaagacagctacagggcttaaactgtgcctctcagtttgcatgttgtctgcaacaaagcaaaacacactcatggttatccccttgaaacttggggtagggagatcctgagaaggttccagcactcaatgctgacattgcgttgtgctatagtattattattgtgtggcagtgtgtaagatcaccttctgtgatcacttactgtgtacactctaaaacaaatactttcttaggaggatttatagatatagatatatattaaacatattacacgcacagacacacacacacacacacacacacacatatatatatatatgtaatttgagttttcccataccttgtttatatgcatgaggtcatatgacaataatatttgcatggaagtaatgtaaactcatgcaattcctcagtcgtattttttttataccctgcttacagaggaccttgacaactccctaagagctttgtggctgctactgggagttcctggaggagtctcccatcaggtcccagtcctcttgttttcttaatcttggctgttttgtggaagtccttgcgttgcatggctgctgaggctgtgtatgaaaactctggtttcctagccaaggagctggcctcacaaatccccagagccccaggccccggaagcacagtgcataacgcagacctctaccgcggagagatatatatgtcacatgcaggcagctgggggatagacagagtttttccccatttgcttcttgtcaaagtgaagtgccttcctggttttcaaagcaaaattgtggaacctccttaagccctgctcaccagatttcatagagttctttgtttatcagaagcatcaaaacaggtttatatttggtttaataaccccatttggtggaagaaatagagatttcagagatttaaaatattgatccattaagagatactaagtttctgcttagcttttgaataactcttctgtattaggggaaaatgtgttgtgagtcccgcctccacagcaaagaagtcagaatttaaatcccgaatctcgtttctagctgggacccaagtatgcaacttgtgctttacccatcagcccctcctgtgagatgctctgatgggaagatagccccaggaagcaggctctatgtgaaccttcttttttgcagacacagggtctgcagaaactcatctttggggagacaggggttgcagctcaagatacttgcagggaggtcatggtggtgcagacagcatgtcgactgaatccgtctctaggcgttcagcattcgggggcagccagctgggcagggttttatatttatgattctgtggtagtccagcatcttcataataatacattttggcttggaacaggcagagtgaattcttagcttctattcaagaacctgatcaattaagttctattttatctgttttatgctacccattttttttcctgttaaaccttcctattggaacatttgcaacattttgcaaagtgcagtttaaaaacctagccatagattctaaaaaaatgccctgatttgttctttatgttgttcatttactttgtctgcaatgagcttttccagatggccacaggtgacttatccgtggcctatgagttttgttcaggatgtcttttcatcaaagtctttcctgattggtatggtttaaaattgtaacacacccttcttcatagcacacttgctgtccttagcctgttttatattttccatatatgatagggtttggctgtgtccccacccaaatctcatcctgaattgtagctcccatgattcccatgtgttgtgggagggaccaggtgggagataattgaatcatgggtgcaatttgccccattctgttctcgtggtagtgaataagtcttacaagatctgatgattttataaggggtttaccctttcacttggcactcagttctctcttatccatgtaagacatgtcttttgccttccaccatgacggtgaggcctctccagtcagatggaattgtgagtccattaatcctctttttctttataaattacccagtcttaggtgtgtttttatcagcagcatgaaaatgcactaatacaacatacctcttatccctttctaaatactaaattatataagcatttttattgtcatttcctattaattaccatgtaacgagcaggagggcatgttttgtttgtttctttattttggtatgttttcttacgtgatttattccaagtgcctagaaacttgtctgaaatagtatgaatccttagtaaatatttgttgaatgaattcatagtttgtaaataaaatatttgtaatcatgctttgttccttcacttttgaaagaaactcctgtcaggaaagaaaaagttcaatttctgcaatggccaaaatttacagcctaggttgtgttttttcttcctgactacatggttagcatcaagacttgaggcgagtcaaacccctgtttgatcctcagtatcttcatttgctataatctctccagtactgcacagagaccaagacacaaagatgggacatctaaagggaaaatctagcaataatcctccggttttcatatatagatacataattttttgttctctctctttttcttcttgcttgttgagagtcatttggttaaaacgtgtttcaacttttaaacttctcaacctttaagccagacattaggagggaggcactaagaggccaaagcggtgcaagatgttgatggattcaaaacggaattaagagttgggctgctaatggaacttctagggagtaaaaacaccaaataagaattggtaaatctactagaagcaacacatccaccagaagttgcacacaaactggctgttcagagcttataccattagtaacaatgcaattaatgtgcttatagcctttcgggtagttcataaacaaagtatctcttgctcattggatttgactgtgtagtctggattctagagtctgagagtagaggcctgggctgttgaaaggagggagagtttgagagatttctttccattcttgggcccaaggacaacactgacaaatgtattcaaatacaaaatgcttcaccctcatgctggctggactcatgctgtgatgacccacctaagcttactccattcctgaatgtgctccatgctccaaataagcctgccagtcctctaggccaggtgtgcttggctcacccgagcagggatttaggaagaaaacaattcatgtgtagtattttacagtgatttacagttatttgaaactaaagaaaatgaattcatattgtttataactattctttaaaagaacacactggttaacagacatctccaattgaaactctagctttaaagatgacataggaattgaacttactttaggcagagtgtggactgccatgttgggatgactgtagtcctccaggccctctgcttcatgaatcagcacccctaaaatgctgatgattttcaaagtaccttctgtatgtttttctcatgaccttcagattaatgaaagctttaggttgcctggtctcttcctacttacctcagtggctttcatggggatgatagcctggaggcaagtaagagaaagttgttgctctttgtatatagagattaattgtgatttttatgtttgtacataagaatatgcatgtaaactagaatcttgattaggcaaaatttcaaccttgtaacatcctcagacaattgctattattcactgtaaaattgcaaatgatataaagtggcccttaataaatatttctttcattttttaaataagcacatgttaagcacctgttgtatatcaatcacaaataagacaattaccaaagggagcccaggcctcacatccttcagcctaatgatgtataacactttcatctgcctgtcttgttttggatgcagtatcactttaagaatgataattctaagctactgaaatattctcaatcataaaaaatccaacagatttcactaaactacattttgtaaagaaaaaaattgagaaggacaagactcaaaaatggtttccagttagctataaagactggaaatcacaggttgcataccacctttatgtgggttaaatataaccttcacaagggtttgtttggtccacatattatcagctttaacagtgcttttattttttttcccccaaatctttgagcttagaactaatgatgtctttttaaaaaacaaaatcagaggatatggcaactgcagggctactattatcctgagagaaatcaatgggaggccatcagaaccagccctcttacacagccaacctcttcttcacctgagtctttaacttcctcattgtctacccagaactgaggacagaggtcaggctaatcttggccctagtgctctcattttctctttggtagttttaaaagaaagttattattttttgaaattcatatattaaaatattttggtctaaattctgacctaacttactcaatcgtgcctgatctggtaagaattcaagtttacgacactgcctctcagcattgccattcatcaatatttgactatacaaacattttgatgaaaatgtcgtttatatgtgtacatatatgggcacatatagatgtagaaatacaaatttaaatatatagaaagagtgagaaagagagacagagatggaaaaagaaggaacaaaaaaatgagataacgaaacaaagaaatgaagaaagcaagcaaagggaaggggggatgtgagggagggaagaagacaggaagggaaggagattatctatatacatctattctccaagatattttcagctcagtttctgtgccatcccctgtgttacttcaggcttgccctaccctgactggtggaatatcttgtcttccagatggaacaccatttacctggtggattgggcggtccaatgaaaggcacccttactggggaggttcccctcctggggtccagcagtgtgagtgtggcctagacgagagctgcctggacattcagcacttttgcaattgcgacgctgacaaggatgaatggtaatgagaatctccatctttctgcaattgtagagaaagcacattaattgatgcataaaattccccaagacagaaggacatggatgagaaattcaatacaaactggagctcccccgatggtgacttttgttttttaaccttaaaaatggtaaattctagtgttttcagtatgacaacttatgtttggtacatataagcatgtggtcataccatcagctgctgcttcttcttttttttttttttttttttttttgagacagagtctcactctgtcaccaggctggagtgcagtgtcgcgatcttggctcactgcaacctccgcctgccaggttcaagcaattttcctgcctcagcctcctgagtagctgggagcaaaagcacatgccaccactcctaactcttctttttttttttttttttttttttttttttagttgagacaagagtttcaccatgttggccaggatggtcttgatatcttgacctcgtgatccacctgcctcggcttcccaaagtgctgggattacaggcatgagccaccgcacttggcccccaccagcttcttatattcagaacttcccatttcaaacaaggaatggcatgcaatattgagctttgcgattgagtcagggtatttatgatatgtggactatatgttttggggggagagagtgagagagatagggatgtggggttatataggctgtttcttcatgctcccattgatgtttcagtcaccagccttcccttttgctaccaataaacacatagcaaaggaaatgtatatttattaagcatctattaaatttcatataattatcttacttttgcttcttaatgttgagtagtatctattgcagagatgttaaataattttcccagtgtcaaacatgtctgtcaagtgatagatacagaatcagaaatcagccatttctgcagccagagtttcttagtctcctacaccaacttacttctgtaaaatcaatttagtttgaagcttccatgcccattacatttactcttcttttatcctccaggtgaactgctagttttttactgtattgattgtgaaaatatgtacagatcatttccaaatatacttttgttttgactgaatttaaagcattctttggttttggcttagcaattttgcttacttcatcaaatgctacttaattttaattaaaaattcttatgttaagctagtctcaatccccaaatttccctttagtgtttttactcactcctcaaactgttaacagcaaggactatttcacataaaatataaagttaagtcaaaatctcagttcagcaaggaaaggaccaggcatctgtcttcattgggtcctaggagatgtgtattatcacttcagaacaccctagggctgcttgggcaccagggcaggttacccgagtgccttctcctaaactcaagctggccgaagttatagggtaatgaattttgcctcttcatgtgggtaaaatcagatatagttaaccacaggtagaatgggcttctgcattctgtgagcccccactttatcctgcagcgaattctatctcattattgcggatgcctacaaaccaactatgatttgtagcctgggtggaggccatgtctctttaaacattatacctctcaagacctacagaagacattcagtggtaattagttgaacagattaatttagacaatctttaaagaagagaattatcgcaagatggcacctatgagcttgggaggtgtgttgaagtgttagatggttgtgctgccgtaaaacatattcaaacatctgctcccaatcgcttggattcactcattcctttgatttataggtttactctcacagtgcatattagacactatgtgtatagtcaaagaaacagatataggagctagaataggtagaagtgcttccccctagttactcttgactctgacccctcccctcccctccctcctccttccctctctccgtccttccctctctcccttccttccttccttccttccttctttccttccttcctttctctctctctctttctttcttccttagacggagtcttgctctgtcgcccaggctggggtgcaatgatgcaatctctgctcactgcaacctctgcttccagggttcaagcgattctcctgcctcaggctcctgagtagctggtattacagggcacaccaccacgcctagctaaggtttagtacagacggggtttctccatattggtcaggctggtctcgagctcctgacctcatgattctcctgcctcgacctcccaaagtgctgggattacaggcgtgagccaacgctcccggcagactctgagtcctttcttagctgccttcttgatctttgctcactgtttcttttcctttacccctttctttataggacatttgcctactgaacactacctcagtgtctcctcttacttgggaacaactgacccaggcttaaattactgcacactgaggggcagggaaaagcgtggccttatatcccttaattgggctgaagggctctgtgtctcctttcctaaaactttccactgatctcttccattccgctcccagcctctccctcctttgacttgctcaatgtttcactctgaacccctcatctgataatttcacttcatcatctagagtgagcccagagggattcttcataatgtcttctctcaccttgatcattccagaagttattacatatttcatgaccctttccatttcctttagagccagggactattttccatccagtgccattttctgtggcaagagacctcgctcagggcaccagaatttattattagataaggtcctgttcaacaatcagcctatcaaaggtcaagagaaaaggactgaacttcccctcttaaggatgcctgactcactcctggatgtcccatagcagcacgttgaccatctttgggcaaagtctaggtgagaacagatcagaaagtttcttctgtcattctcaagagggagtagagactgatattctgattcaacacttctgagcttcattcattgtcttagtgcaagtcatagcttgtgataaagggtttttataaatactttattatagaagcatttatatgtattactttatcagatatttactgatttatcacttacttagtgcctactgtgtgccagacggatagtctgctgtgcagagaaagtcaggggcattacggtccctgcccttgaggaaccctcagaacactggaaagaaaatgctatttagttattaggtgggtacaaaagtaatggtggtttttgtcatttaaaagtagtggcaaggtcggacatagtggctcacacctgtaatcccagcactttgggaggccgaggtgggcggatcacgaggtcaggagctcgagaccaacctggccaacacggtgaaaccccatctctactaaaaatacaaaaattagctgggcatggtggtgcgtgcctgtagtttcagctactcaggaggctgaggcagaagaatcacttgaacccagaaggtggaggttgcagtgagccgagatcgcgccactgcactccagcctagtgacagattgagactccatctcaaaaaaaaaaaaaaaaaaaaaaagtagtggcaaaaactgccatgagttttgcaccaacctaatagaaatacatgggtttaaaaaatctggcgagagaaataagcacagatgtgcctgaacctggggtagaaatgagctgggaaatttagattgtgaagagaagcagcagttacgttttgaaggagcagaagcagctagttaaataaataaacaaactggtgtactacaagtaggggttgggggtagggggaacatctgtgtgcagtggggaaatttaaaataatataaaaatcaccggcctcttaaaccacaaatatattggtgtggttgttgcacagtcgtcatttgagaaatgtacagaagataaaggaaaggaggaaggtcaaattcaggttatgaagctccttgtatggaaataacagtgagctagctttgtctgtacaaggattatgggcatacaataagtattcacacatgacaccaggcatatctttgtgaaaatgcatttattatttatctatcaaactctactatttactgcagaaaggaaaaatacaaaagctaacacacttgtgaaatagttaatcaagttcaacatacatgcaacttatttcttgacaactgactttccacacgtttcaaatttttgttttagaccaccacacctctttttatatcagtggtgctctgtgtgcctcagagaaactttggatattcttgccttgtaaaattccctcaagcttttgctcttgtgaaattaatcagaaaactgacttggccttgtatagcacgcagtggatagcggttgaatatgttacaactcctagatagtattgtcacttaaatgttacctatcatatcctgaattgttcttaatattttatatactgtacctcatattaacatctcaataactcttgaggttggttttattatttcttttccccagaaaaaagaaactgagtctcagagatgataaatggttcggttaaggtcgcttgactaaggggcagagtaggcattttagctgaatctaaggatgcccttaatgattatgtcaaaggagctgctaatgttggagttttgaataatagccagtcagtaaggatgctagagagaactctcctacaatctctcaaatcacatcaccgcagcatgcatgtttctttttgctaagccagggtgcttagggaaactggggcatcttctaagcctctggtgattgataattttttgttttgttttattatttttttgagtaagcttctcactttgttgcccaggctgttcttgaactcctgggttcaagcaatcctcccatctcagcctcccaaagcattgggactataggtgcattcaaccatggccgtcttgttctattttaataagccactgtaactgaataacatacatttcaataagacccaagtaaatgaagataatgagtgcatgttgtagggctgagtgaaagtgacacagctcacaaggttgaggtgggtggggagagaaaaaaaagtcattcagtgaacctcaaaagcacatttccttcttagagtaagaggaaagctttaactacccgtcggaattagctgatttcctaggggtttttctatctcagccaaatcactaaattgtaatgaaaaaggaataaatgaaggaacatataaagaataataattttactgattaatgactgtctgcaaaggaacttctctcaacataatcattcaatctctaggagtcctcccaactagatggtttctgaaccagctactttatagtgctggcttgttgagagtaagaaaggaaactctggtgacagctctgggttgcagaccctggagacagcacaggagagtgttgggctgtgtggaaggtggaaaaacagtcatccagcaagaggcgtcaaaggctggtggagcagcatgttggagaaggcagagagaatacacaatgtccctcatgatgatgacccgtggcccaaatgaagagtcttctcatccaaacaaccaggttgccctaaagtgaagctcttttacttggcagtagaacattcttttatttattttagaagaaagtacagaagttttcatttgatttttagtaactctgttctttgcctctcgcccttagtgtacccttgtataaagtgatatggcaaaaataggaagagaaaatgatgtaaggtgtaaattccggtcatctgataatccaaaaaagaaaatattttattcttttccataaagaatagaatatttttatgggatgttatctttttagcacatggaatcctggagctttaagctactacttactctttggttctacttttctgttacagagaaattatttaataaatgttgctaaattcatgaatgaatgatggatgaatgatttctgttagacagatttttaccaatgtatttttagataggtcaggccatagccatgatagaattagttgaaatttacttccttgttagccattactcctgtttcacaatctcacaataaatgcttaccaaattttaacctacatgccttttgctacagattgattttcttctggctatcaaaagtagttatttctctttctatgcccggattatttcatttaccatcatatattccaggtttattcatgttattgaaaagggcagggttttcttaatttgccaagcttgaacagtagttcattggttatatacacattttcgttattcatttattcactgatggacgctgagattgtttccatgtgaggggatagatatgtcaggtagcttgatttagccattccacaatttatacatatgtcaacacatcacgttataccctataaatatatacaatttttgttgttcaattaaatgattaattttttaaaaagtagttacaagtgaacttcctgttccaaaagttatctttgtatacatttgccttcaaaataagcttttgttttggtgaatgcatgtctaatccaggccccaggacattgccctccccaagggccctgcattcccttcccatgagatgcagaatgagatgatgctggatgcctcctagtggtgtcgaattttgctgtttcctcacctgggtcattatttgatctttcagaactctttcggtttcctcaaaaccttcacctctgagattcccaggctccatgcattaagggcgccttagaccacatagtatcttgagaaggggccccaatcctgaattctgagagaaataacaattcacctcagggcacactaacgttctatcccttatttaaaaataataataaattaggcaatctctattggttgaattttattattcattaatctgtttatgagctactctactgcttattgagttttgaaagtgcttgttctctaggcagacaggaattaggaagggtttatgtgggtttttgctcactcggtccctgaattcccagacacatcttgcaaactaatcagcgccagcctcttgtgttggagaggagtgtgcttggcatgcggtgggtcctccatgccttaactgctgaatgagaggatgcatgaatgaagagatgggacattttctctctccccatccacactttctagttattttctgctgtttcagtcattgaatatactcttaaagtatacattctggagtaacttgatactggcttccttatgctaatgttcccatgactgggtttcaatttttttttattttgtttttaaggcagaatctcactctgtcacccaggctcaagtgcagtggtgtgatcttggctcaccgcagcctcaaactcctgacctcaagcaatcctcacgcgtcgaactctcaaagttatgggattacaggcgtgaaccattgtgcccagcctacatttttttttttaggcagaatgttttgtgaggtacttcaatggaaagaataaaaaggcattgcccaattaagagataaagaaaaaatatgaaaatagaaaaaaagaacttgtaataacaggttgaaaattcaaaaccaaaatatcgcatcattactttgtagaattctaaatgaggtaaatagctgatattttgcctggcgtagcattaaagcaggttttttttttctttctttttatttaatgatgccaccatcctatccaacttttagggaaaaatatctaatatgaacagcctatcatccatgagttctggaaaacaaaacatagctatgaaatacttttttttttatcttgtggaaaacaaaacataccctgaggtttctattacatcagttatctgtcaagccttataaatatactatcactaaattgtctgtaaagtctcattatttgagcaattgcaaaattgtatcagaaataaaactcaaagtcattatagggattattattttgcatttacatgaaatgatcctctccctgaggaggtggctttaccacagggatattcagaactcaccagtcagaacacagatacacaaggagacattccttacaacttcttcttgatcagaatttactggaactcttggccaagtatgtctgaaggggacagctctgacagaatgggaagctggtgatgctgttctcatgttcctttcattctctctgtctttgtcatttctactctgcctggggctgcttccgtggtccatggcaatgctctctgtgaactacaaataaatcccaatgtctgcattttttaaaagtgtagtgccttcatcatgtagcagaaggagaaataattccatctcctttgcacatctgtcttataggtattttgtgaaagtgtcatgagctaattcatgtaataacacttagaatacacccaattgtagctatttttgctggtatcattgtcattttctggatataaaatgtaatgaatctctcagtaatattttattatgtaatggaaagaacaaattgtggatttgtcacttattaactagaaagcctaagtcatttagcgtctctgagcttctggtttctaatttattttttaaaagtgggggaatatctatctctgggaaatactggctgagttagcaataatttgtgcacccagcagatgtggcatggagtcagagctcaaagatttatcaaccatctttttattattattttctccattttcagccgatcttaaataagctataaaaggcaacattgatttatagaagttaaatggatgtctaagaaaagtctgtatgcatgtattgcaaatcaaaaccacaatgagataccatcttataccagtcagaatggctattaaaaagccatgaaaacaacagatgctagagaggttgtggagaaataggaacacgtttacactgtgggtgggagtgtaaattagttcaatcatttttgaacacagtgtggcgattcctcaaagacttagacagaactatcatttgactgagcaattccattactgggcgtatacccaaaggaatagaaaccattttatgataaagatacatgcacatgtctgttcattgcagcactattctctatagcaaaggcatgaaatccacctaagtgcccatcaatgatagactggataaagaaaatgtggtacatatataccatgaaatactatgcagtcataaaagtgaatgagatcatgtgctttgcagggacatggatggagctgaaagcctttattctcagtaaattaacacaggaggaggaaaccaaatactgcatcttctcacttaaaagtgggggtcgactgatgagaacacatgaacatatcggggtggggaacaacacacactggggcctgtaggagggttgggagtgggaggagggagagcatcaggaagaatagctactggatgctgggcttaaaaactaagtgatgggatgatctgtgcagcaaaccaccatggcacatgtttacctatgtaataaacttgcacatcttgcacatgtacccctgaaattaaaagttggaaataaaaagaaaagaaactaaaggggaaagaaagaaaagtataaatgcatgtatgcaatgaacaaaaacaaaacagaagtaatagcatgccagcacaaatttcattcaaccaccaaacttcgagtggagtaaggaaatagcactgaggttccttctccccaaaatagggctgctgtctgaaagtttattcttaaaattcaccatgtaactgatggatctgccctgtgtgtaaataaaccaagagattccttgtgaatgtggaacagaagagctcatggactcccagaaatcctgtcaaggtgatccatgggtaatctcagggaatgcagggctggaaaatgattgcaaattagtaaactaaaacctagtcaattgagctgtgtcttatgtggagaaagcctgtgtgcacagaatggggatggtcaccctgagacctaaggaggacagtgtgaggactcagggcctggctctgtgattccagcacagtccagaggcggcacagactaatgtgagaaacaccagcttccactcttgagagagctgctgtcggcaggtgggagacccgtgttggagcacaggagacattggtggttataggcaaatgctttggcatctaaatctgtgtgcaaatcctggcctttccatttgcaaatgataaaccttgagaagtttcatcaccttcctgaatctcagttattgctcctgtacaatgcaggaaatgtcacaatattttcctagcgttattctcaggattaagtgagctcatgagtgaaactctacttcaatgctcccatggccagggaaggcatccacggatataagttgctcatctgagtccccaaaccaccagtacataataaagcagcaacctcaaactctagcagtgcctctaatttagggatcttattttttaaaaaatagtttatctctggaaaaggcaacagtgatttaaaatagaattttattgtccactttataaatattttggtattgggactttgcctgtgagaggtagagacctcttaaaaggttttaagcaataaagtatgaatcatggtacatattatgtaaacatgtttcttggaataataagaagaatgataggaattaagagagtggatagattagaagcagggatccagtttatgtcaccagccccaaagcctaggcagaaccatgagatctcaaaataaaactgagtccggcagcatgaggataaagcagttgaatggagagatatgaagaaggtgaaattggtggaaattgttaattaagagtgagggaggaagtaagaaagaaatgaagactcttatgcttatgatctcagcaactgagtgtacaggacaagtcattcacagagttgagtgacagacaggtgggaaagttgacccctgagaaaatgactagtgaaggaggttgaacatcttagtttaaggtgcctgatgacatccaagggaaggatttagtagacagtcaaataaatatatattcatgaaggaacatgtgtgtgtgtgtctgtgtgtctgtgtgtagcagcaaagaaggcaaaagtaaaatgtaaaatggtgcaacaaagtgaaggacattaggggccgacatgttccatggaaactagcaatttaataagagaagtctcagtggactgaaggggaaaaaggccaattgtcgtaggttgaggaggaaaagggtgcagaggaagatgagatgacagaatgcaggcaattatctgaagaaaatttggctctgaagagaaaagaagggaagtaactagattgagagatagggttgaggatgactacagcatgcaagcagaaagagtgggagaagttgaaggtacaacataaagagagagcttaattgaaggagaaagtgccctgagaagtcagaagatgagattcaggataaaatactagccatggacaaggggaggattgctcaagccaagagaaagcaaatcacagtgggttcgatggtctgactttgcagatacctttgctagattgctatttaatgtcgagcttattctctacaaaacattaaatcattttccaacagggaaaacaagaattacacacacatacacaagtcaatatataaatcaatgtcacaaaatattttatgcaagaaattaaaattagaatagagagggaaaagagaatacagaacatttgggaacatttttgagaggaaactggagttgagtcttgagaaatttgaagagttggagaagacaaacagttggtgtgttccagagagagatatatattttggaatcatcaagatctaagtggtgttgaatcacaagtatggtgtatagtctaatagttttgacttttaatctacttgcttcctgaataagaccaaaggcaatctagaaatgtataaatatatttctagaaaaatatatatatacattatatatatattcattatatatatttattatatatatataaattatatatatatctatatatacacattatatatatatatataatggcaccactaattgtttctttctttgtattgagggaatgttctacaaattatgactcccaaaatcttcatctgtggtatttttaaaatcagttttacatctctaacgtcttgagggtcattttaatttcttagcagtaaagtgacattgagtaaaccttggctgattcatataccaagacctgcttttgttttcttgtatctgtttgtgaaaagtcctatggtttcagatttctggagcatttatagaaaataaaatagtttctgaacattttaaatacatactttatttgccttcaccccttgtttcttatgttaggaaataaaaacaagattgcagatgtggtccagtccctcccacccacccctgtgtggagcacagggagatggatattatcctggggtagactgtatatttgaccactcaatgcctgcatttgctttggttggcagccaaatgacctttaagctcatttaaagcttcttgttacctaaactcctcggtctttttttttttttttttttttttttttaaatctggaagccttgagaaagaaagcaaaagagaaataattgctccttaaacaaagctaagacagaattatcagcaagcatcagtgcagcattgcagacttgaagagttgcttgcaggcatcttactggccattcctcctttgcagccataagaaatgtaaaacatcatgtaccccactcaggagaagggggtgtggggtctcttgaggttgatccactcagattcacataaggacttcaaagggaactgagttcttgaattcttcctataattttctgtttgtctgccatatatataacgttttatttgctgcttctgagtgactgaaagaggaaaggacacaaaagaggggaaaaaaacccactgtaatttttaatagttaagtcacccaaattatatactaaaataagcttaccaagcagcagttaaccaaaattcgttgatgaaaatgaatggcagtctgtgacatttcatcaaacctgaatgataccccgcccccaccactctgccactctaaatttggtgaaataccaaaattcagatatttaaacttagagaagaccacattgactaattctgtaccatacccttgctcttgagaatatttaatttttttcttgccacatgcgttttattatttttggtcatactaaagtattttttaaggatcatatgcctattccatgtgcccttgtagactccataaatgggaatgtctggctgctctgctcatgcattcctggtgtggggtgccgtttcttgttctccttttatatattgtttgtatgtcatatttttatttcaaacttcagtgagaatttccataagtatgtattgagtttctactatgtacaagttggtgtgttcattgttttgtatgcattattccctttgattaatacaacaatattgaattattgttattattataaccatttaaaacataagaaagctgatccccagagtgacctcactgatgttatacaactagggtgttgaggtacatggattcaactcatgtcgtctgatcccagcgacaggctttcttactacatacaacacaatcatctctcaactgtacttaggaagggccttgtgcattgttccaaaggaagtgaaagtttgcagaatccttacccttggcatgaagaaagcaaatctacagctgtagactccttgcctatcaataggtaccaccatcatttgcatcattttattgtgactaaaacccaccatgacgatcaccactaccatcaccaccaattgtcctacccattgttttgaagtgctggaatggtacctgtcactcacaaatttaattaaatccgatcatattcctaatatgaccttaaaagcaggaataaatacacaaattccccttgatggttccattgcctataggctcaacacagccttcatctgcagtttattggtccagtcagtgtgggttcccattataattttttaaagaaatttaaaattcactgccaatattcaaaaactgaaaatttttacattaagattctagcctggctctttggtctcatattacagaatagcataatttcctgttgctagtgagtactacaggcctgttttagttgggacagctattttatacttatctctctttccccctgacaagagattgtgtgtcaatttccatttattactaacacaaagctggattcgcatgctttttgacttgcttggcccctgtaggcatttaaatttgtgtctgtttctgttgcattaaacagctttagagagcaatttactttaagttttcaggtaaaaatattcttagtaatgtgctttgcatcatcaaactaaatacaatttctttcctctgttatttggaagataattttattcttagagtgctatttttagatcccaacactttgacacaaaaacatcaaacttttgtggaaaagatgccagaatgtgtatgaaaggcagtcgttggcattgatgggcagactttagaaactaccattttcaccttgaaaatggaaatggagagacatacaattctattgcagtacagaatttcttcaggagaggatatgggtttggtcttcattccacttcggctgtttggaatttgctttgaaatctctgcctgaaaagataccggaatgtggagattgaaattcatccctgtgtctatgcaacattcatagatgtactttcaagctgagacaaaagccttattctatatcctttgaatggcctctaagtacaggtattcgaattgtagatattgtatggtatatttctttacattttccttttgatctgtaggaatatatgtacaggtgaatatttgacttattcataatcaagatgaattaatatgtttttctccgttttcatgagttggataataaatctgaaaatttaattttctacatgtggtgtgtaatataagctctccaatacaaaatcataggtggatgcataaaaagataaattgacttgcctggggccacagagtagttcaggaacaaagattagaactaaaataagtgtcactgccaccatttttgagcatttaccgtagatcaggcaccatgctaagtgactacataatctcttttaaacccatcagtcactgtgatgtagatattatctccattttaaaattgagcacactgaagatctcagaaatgaaattatttgcccagtctaacacagctaggacctggggactgagattccagagcacagctgtatacttctaaaactatgtccttaaagacctggggtagatactggggataccaagaatgtggcattgtccctgtctcttctgtggtgtgaggtgtgactttaggccagctatctaatatctctgagcctcagtttcctcatttgaaatgggcataatgacacctacagcataggaatttttttgggggaaaaatacctatcccctagtttatttctgctcaaaaccattgtacactcaatgctagtttcctacatccaatttttccttctcagccaaatgatgtggcccttaccatgagtccaaaaacaccaccttaaacaaaaggggaaaatatccaatggcttatcctattctttctaaactttatccaaaggtgattagtcaatattttatttgcatggttaacaaaaacaaagccagagtcactagctaccgagatctttaagaacaaaatgaaaagcaacgaagcagtaactataaagcacctcgagttaaaaggtggttaaaaaaaaatctaaacttgattaaaacctgttggcaggtggctgaaacaagtccttggagtgatttttgagtggaatttgtgatggctgtttcaagttagttgctgagatagccgatctctttatgggaatgagaggtgaggtttaatgtcacattagcacacattgagctggtgggctgctcttagccaccaaaagcagcatctttgtaaactatccatttctacaagcacacgtggggaagatgtaaaattcacttgtttttggaagccagtcatgggttttgtaattaacattccttcccttcacatacacttaggcgatgaaaggccttctgttttccccctctctgcccctaccctgctgcaactggccaaatcacttctgaaaagaggggtcatggaaaagagtccctagattatccacattttgtcctctttttttcttaaatttatgttttgcaggacaaatgatactggctttctttccttcaaagaccacttgcctgtcactcagatagttatcactgataccgacagatcaaactcagaagccgcttggagaattggtcccttgcgttgctatggtgaccgtgagtacaaaatcgaaagaagctttctctctgcattacatgagcacaagatgttcttactcccttatcccttttccctgcagtgtgccctagtcttgaaaattatccacatgtccagtgctttcccataccccactgaaaacgataaaccatgttgaaggattttctcatttgcaggacgcttctggaacgccgtctcattttatacagaagcctcttacctccactttcctaccttccatgcggaattcagtgccgatatttccttcttttttaaaaccacagcattatccggagttttcctagaaaatcttggcattaaagacttcattcgactcgaaataagctgtaagtgccctcaattatgaatttaatgtaactgatcaacaaacaagttttagtcttgtttttgccaccagtcactagtgggcatttgtaccagcaaattaatctcactggacatctgtaaaattagcagtgataatgtctagttccttctgatgctttatgattttttatgacctgtcagtatttaatcagtcattctcttatcaaaacatggatattccgaaaattcccatagacacctattacagtttccaaaggtatttcttacctgtgactttaatcttccacactacaggactttattcatgacactttccatgcaaagctgaaaagaggattattatgcattctattcatatttagggtctacttttttgctttgcctttgttccaaaagtaatttcctgacttatttcccacactaggagcgtgtgactatccaatcagaattcccatggtttctctgccacttccccatggacagtggcgtatctaataaacttgatgccaggatgtggatcaccttttagcactgcatatcctacatataaactatattcagtaataatcatgatatgtgaagaaaaataatgggaatacagatggtgacatttcctataattaaacattttgtatataatcatactaatgaaacaatattccaatactaataaaatacaatttaaaaaaattacatcaagtggtatttttaataaaaagggaaaaagcatacctatatattgctctgttgcgatcatagtaacattaaaatttatgtttctgagtctctacttctcgaaatttgacagtgacttcataaaatttaagttttttcatatgttcatgttcaaaagagagtgtgctcatgtccatttatcttatattgagaaaataatactttctattaattttagtttgtttcatatgaagcaagagctatacaaatagataaggttttaaacttcctatttgttaaaaattcataaaaatttcattttatactaaattatgtaaattctggtactgttaatgtttttacttcaggattgattctagaaacttctacatgtctctgcaagcaaaaaaattctactacaataatttcaacagaaaattaatgataaatttctattttattaggtaaaaagttaccatattcctaagaatttgaagttgcttgggttctagtaggatgcaaattttgtctcaaacctctgtggttccatacattcatgtattcaacattagatttgagtcaaacaaagctagcacagtaattatacagatgaaaaatgagaacttgagttcttattcttaaaaataaacaattagatttgagtctgtatttttagaagacaatggtaaatctagagttctatgtattaactttccctcagaatataatatttattaagtggaaagagagaaaacatactaatttgaagtttatatatacattgttaaaaattaacagtagtgtcatacaaacaaaatatatttgtttatttttaagagtaagaacttaagtcaaggcgcagtggctcacacctgtaatcctagcactttgggaggcctaagcaggaggattacttgaggtcaggagttcgagaccagcatgcccaatatggtgaaaccccgtcgccactaaaaatacaaaaattatccacgtgtggtgccaggtgcctgtaatcccagctgctcaggaggctgaggcaggagaatctcttgaaccccactggcagaggttgcagtaagccaagattgcactactgcaccccagcctgggtaacaagagtgaaactttgtctcagaaaaaaaaaataggttaaaaaaaataaaaataaacagtagcttcagcatctattgaaacagaccaacaaacgatttgtttggtgaagggatgttttatcactaacattgcttagaattacttgtgtatggtaataatttttaaaaagatgtatttttagtgacgtttgctatttttttggttctctgcatgcagcacactttttattgcttatagatggggtaggctgtacccaccaccttgcccttgttattaccatgaccataaagactcaggcttgtcattaggtgccctatgtatgtgtgtctaaatgaatgtttttctgtagtttgattgaggcaattgaccatatcactataatgatgtgactgcatgaaatacccttgaaagcataagtcatgtcttagcaacagaaattggaaacttgagagctccagaaaaggagacaaaaaaaaaaaaatgactggaggagatgacagaggtgtttaagtctcctgcaaattaccaagcagctaagtgtttcttttgcagttaccacacaatacatacaaggaaaaagatcttcttaattggtagttttaacctccttttgctccaactattgagactattaatgggaggaagctcttgtggctttggtgtgaaacaagatccctcatacctaacatggccagtctctaaaaatgttgagttgaatgccaacaatttcataatatggatataataacttcaatgtaaatttaataaaaatcaggccccatggccttttgattcattaaagcagcagcaaacgtatattattacaaagtaatgactgatgatttagtgttaattacgtatcaatgtccagtttgtttgcactttgtggtactgtattttagaattacatttgacaaaaatcaaaacccactgaagtaattgcttggtatataatatatcaccagattggagaacatatactctccaagacaagattttatataaaaacattgaaaagttcaagatcttatactctcaaatatttgttattattaatatttaaaaggggaaaagaccaaagtgggatggaaacatcttgtattctttatttacagctacactcatattacgcattttaggcagatggaatttttaccctaaagggttcatggcaagaaacctctatagaccaggcacttggaaaggaaatggccttttaacagatgcagtggctcagaatagatttccctctcatccgcaaggagtgttcctctaaaactatctgagcagcagtttccaaggttgatatatccgaattattggacagggaacagtagattcccatgaaattttcagtccatttccttccagcctgctttcaaagatatttgaatttcgtagcccatactctatgaaaaagaagacacgccactatgttcacaagtcttagtgaatgtgttttagtgggcctgtgaaaacgataactattttgatacctatctcacaatggctgtacaggtagaaattgatattttagagtagatgagatcagaaggaaatggcttttgagagtcagtctggcatagtggaaagaagctagactagaacccaatgtggatttgaacttttgttcttccaagtgggtttgtgagctgccttgagcaagttcttctcccttcctatgcttatttatgcaacatggggttggtgacatccatatgccacccagatgcctttggctgcaaataacagaaaattcaatctgaactggcaaccacaagaatgggaattcactggtactggagcatgtgactaagcccagaggaggtaggactggcttcgtttatggttgttttcagtagtttaacaaagttgtcagtcatctgatggttttctctctctgttatgaatgttgaatgtctacttcggtctaaggctggctctccatcatggtggagctgcatcccagctggtgaagaatccctgctttccagccttacgagcaatcctcctgagaggccactcacttggcccccaagaaccaatgtgtgtgactgggaacgtatacattgcagattgatttataccagggcctacccccacaccagagagtgggctagcttcccctgaagcccatgggaatgggaaagagggaagagtctcccaaagtgaactcagtattattagaaagaaggtagtcgtcagggagacaatcaatgaggattcttctaaggcagttgtcagaactgaaatgtgtaatttatttttaaaaataccttgcagaaatttgctgagctgctcaggggaaaaactgtacatatatatactgtatgtatgtgtgtgtgtgtgtgtgtgtgtgtgtgtgtgtgtgtgtatatgtatgtttatgtatatatttactgtataaatatgagagaaaagaaagagagaaagatttaactttatgatttcagaagtatcatactgagaatattacaaaatatgatgttaacttggacacactatagttagaacctcagaaaatagtacaaatgaatactactaataattacacttttgttgaattgttgagcaattattctgattagacactatacaattctttacattcctgatttcattttctttccaagcactcccatcgatgacgatcactgtgttgtactgtgattaccaccacacagtgcacgggtaggcaggatgaacctagagaggggaagtggcaagccctgatcgcacagctgggaaggttagaatcgaggacccacccagctctgtctgactccttgcagcaaccccgactctgctttgcaccagtccacaggattgacaatgttagaacttaagagaacatacaattatttacctccaggttttgaggcacaggacataaaggaagcccctgcaattttgtgcaataccacaggtactatttttctagagatagaaaatgtggctgccatcagatccttgaagagattatgtccctgaaaagttttaacagtattttatttagttcatatttctcattttacacatggacacgtagaaggccagagagattaactcactatgttaaggccttatgaattatttattccataaatcgaccctgaaatctctctcatgccaacctggggtggggattgaggacacagaaatggagtgtggttccgtcttcatggagctcaggactgagtgctgggagaagtgcagagtgtgtcctaaggatattctctaatgggcttggtggtcagtcctggaagaacatcatgcaggagtcttcttagcagcttcttctcatctcctaggagcacttggtagaaactctgttacagccctaaacatgccctttcttttttttatcagtcttctcaaaagtaaatcatgaactcatcttgtttcatttgtctcagaattctcagtgcctagcacagggtctggcttgaaaaaaaaatgccctgaaaggctaagactccttagttttgccttgaaccataaagaagtagctggtgagagaaggcattcgtcagaaggttgggggaagttgaacttagagggtaagttcatgatagagctaatgctgtcattggtcttctcccttcctattcagggccagtgggctatgtccacctcttcagcaagtgagagccagcttgagtttgccttaagggccctgttatactgggccacagtgggatgtatcattcattctctcacattgttttcaggcatctttattatctattctagctttgactagccagggcaactgcacaggtttccaggtgtggaggttttatcgcaggaataataatttaaaaattgagccctgggaaacaccatctggattcacatccagactctgccccacccacactgggtcagcttacttaggtacagcttactacctgtaccttacttccctcatctgtaaaagattccctgtctcataaagttgtagcaagtcttagtgagtcaattaatgaaaaatgagtagtaaggtatttggctcacagtaagtactcaataaatattaactatttttattgaattttactgattttattgaattttactgattctaggaggtgcagcttaaacatagtatgtctttaacagttgctttaataaagttaaataataataattttaaagactttgcaaggaccctaataacttggtataaaactgtaaaggtataaagaaaattgcagaatggcatttagtatgtgcagtgtaatgatgtttcagtgaataaaatgagaacttcctgtatacaaggcacagtgctaggtgctgggtatacgataaatcagatgttcttctagagttgcagactcgggggagacaataaacagattattatacagcagggggctgcagtttggagcagaggtaagcacagatgggaaacctattatggaggttgtggtcagggggcaaggctagtcacagccagcgaaacagcaagccctccccaaacatgtgttgtctcagtggaatttattatccacaagactagccttgcaggaaagcttttagcaaaatctttaacattcctcacccaaattctcaccaatcttattctgtgttttatagaaaaatgtaaatgtggggtccagtcatctctcagttaagtgtttttaaatttggggatgtgcagggctgccaggtggcactggtgatctgaataagaaacagagaaagactcaaggggccaccttcactcttatttagtctaactgctcatcactcaatctgttcccttcaattctgtttcctttaaggcatgaatttgtcacctgaagccaatttgcctaggttgaaaaatcacagatcacagtaataataacaacagccatcacctgttgaacatgcagtatgtgccaggcacagttctaataactttatcaggattcgtgtctaaataatctgatgatttaagtattgtttttattcccattttacagacaagaaaattaaggcatggtgacattgaaaactcgccttagatcacagtagctgcagagtctaagctcttaaatcccattcttactgcttccaccttactacctttcctttaggccagggctcggtagaaagcaaaagaattcgagctctcagatactcaaaattctgtgtaatgcggactttgatggaggctgctttcagttaaggtttaaaggctgggaagaaagtgctctgaggtggagtttgtcttttggcatttccgataatttaaatctggcagttgatgacttcatcaaataaatacccatttcctattttagggggtagaggagagggagcaattgtgaaggtgcctagaaaaaaaggaatgcctagcatatgaaagttccagtcctctcctcatcctcaatttgtaaattacaattagcctctccatttcctttacatttagaacattgttatgtgataatggaaaacacaagacaatatactcaacagagcaacatcgtgaagaaccctgcctgtggagtcagattctgctaaccacttaagacacttgcagcaaattatttatatttctgtgcactttagttttctcactcataaaatgctaataatggtacatttctcatagggtggttttgtgtattaaaatgagataatccatggtcagtgcttagcatggtgcctggcatagagtttgttgttcccactgtgctaccccttccaattctctctcttaatggttatccaccattgccactatcatcaccaccaccatcactggcgccatcaccatcaccttcatcaccaccatcaccaccaccgttaccaccatcaccattaaccaccaccagcactgccaccatcaccatcactgtcaccattaccatcaccatcgccatcaccaccactgccaccaccactatcaacaccaccactgccagtgccatcactaccatcaccattaccaccatcagcactgccactatcactatcaccattacccccctcaccaccaccactatcaccacaaccattatcaccaccattgccacgaccaccaccatcatcatcaccaccaccaccatcaccatcatcatcacctccatcaccaccacccccatcagcaccaccatcaccatcagcattaacattatgcccaccaccaccatcaataccaccactaccacagcactaccaccaccaccatcactgctgccatcaccattgtcatttcaccatcatcagtatgcttacttctgactgggtgccatctggcttccattatacaaagattgttatagagaggcagaaagaataatggaaggagtcccatgtgatgacaggaggcttgggtttgattgcaggtaccgccacctgcagcagtgtctccttggacaaggcgatacaactttctgagcttttttcattatggaaatagcacaaatgcttatataacatgcattagtaaaataaggaggaagcactggacttcccaaggcctaagtctcctccctgcaggagtggagctgccttgctaacctcatgtctgcagatatcctggaggacacagctgaagccacaatagatccagaaaatccagggcctcggcattcatgcaggtatatcagatgagcatgaatggtccaggtgcctatcctgtttcctgaatttgcaaacgtagcaggaaaaaaacaacttggaacaagtatacacatttaatttggtagctgttactattaatggtgatttcagtgctgcagggatttcaaaagaagtcttctctatattgatactgacttacaatcgtttctcccactcaagcctgtgccttgaatgagctaacaactccctctatccttcctgttttcctttccggtttcagctccttcagagatcacctttgccatcgatgttgggaatggtcctgtggagcttgtagtccagtctccttctcttctgaatgacaaccaatggcactatgtccgggctgagaggaacctcaaggagacctccctgcaggtggacaaccttccaaggagcaccagggagacgtcggaggagggccattttcgactgcagctgaacagccagttgtttgtaggtaggggacatcttaaggctccttttgtgctaaaccctgcaagatcactgtgtgaccatgcccaagaaaaaattctcttttatctgagatctgggatatgatcaaaatgtcataaatcatttctaatggtaaatttcattctatacattcttttattctggcttcattggctacatcgagttaagataatgctaacctttagcaaattttgaggttgtccagattctgtacattttctttttgtaatattgtcttcagatgcccagggaccccttttgttctacatcattgtaatataaatctactccaagggacaggacatgtcaactctttacaacttagtgggtgtagactgtaagtcatgggctgcccttccaagtgctgccccagtcctgataattacagatatccatgcaatgatatagttgaaccattttaaagggattttcgtcaacagtaacatggttgagaaaggaatgatccctttctaaatcagggggctctttgatagtacctgaaatcatagcactggggatcaacctgccacaggctgttcatctgaactggcaactgctgctggtgggggcctggaaagatccaggcatccttctttagtcattcctcactactttcattccactcatagtcactgagcatctacaactggtcaggtatcttgttagatagtgggtattgaaagatgaattgagcactaccactgcttttcaaggagtttataatcctctggtgtgtgtgtgtgtgtgtgtttcacagagaagagagcatggggttttggaagtctctcttcagtgcctgagccttaactacatttatgttggcattttgtttcccttgacataattcttacattttgttaaacataagggagtgcgtgtgtgtgtgtgtgtgtgtgtgtgtgtgtgtgtgtgtgagagagagagagagagagagagactaatacagggtgagccttatagctgtagttaaaaaaaattaacataggttgaggagggcttgtaaagctttaaagtacaaaatcgagctcttaaagttaagaaatattgtcaatactaccaaaacaaagagtgtgcttttatataaaacttggagttcagatgtttagaacagtgatgtaaataagtgacagaatttgtcagtctacccagatttaactttgtttccttttttgtttatttattttttttttgccaactcccacactacatagctttactgctagtgatgaaatgccaccagcattcaatggaagtttccttacttgcttcctttaaatttaggtttgtgcaacttttagctctgaggaaagcagtcactaaaatcacaccagctaaaagaaagcaagtaatagagtgtgaggatatcatattctctcttctcaacaggaaccatatttctttctttgtctgttatgttccccagatccagcagaagctaagatataaattatcaaaacagttttgtgattgcaagtcatttgtttaattaataactcatatatgtgatatgattcactattaaaatattttaaaaatttatattgctgttttaattctatttaaacatcacattttgatgggtgacttctgaggaaggttgctagtcatcaaaatctaatatattttttggtggaatcaagtcaagtgtttcacaattttcataaattatattccatgccaaagtttaatttatcttcaggcagtatttatgaatctttctggctgaaaggtatatataaagacggaataattttttaccctttcatgcaaaatttatgtagctacaaaattatcatacaggctggatatgtgataaagtttgcgcaagtcaaaagggaaaggcggcagctgtgtttcatggcagatttctatctgcagacgtttcggttaaattgatcacaaatgcaatgagctgtaagagcatgtcgatgggtctggaggagatatcttgctggagctggagccaaggtcagctgtggcaagagcacctgcttctgctatgtttctctccaataagtcccatctcagatgttactctgctttattgaatttgtcttaatgtacttgaagaagaataaaatgctgttggaggtcactttaatggtctttcagtttgaattttcctatttagagttcagtgatatgcccatttagaaatgtcaggtagccaacaaagctgaagtctcaacatttccatcttgcacaattcagttgttcaataaatatatagataaataaataagcattttggtgcttagttatagtcaccaaaatgaacaattgcattctgtattattcagaaattgagaggccctggatatttatatttgctagggaggaaaagatatcattggcgtgtgcttctttactggaatagattgagtgtagcattacttaaatattaatttggatatgtctgtctagatatctttggccgctgaaggatctttcaatcaaaatggagcatccttcagcattgtaatcactgacacagctgccgtggtcatgagtgtttcctgagtaccagaaataggctgcgtttttacaataggatgttcctctcagcactgcccctgtcattggaatgtgacaggttgaagtgctgatacatgagtcaatgcatactggatttccagaatcaatattttaacttcaggctgttatatcaccatgatggttagggacatttgcaaccatgtcatttcaccagtcacatttctttaacagagcaggagactcttcacaacatgcagcttctgaaatgtaagctgcaagcgtgtggcattctcacctttggaatgctcaatagtaccgccccttctgctttgttattcccccctaatgtgtccatcaatgtgaggatgaggcaagaaaaatcgaagatccaatggagagatctgagtatgcattcctggtcagatgccaacaagccataggccctgggtagaaaactaactagcatgagtgtactattgtctttatctgcagaatgaaaatgaagagactgtaactgatcttctaaggcttgaagatctgctatctgcatgtacaaattaggaacgactgtcacacctacagtcatgcccatgtgtacgtaacagtaaagaaaatgtctcattccctccaaacttaacgcaagatctttcaaaatatgcggcaattatagagtggaaatcttgtgaagatggggcctgtgagtctcattttatgactctatttccttctactttttatttttcccatgggcctattttttttttcttggcccaactgctctatttgtgtcaaaataaactgaagctactccaaacttacaatcccctggggaaaatactacactgacttgataagtcataacatttggagagatcccccaaaattgctgttcttgcttccaggctggaagggaattattactcctatttcaggtgaagcgtgtcaaactcagtgaggtcaagggtgaagccaggcaggcttggcgtgcacatgtttattttgtgctctggcacttcctaaactcttgatttgtggcataatgcaacacttaggtaactggcctcagtctcctcttggaatagtaacttatattttatgcttgtgagtgcctcatgaagatagccttcctgaagcacgcctgtagtgctttccattaggcatgatgtcatgtgtctcacagtataggaagagatctatattctcttcacattgagaaataattggaaaattatctgttagcatatttttacataaagctgtatttgcatggaggataataattatcatgacatcaacggtgaaacaaaaagtgaagaaataattgtttttttaacattatataaatctctgattatgtctactattcccccataaaagtgtatttttttcaaagttaaataatatattaagtatacttcaatttttttaggaaacattaatgtatgactttcaatgtccccttaccaattacataagggaaattgttttggttggtttaagaagagggtaagagacctctgagcgctagcgggcaggtcctgggactgcctcagtagccacataagaaacactagaagagcacccagtggccactcaaaaatgcttctttagtggggaaaaaaaaaaaaaagatgaagaacacctgggtttgtccctagcaccagtgatccacaaaatcaggttcttgtagcttgaaaatgtttgaaaaaacattggttctgtttttatattcaggaaaagtgagtgattaaatcatcctttcagcaaaattttgtctcttcttgaagatgttgagaattggatacatttaacccatcccaacacccattttagtgttttctactcgctattatatattttttgaaacagagtctctctccatcgcccaggctggagtgcagtggtacgatctcaggatctcagctcactgaaacccctgcttcccgggtacaagcaattctctttcctcagcctcctgagtagctggggttacaggttcatgctggcacatctggctaatttttgtatttttaatagagatagggtttcaccttgttgcccaggctggtctccaattcctgggctcaaacaatctgcccaccttggccgcccagattgctccctactatttcagacacacttttgaaaggtttgtctacaacttcttctgctttaattgagctcatattgtgatcttttggtctctgttggattgacaatggacaattgaagcagaatggagggatgtgtgtgtgtgtgtgtgtgtgtgtgtgtgtgtgtgtgtgtgtgtgtgtcaggattcatactgtcttttttaaaggagaatgcagcatggtatcatcttctcatgcagctcagaaagagaggacccgggcttcagacctcacaaaaactcaaagttagaagcagtaatttgattctcttggcacttccacttgtcaacatttataactcagtaaagaaagaaatcattagaagagcatcatttatgtgaaactggcattctaattgtaaaaagaaacttaaggcagatctttctggacaataaaacagttctccctggacattcaaggacccaatctgaggggcaattgcaggaaagaaatcaggctgccctggagctaatgtgactgccacatgctgagtagccacaagggaagccccagttggaaaagagcaaaccagagaggtggctgaggctgtaacactgcctagagcttagtgagctggtttccatttctctgagtctgcccagaggaagcagatgactcagaggaggtgagaaagcccttgggcagagtaggggatgggaagtgtgtcgaaaacctccagtaagtcctactggccaagttatactcttctcattttgttatgaagttttttttgaacacatgcacaagtggtgtctcagccaaagcttcgtctaccttttccatgcacagtgtgtcatcatctcctttaagggtggccttgcttcagtttcagcagcgctggcatcattagcttcatcaatacccagaccgagtttgatcatcctgtcaatcctgttagcacatgtctggggatcttccacactcaagccagaagacaggaacacattttcataaaccaggaagcaacttaatggaagaaactctccaaaaggggcttgttttccaaagaaaagtatagttcagaggagggaaattataagcctacctaggcgtgttgtaaagccattcaaaaatagctcagagagaggattctgaatggtaatgtagtgtccgactcacattctgcttaaaaggattgtaacaaatagagacaagttaaaaagaaaaaaaaaaaagagtttcttctgaacctggaagaaagggatgtggattcaaagctgcttcagtagggaaggtgattttgtagaagaggaggtaagaagtgccatgctccaattcggcttccagtgttatcgtccctgtttcaaggtaaataaggatctgctctcaggctcatcttccgtgtgtagaggggcttagggatctgtggtaggaccttgtaatctgctgtccaggtctcccttcaaagaaggacttgctctgtggctgggagtgctgttggtggacagtcttcatctgtctgcaccttcagaagctgcctcagctgcagagaaagccttgaccaaggtcatgtcctttccagggggattcacatccagtgactgagccagagtgcaaaggcacaactgttgggcccaagaaggaacatctctggttattcgttctggcttcagcactcccggtgggactgtgctgggctgatgttgggcctttaccatagttcacttttctgcccattcatactttctttttcttctgtccaaccataagtatggtttccaaggtttcccctaaaaatatcctgtacccttaactccatcacagaacttgctttctggtgaacccaacctgagaatcaggtatatttttcgtgcaacttacacacatgtgtgcatgctcacacacatacacacacacacatgcttcttttaaatcaaattaattttcttaagtgaaatttatttttcgtttctcctgagaattagctataaaataatgcctcttcctctcctactttctttttccaaagcactgtttcatgctaataggttattaagaccaagtttgcatggttttgcttcattaccctttgaaggtcctggtactcaaactaaaatggacctgcccctaccctgatctacctgacagactcctcttcatggataatgcagactttgatgagtcagatgaactatctcctctcaagggagtctatcctggtacacccccctatctctgtgagcacacacaatacgcctgattatactgacctgattgtttcatctcccctttctaggagtttctttgtgggaagacgtagtgtctaatttatcttcacatctctgggaccagtaaaggttttctaatatatttagtgttcaataaaaatctaatggattaatgaaagtgaatgaaggcagagctccccgtgccgtccattccactagtggctttatggtattaggcaagccacttactctctctgagcctcagttattccatctgcccactgggcttaataataatcaatagcttgcaaatcagtttcaaacattgaatgcagcaatggatgtccctgttccacttgggattttcttttaagggttcttaaataagaatggcaagcaaaagactgtttcaaatgggaaatgatttgtgccttcaccccattggaataatgagacactccttttggaaactgaggggttttgacatttaaaggacacactcaattggtgtaatggctccagggggaaagatccctccctacgctggattttacttcttctcacaaatcaacagaaatgtctccacacactagtgtacttggagtgtgagtgcctcaaaagctgaatgcaggtccttataaaggggaaagtttcttgccattttcttggccatcgactttaaagataaagggatttcaaaaccacattttcaaattactatatggttcacatacgcctgcttcaaaattgttattggtaaattacattctcactgctattattttccccctgatctgttcaataagacagcctttttttgggttgtttgtccaaatcagagttgtgtccaatctggtagtgagaggatgtgcccagaccagaaatgggacctttacttgtgatttaagcataccagaaataaactgaaagctgaccacactcctaacacatttgcaatgccttctgggcagtcaggatttggcctcagccactgaccttctcttggtctggactgagaataaagtgcagcaaaaagccagactatatgattgttttaaattgaaatgactttctttagcagaatttattcttcattctcccagggatcaacctcctcttttcctactatctcacccaaaagagtttttaaaagcctgtgggtgcttcggtggagtttggagcattttgcaggatggggagtgagggacagtggtctgattctgcactgccacttgcttttctttgtccttcatccttttttccccactcacattcttttccttccataattcactgagcaaatattttccaagtgcatgctcagtcagccctgggctgggcaatggggtcatggagataaataagatccattcactctttgggaggtacaggctcagggaagaggtgagctggattttctagtaagtccttcatgctgtggtatgtggtatgtactcaaggcggtatgagcagggaaaactggatgcagctcccaactccatgcggaggcaggccccaggctctatttctcttacgttgtgtaagtgtttatttcctgcctctctctttcttatattggtgaaataagattaatttgcagttagtacaatgtctagggaaatttgcccttggaaggcagcctgagacttgtgtgcccactcagtgtgtaggaagcagatctcttacattgctaagccagttgctcacttattcaggtatctgggaggacacctggagcccaaacgcctcagggcctaagactgaccatccttccagatcttgctgtctatttggggtactcaacgtggacactgcattccccgccgccatctacactgcactggagccctgctttggactcgggttcgtcttaaaatagtgagatggtacttctatcaatgacagagtcaggtgcccttttgctccatattctctgccattttcccacaaactcttatcctcaaggaccgttcttttctaccttttatctcccatcctttcacagataaattaattcatcaaaaacatgggggtgggggttactgtcaggatgaggttgttgccctgaagggcagattcaggctgacaaggtcttacccaataataagaaacagtccttgcccagaggagtgtgctccaaaagcagtaatggagggcagtggagcagttatatatgtatatatgtgtgcatatgtagatgaggttcatttcttttttataatacctccactctcttagagtttctgaagcctgcagttttcccctttccgtcagagcatattgtgttatgcgtttcctctgattccatcattttttatccttttgtttatttgccctcatttttctcctcttttatcttctgcaaagccaccttgcttccttccatttattcctgaaggccacgtaacctctgatggtgcctgcatgcccagcaggaaaatatggatgataatgtgtcctgcttgctttgtgttcacaaaagactaaaagcctctagatatttcagtattttatccttgttattattgttattctaacttgtccccatcattatgtattgtgaaattgatacctttttctgtactagaaggtcatgtggaccttaaacagtaggaaagatctagcttgaacccagtataggggaggcttcagaccaaccacaagccataggtagaaatggaaagtgtaaatcagatttccaataagtatcccaggactgggagaattttagttcaattgctcacatttttttttcatctgtagtttgtaaaataatcactggcatttagcatattgaccaaagaactttaaaagaaaaaaaagcatcattctgagaatgcaaacaattaaaatttaatttattgctggtgggagtataaatcgaaacagttaagaagactgttttgcattatctactgaagtcaaacatatgcataccctatgaccaacagttctactcctaggtatacatcaacagaaatatgaaccataataaatacagaatattacttatggcagcactattcaaaatagccaaaacctatactatgcccattgagagtagaaagaaagatgatttatgaaatgtttctcacaccagaatgctgtacagcttcctttattaatatggacaaatgtcatcaatacaatgctaggcaaaagaagccagggtcaaaatagtacatgcaatgtgattccatttaaatcatattcgacctctgatttcagaaacgggttagtggtattcttagaaggggtggttggtgactggagggaagcttctggcgtgctggtaaaattctgtcttttgttctggttgctagttactttggtgtgttcagtttgtgaaaaattatcaagtcatatattcctgtgcacttttgcatttgttcttgaacacaagaaacaataaaacacagtactaaaaacagcctcaatcattgaaatattttctcatcatcataagttttaatggttttataagtagttccccatatagaattaccatgacttatttatcattctcttttgtcagacatttccctcccccagtctgtaacaactatttcaaaagatcaattaaatattaatatttctgcttgtaatcctcctccaagctccattttcagcttttttctttaaaaagtgcaataaagccagtaataacaatgctttaatggctcttgatatggattgatgaattattattcacaagtctttcacaacatttatttctaccaaacaaataaggaaattattttaatctgttaaccaaattcaagttatcactaaactcttttccagtttcctgagggggtttggcatttggtttgaggtgtcaaaatttgtagtgaggattaaatcaatgaagcatgtagaaggtttgatattaaataaattcttcgttctgatcactattattattttaccttttgggcatccagttaatactaccagtattattaaatagtgtatgtttagtgattcctgagcaagaaatctctctatctggcaaaactcaaccagatacatgccttatccttaaggaaatcacattttgaaattaaagtctacagtaggatttcctcctggtaccaagattctgccaattggagaaccaggacttaaagaagaacataattgatagttagtgtacttgtttttattcatcatgtatatgttaaaccttctgccactttagtcaaaaagtctgccactttttgaaatctaggtggtaaatgcagctgaacttcagtagaaaacaaactgctccatgttcaagggcataaaaataaagtaaggcaggaagaaaggtgggagggaagaagggaggatggaaaggtggcactgtactaatttttatgaaataagagcctgacctgatgcagtctgtgtttttccaggggcttctctgaaaatcagttttgctggagcatgtgcaggaaagagcagatacacatgagagaaatagaggctccgcgtttgtgctcaaggagggtaaaaggaactgagatgcttctctgaaagcaatgagcatttgtccaactgacacatggaggttttcaaagacagtcttagaatgatgatagtgaagtttttaagagttgattcatactcagtccaaggaaacatcatcataatgaacccacttgataccaagggccaactgaagagtatcatacaaaattgcttctagctaggccagccaactaatggtctaagttgtcaaaaagactgatagagaatcccagagaataaatgcatgctggtatattatttggtgaaagaaaacatgtaagaggtaagaggaagaaactggaagaatcacttagttgtggtattgacccaaatcgtctaatatttgtcttagaattttagggcaaggagctacatgcaggctttgaaggtcgccatgtccagtgtgactccaggctttgccacataaaatctgtttaattccccactctggccaaagcaatctctgatgttaagttttcttaggcaatgtggatgttaaattttcttagggaatgtgaatgatatgaagaataccttctttcccattgacaatttaatgagtttagtataaagtttctagcctacaactagtatgactagtatctttaaatattgtttttagaaccagaggcattgctctggtcctcaaagagctcagagattaaggctgagaaaaaaaaaaaaaaaacaaaagaaaaagaaaaagaaaaaaaacccttaagcatctctaagtaaaaagctacatgttttttgttcttctaaaattacagtgaactgtatacaagaaacaaacaagtaaaaatgaaagtatattagagcaataggggaaaaattaaatacttgcagtggccaggaaggcaacatgaatgaatgaaatcatcctggtgggttctgtggtcaagtggagagtgcatgccctatcttaaaggagctgaccccagtgcagttgagaattgccatgcaagaaagcaggttcattgttaagagatgttctgatttttcaatgaggaactaactagaatttttagaagtattttttgtgttttaaaaaattgacaaataattaaaatgaggaaatgatcggtgggtagaaagataaatgactaataagtttatatgagttcaggtgtgcatgtctgcgactacaggggtagtgtaggacaaacagtggagtgcatggggatggataacatactagtaaatacaacatatgtgaagaggtgcaaagtctagataggccatgtggcatgagagccacaagtggttcggaatgcttggtgcactgaagtcagtgcaggaagtgtgggagaaagaagctggtggggtaaggggaggccagatctcccttgctgtgtcaattgtgatcaggaatttcagcttgatccctaggacaatgactagtttccaaagggtatcaaacacgtacagcagaatcacattttcaaatttgcattaattctagccacaaaatgctgaatggaaaggaagagcaggggctgaaggtagcatgtttttgcagggattcaggttagggtgacagagaatatactgaaagcagtctccaggcatagaaagaagcagacaagctggccgttgtggttcacacctgtaatcccagcacttggagaggccaaggcaggaggattgctcgagctcagcgttttgagatagcctgggcaacatagtaagacctcatttctagtaaaattaaataaacaaataataaaaataaattttaacgaattagctggtcgtggtggtgtgtgcttttggtcccagctactcggtaggctgaggcaggaggatcgcttgaactttgggagatggaggctgcagtgcgctatgatcacaccaccgcactccagcctggatgatagaatatgactctgtctcaaaaataaaacaaataggcaggcaggaaggaagaaaagaaagagaaagaagaaagaaaggaagaaagaaagagaaagaaagaaagaaaggaagaaagaaagaaagaaagaaagaaagaaagaaagaaagaaagaaagaaggaaggaaggaaggaaggaaggaaggaaggaaggaaggaaggaaggaaagaaagaaagaaagaaaggaaggaaggaaggaaggagggaaggaagggagggaaagaaaaagaaagaaagaaagagaaagaaaggaaagaaagagaaaggaaagaaagaaagaagacagagagaaagaaagaaaaaagaaagagaaagaaaggtaggaaggaagcaggaaagagaaagaagagagagagagaagcaaatggattcagaaacagatttctgggagagggagagaaaatccacagggctggcgtaggggaggaggacagtgagagaggaggatgagggaagattactgttgcctttctgtttctgtacaataagttttacagaagattcatgcctccaataactctctacacatagtaggtaaaaagggccgcttttaaaaaattattctctttataaagaaaaagcaaacttactcctagttttctcctttgtaaagactaaaacagccaggtaaaaatggaaatttagttcactgtgcaattgagttcataactcactgtgtcattacggtttgtcagcatctgtaattgaaataatcccccagatttgtgtcactatcaccaggttctgtaagtctcaaaccttaaggagtgcatttttgcccgagaaaccaccaaccccagtcatcttcttctccattaaaaaagttgttgactaagtcacacgcaagaaaatgtgcaatagatcttgcattcttcacttctgttaaagaaaaatgacactaacaagatatatgaatagttattcaaatccaccatggggagtgacaacaaaatgagaaaaacaaaaccaaacaaaacatttgactacatatatcctctcctctttattctacacactctctaggaaagaaataatgaaccttcctctatgatctgcttgtgtttataattgatttatcttgtggttaaagagatttacttaccaaaattgagacagacaggagaatgtaattggggtttggcctcctggcctgcttgggtatcacttacgggaactgaaaataaaataattgaacacatattgtattctataaatcattacttcagaatgcaagacgagatctatcccttaggataaatttctatggatgtagcaagtgaatgtcatacatatatttatgagtctgctgacctggtgggatttaggaaaaacagcccttctctccccactctcccctgccccatgtccccctcacatcctccccatttctaattatttccttgctttcctcaaagccattgacccaccattgggccagtctgactaatgccaggaattctttaaattatctattcattcctttaacttacagctttgtttctcacttaacatctctattccctgtctaagattatgcatttcaatttctcatctgatccactttgataaggacacatttgtatctggtcatttgtcagacaaagatttaataaagttgtagaataatttctagaatgaggctcagatgagagatcctaagggtacagaaaacgaatgacaagttggtcctgaccttggtattttcccttccaccttttcctcctctccattagtacatctggtagacctcaaaggcctgtgtgtggctttcactcatccatatgtgtagacttgagcctgaagatttgaaacaaatgttgtgttctttaaggccaggctgtacctccacctcccctgggttctcccaggagtttcagcaccaaataaataccttctaatgggacttagcttaatttgccggcttgtctttcaacacacgtttttctgatatcagaggggtaggctggtggaaaactggatttctgatgggaacaaaacactctgaaatattaaatctgcctgattcttgaataattttcaagaaacatataaaatctctctgaaatcttcaagatatatcctcagcagaaagttacaagcctattgtgtattccacaaaaaagaaatctgtcttctaaatcataatgtaataataagctcattattaatcagcttaatttaaggattaatcagcacatatatattaagtaactggttctagccattgtgaaggtgcaaaagaaggcataagagagcagcagtgattgaacaggtattgtattctatgttattttttttctttctttttctttctttctttctttttttttttttttgagacagagtctcgccctgtggcccaggctggaatgcaatggcatgatctcggctcactgtagcctccgcctccccggttcaagctatttttctgcctcagcctcctgggttcaagcaattctcctgcctcagcctcccgagtagctggaattatagatgcctaccaccatacctgactaatttttgtatttttagtagaaatggagtttcaccatgttggccaggcgggtcttgaactcctgacctcaaatgatcagcccgtcttggcctcccaaaatgctaggattacaggcatgtaccaccatgcctggcctattgtatgatcttagtgaagcctcaccacacacccacacaatagattgatttttattttatagatgaagtagctgaggcttaggtaattccatggtcaatatggctaatcagcaagtgacatgcgtttgactccatgtctatctggctctggtctatccaccttccactccactgcactgcactgtgcaagcattaggaagtctactgaagttttctaagttggtgtacctaacagcttctgtctaactttgccagaaaggacagtcccactctgtgccttccacttcagatgaaagtgtgctgtggactgtgtgagaactttttttttcacaagaaacatggccatctgaagttttactcttaaacttgtaaaatacaggaactacaatctttcactttttttgtatgtatacggaaagagcttgagggagggggttcccagcctagaaggacatgtatttttttcttaactaacttttattttaggttcagggctagatttgcaggtttattatgtgggtaaacttgtataacatggatttgtcgtatagattattttgtcacccaggtactaagcttagtacccaatagttatttttctcttatcttctccctcttcccacccgacaccctcaagtaggacccagtgtctgttgctcccctctttgcgtccaagtgttctcatcatttacctcccacttataaatgagaatatggggtatttggttttctgttcctgccttagtttgctaaagatagtggcctctagctccaccattgtttctaggacatgcatttatttgaggctctttggaattccaactctcactgaaactttaataaaaaaattaatttagaccttcatgacaacagagaactacttaactcttacccatgccaacattaaacctaaatgtattgagccctataataccttacatttgtttccttttatttaacctcttagggggaacgtcatccagacagaaaggcttcctaggatgcattcgctccttacacttgaatggacagaaaatggacctggaagagagggcaaaggtcacatctggagtcaggccaggctgccccggccactgcagcagctacggcagcatctgccacaacgggggcaagtgtgtggagaagcacaatggctacctgtgtgattgcaccaattcaccttatgaagggcccttttgcaaaaaaggtaccttaggcgctcctgtttctcctgagtgcagtgctgtatcacctatacgctatggtcaggccatgtgatactcacactctgagacagtctttatcatctactctcccgctgtttagagagtctgcatagttcttcaacgtaattgcatatacttattggtattacatgtgttcactggcaatgtaactgaactggatggataattacaggaaaacaccctgcccacggccaaaaagtcagttaagtagagaaagaggtggacccacatttctgttgttagctagattgttagtgaacacattaatatttccacttccaatccctcagcccgcaaatgtaatcaaagaattgtagaatctagccctgggggagccttagagatacttaagccatcttaaattattttttacaacaaagagaatatcagtaaattagtaaacacagtaccgtgtatttggtgaaatctctctattccgcaggtgacttgagcgaatgtctgaggctttaaaagccctgtctgaaagttcatatttagttcattggtgggctgggactgaaacacacatgaaagtcaaattttctgctccaggacttttcctataccccttcacaatctcctgagttcattacattgacacaaattaataatcacggatatacaccttggacaaggaatgaggatcattgcttaaattctctagataaattcaagatacctcaagaaactagaaaatctcaatattcagtataaatacgtaggatttttcaaacataaggaaaaagatttggtgtactcataatttttgcaatattttaaagacggaaaaagtttgttcagtaaataatgtaaacaatattttaagagcagcatttaaattattaaaataaaatgcttgaatcactttgagacaccatttgcaaacaaacaatcagagcaatgataaataattcttctcaattcattaaagcatatcttcgaagcacctttacaaagcaatggtttatttagtccagcttgctactgttggaacttagaaacaaaagggaaaaaaagcactcactgttttatttgaaggatactatagtttgagccctccgttcattcatacaggggccttctcctgaattagtttgaattacttacttattattcctgaagagcatgtcatgcttcttgggagaaaattaatggtaaaaattttcgggctaaccgcatggaagcttaaaataaaacagtttccattccaggggctcatattatgagctaaacaagtaaagtgctgctaggtattcacactggcggaggtctctgaacaacttcccctgagaagtgtgaatgcttccctttgagccatcccacatgctaggaggagcacgaacagaataaatactatgagaccctggcactgaaatgcacaagcattcttctcagcatctctaaccaagtcttttgtttggaagaacatggacagtagacctctctgcatttctctggggacattattcaaagatctcgtagatcatattgttctaaatgtagcctaatttctttttttttttttttttttggctcctttctccaaaaccattcatactaattttcttctgtccacggccctgtatcttttccctgcatatgttgcaacatctctgtgctccctcccacttttaattatgatctgcaagttacataggcaagtgtgtgcctagccttttcatatgcttcgtattttactatttccaaactgttcattctttctgataattctaagaaaattatttcctctatatttagtcctcgcaatgtaagtaagatggcctttttagtcacatctttgagccctgccaactgcctctggggaatgtggccggaactgaaatgggaagccagtggctacaagatggttctgaacagagggtggtctgtttggtgattggggcagccttccatgctatttactatggcgcagtatatttcaaggagatggtgtgtaaatactgaatatatcttggatagaattagggtctttttttcattaccaattcctaggtcagaactgtgtttcattggcgatttttccgtttctcataatgatacgaagaagcaatcatcataaaaaataaactagtaattaactgcaacatatattcctcatccaaacaaatagagcaggtattaaaatctaaatttaacttattggggctcataaaggtggactgacttgctaaatgtcagatttggaggtccatctagcttgtttttggttcattttttctttatgaccctaatttcattctatacatgaacatggtaataggattccatcgtttcaaatacagagcttttgttttgtgtattttttctctctctttctattatcgagatgtaatttatataccataaaacccacccttttaaggtgtataattcagtgatgtttaggatattcacacagttgtataacaatcaccaccatcagtttcagaatattttcatcatctcaaaaagaaattccatgtcattagcagccacttcccagttacctcttcccgtgtccctggaaaccactaatctactttctttttctgtagatttgcccatcctgagcctttcatataaatagaaccatatagtatgtgatctttttgtgtctgatttcttttacttcgcataatattgtcccagttcatccatgttataacattcatcattactttattcctttttaattgccaaagagtgttgcgcagtgtgaaagcaccacagtttgtttatccattcatccattggtcagttaatggatgttgggatggtttcatttctttggctattatacataacactgctataaatatgtacaatttttgtgcaaacatatgttgtctatcctcttggatatatacctagaagtgagattgttgtgtcaaacggtaactataggtttaatctttttgaggaacttcctaactttttcaaatcggctgttccattttacattctcaccggcagtgaatgagggatccaatttcttcatcttcttgccaacactttttattgtctgattttttgatgatagacatcttactgaatatgaaatgctatcgcattgtggttttgacttgcattccctaatgactaatgatattggatatctttttcctgtgcttattgtccatttgtatacataaattttttggagaaatgtctaacatcttttgtagattttaaatttttcttctttttactagtcagttgtaataatttgtcgtatgtttggaatataattcccttatgagatatatgatttgcaaatgttttctccagttctatgggctgtattttgtcttcttcatagtatcttttgaaacactaaattttaaattctgatcaagttcattttctctagtctcctatcttttttatttatacatttaggatcatagataaggaagccttacttaatccaagatcatggtttctcctaagagttttatagttttagctctcacagttaggtctttgatgcattatgagtgaattttcatatttgttgtgaggtagggggtccagctttagtctttggcatgtggatatatccttgtctcaacaccatttgttgatgtgtgtttgttgttagctctcttatcccccctacacacacaccattaataaagaacttgggtaccactgtcatagtgttttaatttaaatgttttttcttcttaattaaaatgtaacataattatttataaaatttatttgaaaatttatttagaaatctagaaaagttaaaacccaatctaagtactcaaaaataatcattaatagggaattgcacttccttctagttttttatccccttgcacttaatataactaagataattttgcccattacattttatattctggattttctttatttcctttcaaaagcatttctatgtaagtcaccaatatttgtaagcatccatcttaatgattgcaatatgttccatctggtgctactaccttctcttgtttaatccatcctattaccagagcattactgctcacagataaatcgtggagctctggcaccacccctgctcaagttgaggttctggttcatctacagtccacgttgtatgacactggttgtgtacctcaacctcaagattccgtggtttcctcatctacgagatgtgggaagcgcaggactctttcacagggagtcgtgtttaacattcgatgagcactctacaaagaacatgggacagcccacagcatgtaaagtctcactaaatgctgactcttcttattgattgaaatttttcattatctaaaattttggtgtaaataatgctacaataaacacatatattgattattttcttaataacagaatttcagtgaaaaaaataaaagtatgtacatttgggtgctctttacatattgccaaaaacctgtccagaaatcatttaatacttatattcattttaatttataccatttatttttactttttattatggaaaaatggcaaacatatgctgtaggacagggaagagtttaagaactcccattcaccggttatctaacttcaacagttacaaactcatgatcatttttatttcatcggtacactcacctcctatcctcctcctttattattttgaagaaaatctcagatataatactatttcatctacaaatattacatcgtatattgctaaaagataagcactcatgataaacacgtagccacaggatcattattataataaaagtataataatttttgaaataattgctcagtgttcaaatttccagttgttttatttttatttaatttgtttgattttatctaaattaattacagcttggatgatttctggataatttctagactattcattacccaggactggtctttctgtttgttctaattccaaatctaattctactactattattaaaaccagctactgttcattgagttcctactatgtgctgtgcttttacgtactttcttccaatcctttcacccatcccaagactgaattcatcctgatttatatttgagtaatgtgagattgaatgggatcctgtgattgcaggacatgtgtagattcaggttttatctccaagtctacaggccccatggaggctcagagacgcaccttccagtaccatcccatttccagctccttctcctacttcatgtcacccatcaatgccctgtcaatacggagatcctcttgcaggtctcaggaggctctgctctcagagacatccagctctggaaaatattgtctctgtcgctaacacatcaagcccaaggttaacttccattggtccactggcaatttgttttgttttgtttttgtttgttgttttgttttgttttgtttgacagagtctcactctgtcacccaggctggagtgcaatggcgcaatctcagctcactgcaactcacgcctcctgggttcaagtgattctcctgtcttggcctccccagtagctggtattacaagcacctgccaacacacccagctaatttttgtatttttagtagaaatggggttttgccatgttggtcaggctggcccgaactcctgacctcgggtgatccacctacctcggcctcccaatgtgttgggattacaggtgtgagccactgtgcctggcccaggtgtttgttttttttaaaatatgtgtcttaccatctcagaatctagttagcataggttcttccaccaagtggatgctcaaggggtgttgttgatagtggctcggtggccttggagaatcatcatggtcactagaaatcacttgcaagttaaatatctttatcctttttggccagtggttttagatgctcagataactcaacccatctgatcaaaagcttaaactcttagattataaagtacaagaaactgaaagaataatagagtccagctgtattgctgaatttagctttatgataaaacagacaatatttaaatattaaaaataactagaactggggctggaggaagagtgacaacagaaatttggtttgacatttctaattacaaaatgcttttcattttcaatttattgtcttaagtataaagaaaaaagtaatatcctgtatatgcccatatctatgttattcctaacagaatgctctgaattttacttccatttaagcacacacacaaatatcaaataaaagtcctttattttgttaactaggaggcagtagctcaaaatgcagaccaaatatccctgagtaaatttactcaaggaaaattcttgaatcaagctgatgataaccagaattctcactgtcacagatgtctgctgcatatttttataaacaggagtaccaaggttgtaacctgcatgataaatgcaaaacactttctctgaacctttagtaaaaatgaactagtattctcaatctgctaggcaatatgcataaatatgcaactttaattttttggcactattacagactgttacagaattttcacaaggtggaacacatttgcaatagaattaggaagaaaaagccaggtattattatattgtaggtgccactaactcaatcagagactttcatggggaatttggaacattccatatgccatttagggcaaagggaaattaatcatgccaatatgggtttatgtttactgtgcagtttttatggcagaggtttgctgcctgatctaaggtgtgctgccctatgaaagagccttccccacacactctgttactgtatagagataaaatttaaagtgaactcaagagcagccttgatctaaggagagtatctcagcatttggacagatgaacatttaataaatgaatatattgtataaagtctattgggatggattcaggttaatttctcttctaacactctgtaagttcaaactgtacttggcaactctcttaagtgctttacatacatcagatcatatacatcagagaaatactgatgaggtaggtgttatgattcccattcatcagataagaaaacattctccacaaagttcattatcttgcctgggaccacatggccggcatgaaaccaagtgagactcagatccagtgctgagtcactcagtgctagttccactacactaacatggtaacagttggtgtgctagagcattcttcaaggaggctgggtgatttacatatcccactaaatgaattttatcagtttttagatcccgtatttcttcctggtggtggcagatctccattcagtgtgttatgctagagggattgtttcccataggaaagcctatttacccaagtcttggctatattttggaactgagtaccaatgcctacacagctaaaaaaatgagtttaagagttggagacctatgtcttttctactttgtccataaatttcttatttgctgttttcgttgttcttcatgatttaccaacatcatagagaattactgctgctcaccccaatgtcttgctctgtatttagagaccatccacaatctccctgagataccagagaagaacacaaactagaactgtcaggttctcagttttgggagtaagatggtgccagtgtatttctctatgcactatgctggaggcagagacatgttatctttgcttctcaggaaattagccaggcaagtggtcattattttgcagatgtatgtagagctggacttaaaccacaggaggaaaacctgagctttcttttctggctatgcaaccctgttcaaggtttgtaacctatgagagcattaagtttttcatttgtaaattaagaatagtgacttctgccacttcaaaattattgtggggaacatgttgtctgatgcatgtattactcctcacacagtgcccagtgcataggaaacgagaaagcagctaaggttagcttgaacaatggatctaaaggtttcaatgtgtgctctcccctcttatattttgcagaggtttctgctgtttttgaggctggcacgtcggttacttacatgtttcaagaaccctatcctgtgaccaagaatataagcctctcatcctcagctatttacacagattcagctccatccaaggaaaacattgcacttagctttgtgacaacccaggcacccagtcttttgctctttatcaattcttcttctcaggacttcgtggttgttctgctctgcaagaatggtgagtgtgatggcatgatacccagcggagtctcagcctgggctggagggacggtgcatgccctccagaactctgcataatttcaacctcaagttggtcccatctgggaagcttatttccagacttccagccaaatccttgattattctttacctttatgagatgcaattggtattcagggccagtgtcaattcactgctgaagtctcaaatgcattgactttaatttgcctcaactgaatagcagtaattctttattatttattctgtgctggaatccattaagtgcaaaggagaacatcataagcatatccgaatttcagaaggacacttgccacatgtattttgtcatctttgcttcagtcttctttactgagggctgttaaaacaatgagcatacatgcaggctgtattaatagaaggcaattgtccaggtcttagagagaagtagttagtatatgagtcataaccttggggaataggtggcttgcttctgggaatcaaatttctttttttcaggctttttttttaaagataatgacaaattgtggcatttgctattttgaaacagaaagatttggggcattttatttgacaaaactatagtactattgtttcacaaatcaaaatgctatcacttcctttatttttataattactcctacttgatacaaaattcacaaaaatacagggcaatattttcctaatgctaaataaaaggattattttttaaattttatttattatttaagcttcaagactagtgataaggtcaatatcatagtatctgaggaagggatcatttttcaatttgcatggtatctaataggttctagtgcctaaattgcccattattaatttaagcagtaggtgagaatcagatttttggaaagcatttggacaaaatgtaatacgagaagttgagagtgataagcaaggtggaatacacttcatgcaaggaatggtgaacgacaccacttaggatggctactgcgagttaaaattttcttctgatactgcttaattccaccctgcaaggatgactattcttgatatagtcatggcaggaacactattagatcaaaaacttatggggtagaacatacaacagtatgatataaaaaacactgtcctgtgatcaagaatacaactttcttccctttgtcatctgctggtatcataagatggggctgggccttggcagattctgcccaagccatgccactgagtttctgcacggacagtggtggaacctagcagaaaggaagcctggagtgtgccccatacacagagtcctctccaggccttatgaggaaactctaaattattatcttgctttattttttctttggtttattcctctttgattcatcttgctttccagctatttacagcatcaaaaaccatgaatgatgaatgggtgtaaagaaatgatcaaatgctgaatcaggcatgaagtgaaataatgatgatggaccacatgatgttaacaggtgtccttctttctaagataaaaatagaagggaaggaaaatagacagaaatagagactaggatgacaatggctcattctaagcccatctggacttgaagaatccacaagagagagggggaaacactatgggtaattagatctgtttatcaatagccctttatgtgattatgattaggaccattctatcaacatagcaggtcttagactctgcccatcagggctttgtgagggtgataaagctgactgaggacactgaggcatggagaagttcagtaggtgggcgtgccaacgaggtaatctatggcacagtggggaccagaatgcaggtttcccaatagtcagccagcagcctccgttctaaacaatatcatcctctaatgatgtcattggaccatagtaagatggttggttacaaccaatgcgagattttttccaaagcatcttttgggtatagttccataggcacaattgtacctgtcaggccatgcctagggaaatacagctgccatgaagacagacagtgcataatgaatataattgtatcaaattgcacacacatatacacacacacacacacaaatatatataactctatactgagcactattttaattaatccacacaacatttacttctcatcacaaccctgtttgattgatttattgtagaaactgaggcacttcaaaatctcacagcaagtaagaagcagagctggattcaccctcccttcctcagtctggtggcatattctgtattcttaaccacaagggctaaactaagagtgtttttaaaatgcacaatgttttaaataatgtgaatctatttcattgagaaagcattcttgaattctaccctgcccctatctttttacatcctgaggtcttactctattaaaagctgcctgatcccataggcatctgcatgttttaaagtcctggctacatgcaggaatcaagaaggtacttgtgccttgtttgtatgattgtttaagtttaggtctcagggcatgtgtgaaagttcaggtatgagtcctgagccaaatatgagtgaccatggcctgtgacacagtcctcaggaggtcctgagaacatgcgcccaaggtggtcaaggtacagcttggttttatatattttatatattttagttagctcaggctaactcatgggagatggatgtccaggacattgttgttaatagagtgtccgccttccccactccagcttggaacacccccaccacaccttgctccagggaacccatagcagtaggtagtgggaaagataccctgatttagaatcctggacatctcttgccatctccttatactgcagagatacaactaagatatgtgctcaatcattcattttttattaactctgtgggtaattactagtcaaactgcacagtatcaggaactgtgaagataagaaaagaaatgcaggactaagtgctgtctaaaggagataaggaatgagagactaaaaaatctgccttcaactttttgaaaggcaatctagatagaggaagcagtcatgtttcccacatttctacagcaatctaactagaagggagactttgactaaattttaaaatgaatcttctaaaaattcagggattataacagtggaataaagtaccttgagtggtagtgaattctttgccattggaggtcctcaaataataatgcatgactatttgttggagaaaccataataactatcacaggagtagatgagaggaaaaaataataacctctgagtttcttcccaagtcttagattttgtgattctttattcccttcttgtgtagtcttacattaatatttctttctgttaaggcttcatttgcagactttgaaatgctgctttgaggaataaagaatcgatattcttacagcttgttcccagtatgtttgttctattaggccattgacctaattaccagagaatcatggggggtgagaattgcattataaagaactgggaatattttaatgtgactttgatacactgtcgtgaaaaaaaaatacctgtgaaaatactagtgggagttaaggtttattagaggttgcaaaaagatcagaaaaccacagggtttaaagggggaggttatttattatctgtgagagtttttatgataagattgattcaaacctccctgagaagaactgagagtcttctgttagtctagctgtcttaacctttgtgactgaagatagccttgggaatctggtggaaattataagagggccactcttacagggagcccattttgctttctccaaataaaatcaagtatccgcctccaggttgtgcacaatggctctaattttagcactctgggttaagaagtcagcaggtggagtaaggtggatgagttgcataaacactgcacacaattctcagcttgcaaatttatttaatatagttgaacgggccagaggaaagaagatcaacgtgattcaaagtcatggttataagtctctccctggcaggggtttgattttccagggttggaattcttctgtgccctttatcattattcttgaaatttctccaactagagaatcattctggttaaactgctgctatcttttcaaaggaaaacaggtacttcttcctaaacaaaaagaaattagtttaatttctggaatggaagaacagaggcagaaagagagacattttgaggtcacagagttgttaggaaagagaaggcagttttagttctataacctagggctgtggccacagacaacttctctgagtctggacggttggaggagaaagggtcttgaagacaggaaaagggtacagaaagggagatgagctcattctcaagatacacaggactttcacagaattttatttagtgatggctttgccttctccacagtagtggggatttctctttcaaatttgcaactcagaaaatattcatggggcacttaccatgtggcagatactagctcatgtactgaagagacaaagacagatagaaaggatccttccctggctttaagaaatctaactggccaggcgcggtggctcacacctgtaatcccagcactttgggaggccgaggctggcagatcacgaggtcaggagatcgagatcatcctggctaacacggtgaaaactcatctctacaaaaaattagccaggcatggtggcgggtgcctttagtcccagctactcgggaggctgaggcaggagaatgatgtgaacccgggaggtggagcttgcagtgagccgagatcacgccactgcactccaggctgggcgacagagcaagactccttcaaaaaaaaaaaaaaagaagtctagttatgggacagaaacatagttaaaaaaacgaatgtcatcgatgctaggtagaagtctgttctaggtagaatgagttaaagatgatcaattctctctgggagagaaggtcagaaaaggcttcctagagagggtgatgcttgagttggtcatgaaagataaattagtgttctccagcagacattatattttttcacgaaaataaagattatttttgattgttcctcattttctccattttattcacattgcagttgaaatctatatatgtgttatgatcaatttctgtttctattcttccatcatcttctttgttgatagaaatgcaaagtcaaatttagaatatgcactaactctagggctatccatctatggtgaaatcctttgggtacacaatccaaatatggttcccagatcaccttctggggaggctgtgcagctgccctccagcaccaaatggtttgtctgactttgcttcaggatttcctttttatcaatctttttttaagcatatgcattcaaaagatgcactgtctgcatttgtgattgcacacaccttggaaggaataatgatgaactgcgacattttatattttgagcacactaactcaagggaggcaagaataagaaggaagccagggagggagcattttcaaaacacaaaactcggcagtggctagccagggctgggttgaccttagaacatcccctgccattcctgctatcttatggaagcccttcaaagtgtaatgctgcctccacatagcccctccctgacaccagcatatgcttgatttcctcagagcagcaagaatcctgataaacagaaggggaaaagcaagccttggaaggattattttgacagcataactaagccctgaccacttcagtctctgggcttgtgtcaagtaacactttgctgattttgaatttaaaattcccagtagtcttttgctatctcccagactttgttttagttgtttcattccctacatttctgtgctttccaacaatctcttgtactttcatcatccatttcacagtaatgaggttatgagacactgtgacctctagagggcgataaagagtcctcctggtcactttctcctagggaaggtcaatggatgataagggcaggacagagggcacttccattatcacagggttagacttgggtggtaagggtgggcctgactggagaaacagtggcatgcttagtagcactggatctggttaatctttcttgtttctcttctctttgttgttgtttatgctttattttctgatatgctcctaagtcccaagaagattgctatgaactgagttgtgaaccacccccttcccaaaatccatgaccctcagtgtagctgtatttggagtaacagggtaattaggttaaatgaaattataagatcggagccctaatccgacaggattagtgtccttaaagcaggagacactagagaactctgtctcctgctctctctttgaatgccatgtgaggacactgagaaggcggccatccacaagccaggaaaagagccctcaacagggaccgagtcagccagcacttgtgtttgtatttcccagcctccagaagtttgagaaaataaattgtgttgtctgagtcactcactcagtctatgacattttattgtagccaactgagccaactttgcaactcattgacaaaggtcaaatgagatgatgcaagtaactatgctgtgtagattgtaaactataaaacacactttatttccttattggtaaaagtaataatatgaatgatctgcatcctggggttatcagagcatgaatgtgaaggctagaatttggggaatttggggttaaaaattaatactcctctttgtatgaaatactctttgtatgaaatactcttaaaaattaatactcctctttgtatgaaatactcctctttgtaatgaaaatgtgcagtgcgtagaggcagaacacttgggcctggaagggacattaccctgaagaaggagaaagataaggtacagggtgtcctcttgaaaaccggctgtctctagtcacaggaaacagattttaatatacacaagcatgaaaacgaaaccttttaagaatgactttctcaattgccccctgacacagaccttcagggaacttccctgatgtctctaaaatagagaggggtgtgtgtgtgtgtatatagagagagagctataataactaagaaacagagttatgtgtagaactaactaacaaagacttctgctcactgcagtgctagtccttgcacaatacacctggggcaacatagtcaaacacaaggaaactccccacctcaaccccaacaactttggctgtggagctagctgggcagcatgtgccagcatcaaagaaaatcaaaatagagacaatagcagcttctaagtcagtcctctaagaccctcagaaaagagctagtatggaaataaagccaacaaatatgtcaaaatacaatcaactctacaaacatctgtttaatacctactgtctcagtttgccagggctgccaaaacaaaataccacagactgaatgacataaacaacaacaatttattttctaacagttctagagactggaagtccaagttcaaggtactggcagtgttggcgtctgttgaggaccctgcctttgtgttggccacctttccctgtgtgctcacatgatctttcctcgtgaatgaggagaaagggagagagagacagaggggctttgctggtgtctcttcttataaggacactaatcctataggatgagaggcccaccctaataacttcatttaccctgaattactttgttagaggcctcctttccgaatacagccacactagagttagtcttcaacatatgaatcttgtggagacacaaacatttattctataatacctgccatgtgctagatgctgttccatgtgctcatggtagaaaaataagtatggtgtagttggcttcagaaagattcttggggttaagattaatatacaattcatctttgtaacgtcagtgtgaggcagagtaacttagcacatagttcacctctgattattcttggatttaattaatgtattttgaatctagtaggaggagaagttacatatacagtgagaggggaaatgccctatagaatccataagatgttataggatgacagtggggccatattggggaaagggggtagctcttcctggtgcatttcaaaagtcttctagtataaataggcatgaatatacattgcattaattgagttcttaatcatattctttttgagattctgtcctgccacctgtgatgtatgtgtgggaggcagggttgcttggggagtgggtctctgtagagctggcattctgtggctctacgttctcacagcctctgggtcttctcactttgtactttcccagtttaaacgactcttcagaaattttccaataattgagcaactgctggttttttcagcaatgctggttgcttacagctgtactgtgagaatcagaataattattatttgcccttatgatgcttcattgtttatagaaagaaaaaaggagtgcacaaagtgccttggttcttcatctgtaaatgtgggataatcttgttggtcaagggtctcacagccgtgtggtggggcattaatgagatcctgtctgtaaagggcttggagaaactcacttgaaagatgtggcataaatacaaagaagggttattacaaaacagaccaaagaacaggctagttactgaactacctttattttactttttttttttttttaagccagggataaagaaaatgggagattgaatgtttagcttttggactggaactctaattagaggtttaaggattaagaaaatagttggagtcagtgtgaagaagcttttctcagagaaaagacatgtttttattcttcttagagcacttgacctgtaaatacttacatcttgagatgtgaaacaaattcaatgaaaggcctgagctcagggcttattcggttctctgtgcagttaattaccttttgtccagcaaggaggccttgaattatcattatttctcctaattcaaagtcattgaagatatgtctccactgtaataagtagtttgacctctcgatgttaagaaataaggactctgactgtcggatgccctgttctaaatctgcagtggaaagatgggtcgggggatagtttccagccttaagaatccagttcaaattcctaacaccagccatatgccactgtctttgatctttcagctagaaaatatttcctagcagctaatacctatcaagtgctgagtatgtgccaaggcatagttttcgtagtttgcaaacattaattcatctcattctcacacaatgactatggagtcggtactagtatttccctattttacagacaaggaaattttggcctagaaaggttaaatgacttgtccaagaagacacagcaagggatcagtggggctggaaatcaaagcccattatatttactttttaacttataaactcttctgctttgttctctgacgtttcatggtactgtgtgtacttctctcaaggaacctgccatgtttttctggatgcttgctcaagcccccatccaggttgtattcttgtctaggaatgccacatttacttcctgtgcaccccaccaccacgtcttgcttgtagatcttcattcaagagaggggccaggcagaaataatggggtaatatatcaggagtgctaaaacaccactggaagatttagaaacacaatgccagtgaaggaacttgccacagatctcctgatatttagcaatttgtactttgatgcacaaggaagcacacaggactaacaagtcaagaaaaaaataccatgcctttattggtgtcagtttctgtaatgcaagtttcaggatgcagcaagagcctccagctccgatacccaccagccaaatcccacagccactgtcaactgaaatgctgtagtggaatagcacacaggggagtgctactttcttggaacaagtgattttaaagtattaatagggctccccaggattttttattttttggtcagaaaaattacatgtgataaatgtatgttctcatttaaacatgaagaatgaatgtgcagatttattatctctcccttcttaaactccttcaaaatgacataaagcaggccaggcacggtggctcatgcttgtaatctcagtacttcaggaggccgaggtcaggagttcgagaccagcctggccaacatggtgaaactccgtctctactaaaaatacaagaatttgtcgggcgtgatggtgcatgcctgtagtcccagctactcagaaggctgaggcagagtaatggcttgaacctgggaggcagacgttgcagcgagccaagattgcaccagggcactccagcctgggtgacagagagagacttggtccaaaaaaaaaaaaaaagacaaagcaatcaaataactttttattttattttagaagtaggaaactgaaaagacaaagacaacagaagggaatttagtatgagtgaaaaatatgaactcactgtgggaaattggagagcagataaaggaggaaggctgcctctgccccaatgtttgctgaacagttttcctgttcaggctaatatgcaagttctttttcacttccatcccaggcttattctttagcatatagaagttgaaccaaagattgtccaaagctgaaggcaaggtgaagatactgggctaaatacggaaataaaggactgtctgcacactgggctatgggatccctagccttattttgtggccctgttcccagagctcttatggtaagactttttttttttctctatactggagataagagtccttgaccatggaagaactgaacagccccatgaaaaacatgtgtgataactggaattatagaaatgtcccctcattgaaaaaaatactttacccatatgatcaccagacagtaaagcccatctactggcctgcgtagctccttcacttgggaacttcagtccaatttgtagtgcctcagtcataagtgtgaacaaataaccaaggctactcagtactttcaccagccttccaagacaaaagatgacaatgaaagcatacaaataaaggtaatggagaaacagaggtgatgcaagagacacaagaaacatcaacaacataatatcttcagctagataggataatatataaacccataaaacaataatatggtatttatttatttatttatttatttatttatttatttatttattaagaaacggagtctctctctcgcccaggctgcagtgcagtgccatgatcatagctcactgcagcctcaaactcctggactcaagggatcctcctgcttcagcctcctgcgtgtctgggaatatagctgcaagccactctgcccggctgggaacatgatctttaaaaaaaaacctggcaaacaatgagaaataacttttggaaatgtgatagagaaatttgttaaaaaatctagaaagatgggagataaaatctgagaaatctcctagcaagttgaataaaaattaaaaaagtgggcaatcaaaaacaaagaagaaaatcagagggtcaaaatgtaatgtccaatatctaatagtatttacagaaagagagaataaatgtggaggaggtgttagcaaagatataattgaaaatattttatagaataaaactgatgtaaaagtttgttctcttacccagcacagtgcatagaaaacggcacacacaaaggcaaaggcaaaatcctaaatctcctaaagatagatgaatcaggagtcagacagatatggaacttctgaagaaaaacactggccatttgcagatagtggaaaaacaccacagttctaagcggaaatggtttgcgaactggaatcctatgtttagtcaaattatcagtcatgtgtaatgtcgttattgaagacttcctaaatatctttcctgggactctacttgatatgcatgcattcattatctgatattgcataaaaactaccaccaaacttagcaccttaacgcaacacacatttatcaccttatatagttctgggagaggtcaggaatctcagcctggtttaactggatgattccagctcttggtgtctccgaggtcaaactgttgtcctgggcaaagagcttgataatctgcttccaagctccctcgtgtggctgttgacaggagatttcaggttcttgacaggctggttttttaatagcgctgcttaaacagcatgtcatctggcttccccagatacagtggagggcagggggaaagggtatagagggaggacacaggaggacagttaaaacagaaattaaagtcttttagaaccttaactggagaagggatgcctagtccaacctgggagagaattacacaagggtgtgaataccaggaggcagggattattggatgccatcatgaagattgcctgtcacaacgtggttcacccaattaaagaagtatataaaaaagaaagacatgagatccaggaaacagagaacccaccacagaacaggccaggtatttcgggatagcagctatgcagaaggcacagagaaaaaccagtctgggtcaatggttctcagctgggcatgctattgccctcccagatcctctgggagggtgcatttaacaatacacagagacatttttcattgtcaagatgggactgctacaggtatgcagtgagtgggagtgagggatgcggcaaaacatctgtaaaaccaggatagccccccgatgaagaattatttggtccagaatgttaagaattttaaagttgaggaaaccaaatctataggcgtagaatgagatacaagaaaacaggccatttggaaggaggatcctagaaaagtctgcaagtaacaaataccagctttatcacttgcatgcatatatcagacaaacaataaggactttgaaaaccaacctcaccaaaatggtgatagacctatacagaaagcatgacagggaatcttatgtgactgggtctcagaaagacagctccttatttacaaatgtgggtgggcaaaagattatatctaaaatggataaatcaagaaataacaacatatttagtaaaatagagttaaaaataagaagagtaatggaactaaaataactgcatgtgaggaggaaggcgagagggtggggcaacagctgctttcttatgttcagttattctatactatttgactttataaatgtattacttcgataaaaaattgaatgcttcaaataaatctattgttagattataaagaaagttgtttacagttttgttaaaagaaaattagtttttttccctaccaataaatatgtataaatatctaaaggatattggctgaagacacataagatgactatgtggacagtggcacacatgcccctttttgatgttttcagttaatgtagttattcaatgagtgaatgaaggaatgaatgaacaatgcatgatgaaataattaaattgaaaacaggtcaggcgcggtggctcatgcctgtaatcccatcactttaggaggcggggggggtggatcacctgaaatcaggagttcgagaccagcctggccaacatggaaaaaccccatctgtactaaaaatacaaaaagttagctgggcgtggtgtcaggcacctgtaatcccagctactcaggaggctgaggcaggagaatcgcttgaacccgggaggcagaggttgcagagagtcaaaattgtgccaccgcactccagcctgggcaaaaagaccaaacctccatctcaaaaaatatatatatatatattttttataatatatataaaatttatatttatatattatataatatataatttatatttatatattatataatatataatttatatttatatattatataatatataatttatatttatatattatataatatataatttatatttatatattatataatatataatttatatttatatattatataatatataaataatatatgtatttataatacataagtatatataaaacaaatgattctaccctttttttaatggtaaagcacattttatttaaatagttcatgctaaggctagtaagaagctcctcattgccagatctggttcaggccttaatctccatgagctacctagagcacacatatggaaaccaaaaataaaatttgaagtcccccaaccccccagtgatcagagtggaatccctcctttatggcagagcactccaaagttaacttcaagaactggtttaggccatgacaggaaaggggcggttggacatactgcattataccctccccacttttggaattcaggaaaagtcaactagcatttgacatcaacccagaccttaaatctcataagaaatatttgcaatctattctctctaaatccagccacctggaggcttcatctgcatgataaagctttggtttccacaacgtcttatcataactcagacattcctttctattgatattaactctttcaaacagtctgaaaaattgtagatctacctataacctggaagccccatctttgagttgtcttgcctttctggaccaaaccaatggttatcttaaatgtatatgattgatgtcccatatctccctaaaatgtataaaaccaagttgcaccccaatcaccttgggcccatgttctcagggtctcctgagggctgtgctgtgtcgtgatctatgatcactcatatttcactcagaataaatctcttcaaatattttacagagtttgacttttcattgacacatgcccttacaagagcattggagctttcttggccacttctcagtcttctggatgaacaccttgtcctgagcctaccctttaaatgttgactttttgtgtcagctctgggttttttttgctttttttgtttttgtttttgtttttttgtgatggagtcttgctctgtcgcccaggctggagtgcagtggtgtgatctcggctcactgcaagctccacctcctgggttcacgccattttcctgcctcagcctcccgagtagctgggactataggtgcccgccaccatgtccggttaatttttttgtatttttagtagagacagggtttcaccattttagccaggatggtctcgatctcctgacctcgtgatccacccaccttggcctcccaaaatgctgggattacaggcatgagccaccgtgcctggcctgttttttttttctttttttttctttttttgaagaaaagatataccctcactgagctaactcatccattcccatttccaaaacttcagctggttactgtatcctgatgaacccaaatctatatgcctagcttgggtagatctatttggccttaaaagaattgtctcaattacttacaggggcaactttacttggttgtcccctaggcctctaaaactcaacacttcacaaaatgaactcaagctctacctcaacacctccccaccactccaactcctcagctagatctgcttctgcttgattttttcttttttcagggaaatgttctacattcaccaaaatgtccatgtcagaaacaagcatcactcttcttttcctctttctcacccctctggagtccatcaaacaccacactttactgaatatacttatattgcatgtggcatagctgcttccacagtctctttaaatctattcaattctttatacaaagatagctttggctatctttgttctggccaccctaatcttggaattagattactgccacggagttcaaattcttctcccaacctctaggcctgtacccttttaattcattctccattctgaccagggtgatcttttaaaaattcaaatatattcatgtcacttattttttgatagcttcccattgcctgcaggttcacctctaaactctcctcaatcccaggctcttgttattctctgaagtttccttttttttttatgattcttacaccccactatactctctgtctatattaagttgtgctcagatgattggatgcatcatgttctgtccttcctctaggtctttgcacattttcttacctttgctcgaatcctctttttttttttttcctgcctccattccctccttgctggaaattctaatttctccaagttttggttccatgtcactttctctgggaagctttcctggtcccctcccaaagactgcattaagagcccttcaactgagctttctgtatcagtctattacagaaattgtcacaagcactgttcacttgtatccactgctatgatctgaattccaggactcagcactcctggcctagcacaatgtgggggcccagtgtctacaggcgataaatactccaccattgtggacaacttttcttagtgaaattgcttaagagcttcttttaaaaatagggcatttttttttcaagcaaaagatccttttttacaagcatatactaatggttcatcttcaaaagagttcactggcatatctttgttgtgcactaaagcacagtgaagaaagaaaaagaagaaattaaattggctaacaaccttgcttaaaagcacagaaataaaatgagagtaaaacttaaaaaagttgcagataataaaaatggattgcactcttcttcttatttctaattttgatagatatttttcttctcaaagggtctgagagaaaaatatcttaaaagggaggcaatttaaaacaggcaaaatattgcattaaaacaaagagaggggaaaaacgtgatcaagtcatcagctccgtaatgctaatactgttggttttcaggtgtttgaattgcccaccttaggtggggcctctaaaaagacaaatgagattagagatgaagtgcctgctagtctaaatgaaagcacaacaatgaaaatcaaagaaacagcacacttaattcccctctgacgttcctgatttccagctctccgtagcaataactaagtaagcctgggtgtccagcaacataggccatcgacatttgtcagaattttcaataaactggcaatgaaagactaaatccatgcaaggtgggagatgaattagcacatagccaaaggtactggaggaataagcactggtttcatagctgaaatattttttgataaagtaataatcctcggtaatctctctccagctttaaataacagccagtctttgtgccggcagtttaattttgttggctgcccttgtcttacaaatatatttagtggagtctggaatatcattttgtgctgaaagctgaaggctttgtcatgctgaagccaggcagaggcaataaatcaaggacaaagtgaaaaggaatagaaatgggctatcggaaacttatttccccagagcggccgagctttcgtctcatgctagcaggtgtattgcatcagtcatgtcttcctgttaagtgcctatgttgtaatgatattgacttacaactacattgcaccctggttggcattgctccgaagtgcttaagatgcatctatgggaaatacatgctgaaaatagcgtcatgaaaatatacaactccagttttcttttctttcttttttttttcttttcctcctctaagatcattcttcccaggaaatgggatttaggtaacttccccaagtcacaccatttgtacatggaaaggtgtataactgaataattttatcctccagtaagaactgtgctgggacacgatattcaacttcagcttcttccactaatttcctcatttgtgtctaatcaattaataaatgacgttttaaaggtaagggaccactataaacttaaaatgatgaaaccaggactaatgttcttcaagatctgtgtttgccaaattggtcattactgagaatggattgtggagaaagaatatttaagtgtttataggggtctgtgtcttaccgttagcaatataaatgaataaaaatcactatactaggaagccggggagctgggttcttgtattagttttctattgttgagtaatacttctacaaatgtgctggattagaagagcaaacgtttcttatctcacagttcccttgggtcaagagtccaatcaccatttgtctgtgtgctctattcaggggctcacaggctacaatcaaggtatcagctgggatgtggtctcatcagaggctcccctgggaaaagttctgtttccaagctccattaggttgttggaagaactcagtttcttgtagttttggttcctattttctttctgggctgccatccagtctctgttcccacctcccaaaggccacgaaagttccttgtggcactccctattggccttgcagcttactttttttttttttttttttttgagacagagtctcgcttttgttgcccaggctggagtgcaatggcacaacctcagctcactgcaacctccatctctggggttcaagtgattcttctgcctcagcctgctgagtagctgggattacaggtgcccactgccacacctggctaatttttgtatttttaatagagaagaggtttcaccatgttggtcaggctggtcttgaactcctgacctcaggtgatccacccgcctcagcctcccaaagtgccaggattacaagcatgagccaccgtgcatggctgcagcttgcttttttaagccagcaaaagaaagcaaatatatgtatgtatggatgagtcttttaatgtaattacagagaggatattctatcacttttgcaatgtaatgtaacctaatcatgcgaatgatatcacatcatcgttgccatattctatgtgtttaaagcaagtcacaagtctcaactacactcagaagttggggttctatgtggggtgtaaacatgagggccaccctagggtgtttctcccacataagtagtccttattattattaaaaactagatactcatatatttgctgtaagcagcaagaatgaatgacttatattaacactaaacaaaattgataaatctcacaaagttaatgttgaaaaaaacagacttaagaaaggcacattctctatacattcattttatataaatttttaaaacatgctaaattaatctgtgctcttagaataatgttaactttggaggtagggagaatgagggaatgcaaggggatttatacggtgatagaatgttctgtctcctaaagtagatgcattccatttgtaaaagcatatggagcatggagtattatatttatttgcacttttatagacataagtacaattattccttatacttcaaaaaaaaagtaaaacaacacaacacacaaaaaaaaacaaaagccctgagttaacttagaatagatgcttaatttctctggctctcagttttctaatctataccatgaggttggtcttgatgatgtttaagtctattctaacagattatagctagagttgtataaagtcttgagaggctataaaactcattggatgattctgaagagctcaggagtcatcgtgtcccagcacagttcttactggaggataaaattattcagttacacgtctttccatgtacaaatagtgtgacttgaggaagttacctaacccccaatgcacttttgttttcttgaggccttattcagctcaaaacatatctatactctactaatttggcaacaccttctgactaggcacctatgttataaccagggtggagagcaggcagtggtgggtgaatctggcctgggggtaaataaaaaggaggtgcattgcagataattttaaaacaataataaaactgagtgcaaatgggccggtcttgtgttaccaccatgtaactgcctttctagacaacgttagccaccgacacattctcacacactgcagcggacagttccaccactgccccgtgttttcacttggcaattgtgctaaactcatataaagcactggctgcagatatagctaagatgtgacactctatgctgggatatatgacatggaagctgagggatatgtgcacacccacctaacagtgcgttcacaccaagaccctcttcaaagagaggtctggatattcagaaacatactatattttagcctcacttgtccctcagcttcctcctccaagccccactgagcaaccatgatccctggaagtattaggtaactggctcccagaattgcttgcttgaggccaagagttcaagaccagcctgggaaacaaagagagacccccgcctttacaaaaataaaaataaaataagcttggcatggtgacatgtgactgtaggttgtcccagctacttgggaggcagaggtgagaggatgacttgagcccaaggggggtttgcatggctacagtgaggtacaattgcactactgcactccattctggacaacagtatgagaacctgtctcttaaaaaaaatacatctccaatttagtacctcttgattatcccttcacttatagcttcaagacaaattctgaatccaagcactgctgaccacctcacccctgcaggctgccatctcctcccccactttccactccatccgctcctgtagccacaagcctcttcccaggccccctgccctctcctctggactgcagtagtctcttctccatagggcacccagagctatccattcacagcatgagagaccaactgcatttctcctctcaaacctggatctagcaggcagtacacaatctggcccttaaagttgatcccagacttttttcacctactgtcataggcctggctcatcgaccttctcattatttctaggatgtgcccagcaggccactgttttgggttttacactaactttctctatgtgcaaacccatttagctcagtttcatgtagatcccttgtctgggccctacatgtcaccttgtctggcagtctttccctgaccacaggctgccatttgaggaacccaaggagtggggcttatagagaccatgccatctccaaatcagccccaaccttcactctctgccttctacttggcttggtgtttcttcatcagcttgttatctggaattatattcttaatttatttgtttgttgcctgtcatccaaaccttaatgtaagctttggagggcacagatgttgtcctttgtagctaggatggagtttagcacagagtagatattcactacagtattcagttgactgaatgattgaaagtctggtttagcttttacattagtcatattgaattttcactaccacttaggactcctatttctgtttggtaaaatttttccagcaaataacatggcagtatgggtcggtttgaccccatgacctgagctttgttgggaattttaatcatctgtcatcataatttcatcaaaattttcttataaaaaatgagtaaacaactggtgatgctgttaatggagcacctacatgaaagcaacgttcaggccactgtgaaattaacattatcttcaaataatagttggtcagtggagcctgctgggctgagatgtgtttgaatgatttcatcctttagcttcagggctgaaattaagaaccaggttagaccactcaaagttaaaggaaagaaacaagagcagaagggaaaggaggtccaggaagccagaacaccaaaaactgtaagaaaaaacagacattgagaaatagagagtctgggacaaaagaataaaagcagagaaaatatccaggcctcgatgccatatgtccctcaggctttcccatcagctgctcagttactgtgtgtctctttcttaaagtttcttcccttggaccccatgctttctccatgtaggctctgccttacttcctgttgcagcattttagcctggttggtgaaattgcatatcaacttaaggctctagagccacacagctatttgatttgcagaacaacatgtaagggagaagattctctcccttgcagaaatgggccagacctggacaaacaaatagaacttccatgagtgtgcattgttttttctttccttactctggtcttactacacacccagagtcaagctgttatctattgtaagttatattaagcctttagtctgtttttttgtttgccgggaaggtagatgtgatgtcaaacatttgaggcattttgaaagtctcagaatattaggagattttatcatcataataattggggattgaatccatttacagtaaatgtcccagtactactggcccattctatcacacattgagagaatgatggttttccactccataatgatatctaaaccacaatttgatctgtgacccagaagaagggacctgctctccctcaccagttgcttcctaatccctctcctcaggtgaggtggaaaggaaggggaaaaaaaaaacaataaaaatgcagcgaatttaggagaaatagaagaaggaaatgacacaaaggaaaggggggggagaaagaaagcaaaagagaagcaaacattaaataggtacaatccaaaaatcctatcagtggagttcttgtatcagtggagttcttgagttgatgggcttctagtttcaattatttgtaatcttctcttaaatatggtagtccctcatatttattcaacaagtcattatgcgcattatctctttggatctgtataccatgcctgtattaatctgatttgctgtcatagctgacaaatcccaaatctcagtagcttgtaataatattatatgccacttactttcacattatatctcactggctgtgggttagcttctgtgattttgttccatgcagtttttcattcaaagcccccggttgaagcaataactctatttaggattttctatttctcaagatagaagaaaagagtgaacaaacttgtggaaatatgcagtggttctcacagtttgtgctcacaggctctttgtcaaaggaagttggagggttattcccaacatcgccaggcaggaaaccatgcagttcccacaaggtatggccggtctcatggccataagccagggtgtgtaattaccttttataggaaaagtaaatatgtatctgggaacaataatacaacctacattaataccagagtaagttaataaggcttgtgggcccactccacttaccgataagaaaagagagggacagaaaactaaggagaaaaagagcctgacctagatctcaggttatgtaatttccagataattgatatggcctttctatccactttctttccctcccctacttgcattttcttttacactaaggtagcactgctcaaacggcagcaggcaccagaatcacctgaaagactccttgaaacacagatgactggaactcactttcagaatttctgatttgttatgtctggcatagggctttttaaaaaagttttctttttaagcaagttcctagctagtgttgaggatgttgatcctgggaccacactttgaaaaccaccgctttaaggtccatctccagagtagagtgcaatgtacaactgttccaattacctattttttttagcctttttgtagaataagtgaacagcgacttcagtgaattggttctgtaactttaacagctccactcgatcttaggagaggctatagcagccccacagtagtagctctccaagtgtgatccctggacctacagtaccagcattgcctgggtatgtgttggaaatgcacatcattgactctgctccagaactactgactcccaatttctggggatggggcaaagccctctgtgttttacgcagtcctccagatgattctgatgtatgctcaattttgagaaatgtggtttggtcctacagctagactgcaacaccatggtgaggtcttcaggacttgtttgctacatgcctgctgcttgctagaaatgaaagctctcaggtcccatcctatatttactgactgatcttcatgttgtggggtttcttcttgcagagcccctagtctctgccacattacccagccatttagtccatttattacaactgactgtctgcttgactttcagttataattttacccctgaatgatccttggttctgtgctctgtagcctcaggacttatattcctgctcatttccctggccaatattagaaccttactccaggtgtagcttatcagccctcttggaagggggttggtgtgaggatgcttagacagggttgatgtgagagcctctatttctcatgatttgtatttttccattaaaattcttcaccttccttcattacaaccttgtcttaactcttgccctcattctttgagactagctttatggacaattttaaccagtgtattaaaaacataattacagtcatactattgtgtatttatgaaacacaaatcatctaatcagctgattgcctttgcatgagttgttcatgagaaaacatgatgcaattaccagtccccttccaacgagatgtactattgccattttaaaaaagcatttctacatccagaagtcatttagtcttttctttaaataaagtaaaaaaacaaggctgcagacaatgaaatgagagaaacagatcgacatctctaatgattctaggcaaactctgagtcatttcacttcagatctgtgatgtttatacagcaaatgcagatgttatgtttactcactgcagagcatttcctgaaagtcttggcttgcatggaaaactttcatggggtattcttttagacagtgtatgtcttgctagctgagaaaaattttaaagaaaaaaaacttgacctcagaggatattgacgtagaggtatctgaggttaaaatgtcagaaggaagacctttgggaacatgtgaatatttcccgagtcccaactctaccaatgtgtgaccatcatcactgaaatttggtcatatggaggtgcataaggcatgtttcttgtcttcaacgagctcatagtcttgcaaaatacaaacaacacagagaaaaaatgaaatgttttatcataaatgctgtgattagtgcaaccaataatttatcaccaaagcaggcattcacacaacaggtatactttgtagctgttcctggcacaccgcttatatggtcactctagttacagttgataagtgcagatatgaagtaggcttagaacggacatttccttgtgggatgattctgggaaagctacctaagacaccagatctagtgcttattgaactaatatttcattgtcctgttgatctttagagccattcactatatatttacaaactatcgtgttggatgtcgagatctctttctaaagccaaaccattatcaaatgctttgtctccttttcttaccattcacacatttcacctttcaaagaccgtcaccacaccagctccatgccctactggttacgtacagaaagagtaacagactaaggttgacaagcatctgtttaaccttgattttattgcaaaccagccatgacacattctactaatcagtaaacatctacaaacatgagaaggacatcatcagtgtccctgctcacattgttctttggtgcccttatcacactaaagagttgtacaggcagacctatggatgagtcaccactctgacacctcaccagttaggtgaccttagagaagtccctgaacacttctgaaccacaggatgcccatttgtaatagccacagaaccatggagggcattgtatagactgagcacagtatatgtgaaatgccaagcaagtttctgctgccaagtaggtatctggtgcatggtgatgagttgctgtcattattctcactgatgcagttgctaactgcaacatagggctggccatgagtgacagttctgattttttttttctttttttttttttgagacggagttttactcttgtttcccaggctgaagtgcaatggcgggatctcggctcacttcagcctctgcctcctggttcaagcgattctccttcctcagcctcccaagtagctgggattacagatgcataccaccatgccaggctaatttttgtatttttagtagagatgggttttcgtcatgttggccaggctggtcttgaactcttgaccttaggtgatctgccctcctcggcttcccaaaattctgggattacaggcatgagctaccatgcctggcccttatgttcttttagatgagtgaccatgctctttcccaaagccatctggggagtcatcctccctttttaccatcttcgcatgttattttcaattttcatactaacatgtcagaaccagtttgctgcttattcctctgctgtactttcaaacagaaaatagcatgttgttggcaggttctgactgtttgattaaaagaaataaacaaaaatctgtgatgaaacagttcactatgatgtttaatccatcgtgtccatggaaaggggttcattagccagaatctcactctgaaggatgcccaaagctaagagatcaggggaggcttcactcagtaatggcatctggtgaaggttagcatgaaaaaaaatccatggtttgtcaattacttaagtaatatcttgtcccagcatggtgatgctcatggcaactcccattgattggttttgactgctcttggaataatactggagccactttgctcccagctggaagcagagcacgatcagtagtgtctgcctggggtagtaaaacaagaaacagaaggcttctcttaatgtcctaccagtcctaatctgtaaactaattgcaggactaattcctacaggactgtcacacaagcaaagattttatgccttatttattaatttatacacgttccaatccatcttgtactcctggatttagcatactcttacaagctttcagaaatgaaacaaagattagttgacattcatattcttttcagtccacccttttattcctcctaaaaacggtagacttctattcatattacaaatatttcaactacttacatattcttaactattgtaaaaataagagaatggtcaatgaagaggacaatagaaaaacctgataattattagataaattgagataactattttaactatatatactgagagtgtttggtaaatataccgcattctgctatggtctatctacactctattttcttgtatacaaggcatagtgtatgtatgcctcttacctttaataaggataacaaatttactttcttaaagtaattgaagaacagtaatttacctgtttccaatagtatttattttttagatttttatcatctccaatgaatacttgcttgtgcccagggataagtgtgataacacaggggatgtttctatgtaattatttatctcaaagtcccatttaaactgactctccctcaagaaggtcccttacaataacaagacaaagctatgaacagcaccttagacagttgaccttaactatagaacacctcttatactgtgggtggagtgagagtgagtccctcacaaggcaggaagcagaatcttcagggtgagaaatgaatgcatcctaatggcactttcctgcttggataggaactcattcttaatcagaacagcttttgaaatgggaaacacttgtgggaggggaggattatactttagggcctggaaggggctgctgatcaaaagtctctttttattctggaatctggggagaaggcagaaatcatatactttatttttgtggaagacctgctgctgtactacaccaagcattcttgggatcggggcatgacgatgatcccatccaggatatccaggaacccctgaattacatcccatgctttgtatctgttggaatttcctatgaacagcacccatagcttgtattagaagctcacaagtgtctgtaactgtagaagattaagaaggctcaggagttattgtaactcattttggcttacttaataaaagtaaattatagagactgaaatatttctactggatatgcttgcattttagtatgctctgttttttatataacaaacataattgcataatgaaattaatatattagcctcaagtagtttttaaaaaaaaaactgaatcatttggatcttgagatcttactgagttattactacattaattattaaatatcaaaagaagtaccttagtttaagaaactttataaccatatttctaccatatttgaaacctttccaaagtatttgtcttgctgttttaattctaatttcctgggttccttgtgaaggtgaaagtctttggtaagtttcacagcctttcttagtgtcagattgggcccatagaggttcaaattttgattgagtaggcttaccattgggagagtgggatgttaagaaaactcagggatgagtgggaggtaaagagagaaggtggggaattagatgaagtgtggagcttccaggccagattcccagcccctccctggcccctgatcactttattctgggatgaagcccagaataagtttccctcttctcccctgtcttttgctccagggctacacagggtttgcaaagtgtggtctctggaccaacagaaggagcttcacttgtggactcattagaaatgcaaattctgatgctcccctccaacccctaccctctcacatctgcaaaactggaagctatggggtagggcccacctttcagtattttaacaaaccctctaggtgatcctcctatttgaaaatctgctattatagccagacactatttctgaaacacccctgagatagcgctcacctgagcagcaggtaaatgtgtaccttcccagacctcttcctgaagatcctgtttgattgcatctgtgatgagccccagaaaggctggttgtcaataagtaagtatctacgaaaatttttttcttttctttcttttttttcttgagacagggtcttgttctgccacccaggctggagaataccagtgcaatcagagcttactgcagctttaacctcccaagcccaagcgatccttccatttcagtctcttgagtcgctagggccacaggcctgcaacaccacacccacctaatattttttattatttccttagagacaggatctccctgtgttgctcaggctggtctcaaactcctgggttcaagtgatcatcttgtctcggcctcccaaagtactgagattatagatatgagccaccgcacctggcctacaaagattcttcccgctagaaaacattggcattaccaagcaagcttccccaccacatcctgtggcacactgtgtgctggtggcgagtcacaggggttttcaggatggattcccctcaaatctcactgaccaggtgggtctgggtcagttaaagtccttgtactggtcctctctgagcagccaagtcagtgcactccagtgtctctgcagatgtgatgaaaaaagtcatgagatcttctaaatctgatgttttgtcctccagcataacccacgtgaactgagacatccttcttctgtcatgttccttgatgagacttaacccacatgacagacagcagcgcctccatcttgaaccctggtgtcacagtatctgaggttagaggaaggaagtgaagacgaacatagtccacttacatatttttttgatttgtaaataaaatactactagttcagtgtttgtttcgtataatacattttccttttttatcgtaattaccaactaaatatgatgtagcttttcataagtagctctatgttaggctcataaacattaatgcttattgtatgccataatagagtaatacttaaggcaggtgagttcttttgtctgtgttctgtagtttctgtgttttcttcccccacttcccttgttgtctgttttcttggaccaaggctcttcgtatcctagaaactcttcaacttgctgcctctgatttttcctgttctgggtaaactggtagagtaaattgtttccaattcagctccaagctgctcttcctttgagttgctcccacttgcacccagtgtgccatggacagggatgtcagccttgagtgacaggaaaaatgttgtagtttgacagctgagtccactactgctgtaatcttgcaagaactatttaatctctcaaagactttttcaaaggttgtaaagtttgataataatgtctacttgttatttaaaaaatatggtattggccagacgcgttggctcacacctctaatctcagcactttgcgaggccgagacgggcggatcacgaggtcaggagatcaagaccatcctggttaacatggtgaaatctcatctctactaaatataagaaaaattagcctggcttggtggcaggcacctgtagtcccagttacttgggaggctgaggcaggagaatggcgtgaacctaggaggtggagcttgcagcaagctgagatcgtgccactgcactccagcctgggtgacagagtgagactccatctcaaaaaacaaaaaacaaaaataaaaatacataagttattaaggatgaatgcacagaataactaaaaccatgctttgccatatcgtaggttttcaaaatatttgaattcccttctcttcttagtcctatctaagctgtgtttgaatagttggattagcctgagaaatggcttctctataagtataaggcaaatatttgcttaacaaatgtttaccaaggacctactatatgccttgcagaccaatgcaagtgttggcaaaaaaaaaaaaaaaaaaaaaaaaaaaaaaaaaaaaatcaatcacttaaatcattaaagtaagttttgttcaaaagtcttactgaagactatagaatgaggactatagccccagagtggtccttcagagaagctgtcagacttctctgacacagtgtttcagcccacagcttacatatgggggtgggggttcagtaaatgcaaaatcacatcaaaattgctcacaagtgacatcaaaccagaatcacaccaaggttttggtgtaagagtacctctggtcatagattacaaaggcacaatcattaaccctatcagatgtcatcttatgtgcaagaaaaggcaagggctagggtcattcatactttaaggaatatagtgactcgggcaagagatgtggggggccatgtgccctatcctgttttgtcttcaaagtgtctggagagctatacatcattccagagtcaggggcttgtgaaattatgctggcaagctgaaaagggccaaaagggcttcttccctttgccattttgtctcacaagatcccccctttgatcataaatcaactgtctggttgcatttacagaaccagtatggattgttccacatagctaggaagactctttccttaggaaggtcggtgatcttcatttgtatttgtaaggaattgggcagcatgcttactttcctatttgttggaaagcatattttgaatatcttctattttttaactagcataatctgattttctttcctgacatttccctgcacctaacataacatctcaacaggactatacaaggatactagagattatacatagtggtatatacataatagcatcactatcagttacaaattagaaattaaaaaaaaaaattgataatcatgcaacaaaattggaacatgcatttgcatattttttcattaattgtactatgttttttcctttttagtatccatatttattattatttatgaaaaaatttgacctagagcttattataaatgtttttagagaatacttcaaaataatactgtggatgatgaaaactttgaatagccatgattaaaatatgatgaaagttcccagttgacaagaacatctagttatttctattatatgcagtatactaagataattagaatcatgactgacagtgccacatcagaaaaatcaaacttttataaagtttatgtagtctttagaatactcacattaataacatttataaaaatataattttagaaaagatttaacataatcaaaattatagctgataccatattagatttctatgaatttatatattttatgtgatttatagcaataacatacccataaatataatggaaagaggatctagattatttatcatttgataatattttctatacaatctacctaataagtctaatattttaatcaaaaagacttaatttagaattttgatctttgggaaaactgcaaaagatgtcaaaatgtttaaaatacttgatcaaaacagattcacagattattataaaataataattattcatttcactagagtcataacatggatgtaaaatacttaacccttttaagctcagttttcctagttaatcaaaaactgaataaagacaacacaggaattatcttaatagagtgtaaaatctttattgtgtaggccagctactaaaaacataaagaaaaacctcccatagtgtcattgcctttttttatgaaaagcccattcagataactgtcaaatctgatgaaaagagcccttgaattcaatcagacacaggaagagtgcgtccagggtcatgaatgtacactatataatagaggaatgtaaacacaaaactagtaccttgagcagagggaatacatggcttttagtaacaatataggaaatttcctggttacattgaacaattcagacatatcaagaaaagccaaggcacagaatcaagttatacttgagaaaaaaattgtttttctggaccttcaagataaacatttcagcctcaggtcacaacagcagagttagaactggagaaaaaaagttacaagaactgatgaaaaagttgaaagagagagttatcatctcagctaagcaaaaagttatatcttctcaaggagaaaaggaactgaaggcaattatgtataattcacaaatcaggtgcagtgaaataggcaaaagttaaacttttgagacataaatctgaaaagcttcaaaaagaaactgatttcagaattaaaaatcaaaacctcttgcaattgcagtaagagcaaatcagtatttttagataaccttatttttctaacataactgacaaaattttgttttgttttaatatattttaatatcaaagctcaatctttagaaagacaattatgaataatgttatttctattatagccaacttgatcatataaaacatatctttcatacattctcttttcacaactatatcatgacttacccagaccatttatgacatgcttgcactttctggtttgtccaataccttctcttttttaaataaccgctcattttactttaagacaacaatttatgtaagcttctttctcatacaagattaatatctttcctcttaccttccttaccaagaatacatcatcatatccattccattcatatacattcttcatatctttctttcctacttactggttcctttctatcttgtttcatgaataaccactgaattagataaaattgtcctttttctcaaaatgatgcatttttatgcttttcttatatttttccatcaaaaaaccatatttttgcatactttgtatatataattatatattaaaatattttaaattcttagtaaccttaaattttagtcaaaatctaggaagcaagatcttgaattgtctttcatatatcagtattttatatactaaaataatttcctaatttttagaaacatatttccttataacaaaatttttctctcaattgaaaatgacccaagtattgaatgattatctattatttaatttaacataactttaatatttaaaattacatgaaaagtttatttacaagtatttacctaatttattatttttaacagattgcctagattacttatgaaaactgacatattggacaaagctagtcatcatttaaatttatttccaagttgaccatttttacagcctgtgaatatcaagtgtttacctaagtaagaactttaaaattaaatacatgagtattttgatgatagctcagaaaattcggttgttttcattaaaccaacaatattaaattagtcttacttataaaaagaatacacacagatctttctgttttgggctgagtttgtagttttatgacattctaaaacctgccaccttaaaatatctagcagaggcaaatatagaactgtctcttcagtaaatccaggcaaaaatgtatgctgatgattctgaagacaattttatttttattttatccataatttttaaacaagcttatttattaaggattttcttaagtcacatgaactggaaaatatttaaacttactaattcatgagtgctcgtttatttatgcatctacttagtaccatatgacacaacatacagaataatacacatacatatgcaaacacttctcaacatatatacacacatagaaataaaaatattatagttttcatttcagaaatttagttatgagatagtaatataaactcactaatttaaacaagacaattagacctaaattatttccaacaaaattggaacctttttccatgactaaactttatttgacccaataggtaatctaatggaggctgtggaccaaaattttgggtaaagcattttccatgaaagtttttatttttagaaacttcttttaccttttttttccttcaattccaagtgagttaaaggataatacttcaatgattacattttagggagaacttgccaagttgtgtaagataaacaaaatctccagttactaatacagccttgaagtaataatgccgtaaacaatgagttttatctcaacaccagtagaatagacaacagattcaagtaggcagaaaaaataatagagaacttaaaagactctgcaggttaactctatagttgcgaattttttgagtaatgatcatttaagctctgaactttctttttctttttttttcttttcctttttttttttgagacagggtctgcctctgtcccccaggctggagagtggcacaatctcagttcactgcaacatccacctctcaggatcacaccatcctcccacatcagtctctcaaatagctgggattacagatggacaccaccactcccagctaatttttgaagtatttgtaaagatgaggttttgccatgttgcccaggctggtctcaaactcctgagctcaagagatctgccttccttggcctcccaaagtgttgagattgcaggcatgaaccacggaacctggacaaaaatttcccttcctaagaaacaaaagatctcatggaagaacttacccttttgtcaaggagtgtaaataactagctgaataaaactcagcattggcaacaaagtatgagatctgagactcaggagagacccacctagtcatctgcaaatgtggaggagatgcaggggctttaagggccatgctggtaccaaggctctgggtccccacaatgttccaaatggtccttatctgtatactatgggtttcttctgggacaccatgattgttgactaaagaaaatagaattaagctgtttagaaagttaaagttagttttattcagaagtcttactgaagactaaagattatggaatgaggacctcacctaggagcaatccttcagagaggttatcagatggctctgtaacagtgtttcaacccactgcttacatagaggtggtgagggttcagtacttcagtacatgcaaaaatcacatcaaacttgctcagaagttacatcaaagcagaatcacatcagggtttcaattcaagtgtagatctggttttagattacagaggcacaatcattaacttcatcagatactgtcttatgtgtaggaaaaggcaagagctaaggtcattcatattttaaggaatatattgactcaggtaagagatgtggtggggggcatgtgccctgtcctgttttattttcaaagcctctttctgaggagctgcacatcatcacagagttagggactttgtgaaattactctggcatgcagaaatgagtgaacactgcttcttatgtttgctactttgtctcacatgagaaatagaagataataacaaaggaagaaatgtaagcaatctactacattccaggcaccatgtataatcctttatgatagttactattagtattattccacatcatgaaattgaggaagagcagttttaaataaattgctgataaattggcagaaccaagattcgcaccagataccctgctcttaaatttgttttcttgaccactaattcacaaacttcaaatttgagtggttcattctaaagctgatgtctagtatctttaataataaaaaaccctctttgccccaacttacatatgcacaaatgatattttccttaaaaacaatgctttagacaattgattctgttatttcatcttaccagctgtactctctgaaaagtgaatttactgagcacaaatacccagggagaaatggctaattgtgccaccacgtttcctagccagctgttccacacagagagaagtagttcatgtttaaatatccaggctgtaatggggggtattgcagcagaaggcctctgcaagctgccagaacacatttcttgtttaatggcaatggagacaggggctggtgtggtgtgatctgtaagtaacaggacagtgagctcttttaaatcatgctaagggagctctaggcaaatcatactaagggagctctatagtcaagtgcactgtggcactgagggtgctgcttacctgtctgcagctgcatcctcaacaccttcctctatagtgtacttgctttaaagatacctttaaaatatttcacagtatatatatatatatatacttatcaaaggaagtttaaaaacaagtacatgcaaaaagaagaaataacaaatcacctttaaccccatcactaagatagataggctaagatttcattttgtatccagttctctagtgaccttggtaaagtcataaaatgtattgacccttggtttactcatctataaaatataaataataatatatattttgaaaggctattatgaggattaaataagataatgtaaagcacatatcacaatgcttaaaacagggatcataattaataatgacttttatctaactaccaatagatacttaaatgcaaatgtaatcaaactacacagttttagaattatcttcatttaataatatcgtgtaatatttccacattgctacatattggcaaacaaattgtattagattatgtagtttgttttcatctttctcattgttggacactcaggttaatttaaaattttgctacttcccttttccccaaatgttatgatcatttgcttactgctcagtcctttgggtctcaattattgccctgtgtaaattcctggacctgaacgactagatttaagtgtataaaaaaatccttttaaaatcttagatatccatttcaaactgccaggattgctgcagaacttgggaaaggtccatcctgacagcctctggccaagacccaagaatgcaggggcagttgcttggaagttaggaccctccagagtggcgacatccaggtccatgccagagagtttgacgtggtattaatgaagtctgaagcataaaatccaaccctggaatggcatttgacattaccccgtccccaggcatgatgttaagtgtcaggcttctggacaattactgtttgtaggatatctgttatatggtgtgcaagcctggaaaattacattattttttctaaatctaacaaattatctgtgaagtagacattagtatccttattttgcagccacggagcagagaggttagatgacttgtcaaaactcacgcagtaaagaatgaccacctcacttgctctcttctgacttactaaaaacaatacaaaaagattcacagagggcctgtatctcttgtcctagatcacacatactgttatcaacaagaagggcaccaataccctggcaaacatattgcctgttccagtcttttagttagattattcagaaaatatcagagagagagagaaaaggagatgggcatgctattagtagaccatggtaagaaactgcacctttattctgtggccaatggtaagtggcagaaggatttaaaaggcagagaaggtagaagggagaaagatcagacactggagaaaagataggatttccgaggggatagttttaggaaaaaaaatggctaaacacagattttagaaagttatttaccttggaaagctcatgaaagattctgaagttaatgaatggtttccaaaatgctttgtaaaactccacacaaatacagttgcatattattagtagtattagtcagaagctaatatgttaggacagatattgatatcataatgtcatctaaaaatataagtggtctctaaaatgaaattgttcctgccacagacagcttatcctcttacaggctttcattgtcaaatattcatgtcagttttgtagactgtttatagagggaggaattgggaatggtgatttggttttctgttttgcttttgattttctaggagaggattcctgggacacttactcatagtggctatcatgctccctcctgcccgtcctcaagaaagcatagtaacctcccagctctatgtgaatgtgtgctgtggtctatgggggtgcaagtggattgcagtgtgctgtatctgtaataggttccatctgtgctcttgagtgttctgctgatgaattctcactacatccatgggtaatatgccccgggttgttttaagattatttaactatcttcgtgagtgtcagtatataaatatgctcttgcccagagaggtcataatccccactgaacagtgattaattatacacatacctcgtgtttgtattgcagcttcccccagggagctcaaagcactttgcaaatatgaattgcgaataataaataatgcctttgatttctaagacacctatctctaaggtcttaagtttatgcctctctcagcattctactaggagcaaagccctcacaacccaagggcaagagtcagcacctctcatcttcccctgtgagaggggatcgtgaactattcacaggcctgattttaccagagtggaactgagtatgtgagggacaggaatgtataaaggcagggaaagtagaagggagagaaaccagacactggagaaaagataggattttccagagtatgactatcaaaaaaaaaaaaaggttaaatgcagattttagaaagttacttacctcaaaacactcagggaaaattccaaagttaaaacaatacagggtaggtggggcatgtgacactaagtgccatttagaaggaaaaatgtggctttctactaaatcttgactatgagaaatcctcattaatcaacaaaaagatgaggtaggagggaaggttcaaaacatggactacaactataattctcagttaatttgaagcaccttagtgagtaaattccaacattggcgaaaataattcatttcttttgctaccgaagatagttatccagataaaatgtatgtagatcagatggccctatttgtttcacagtttactctatttttagtccctcttttatccagggaaaggggtgggagagttatttgggtcattttttgcttgagcacagaactcaacagcaattaaattatcatcgagcaaaagtgatattttaggcacagttgtttacaaaacagtaaataaataagaaccactggttcctttctatataaacacgcttctcctaggaattcatccatttcagaatttccccttcactaggcagaaatttgaacttgagatgaggattaggcctttcagaattctttggctgctgcctacatagcaaattgtacacattcaattgatatcaattggtaatgagactagcactccaggccactgttttcagtgttcaaaaccacactgacttccttctaatttcctgttgtgcaaatggagctcttaaatgtggtgctgcattaatagaactcttttcagaatcattttaacaatgacaaaaataatgacacagaggatcaagcctaagctgactagtgatgatgatgataatgatgattcattaccttgattctttgtagaatgtctgcaaatgtagcttcagagggattaaaaaataataatcaagataataattgcaagaatagttaacatttaggaatattatgtgccagatactcttaaagtgcttaattcagcttcaaccttcacaatttaatgaagtagaagtagatactatgattatatacattttgcacatagggaggtgaaacactagaagaccattagatttttccaggctttcacaggtgatatctagaggccttgagatctgatccagattgcttagctcttaaacacgattctggcctgcctctcaaaaaacatgttgatgggcacacaggcttaagatttgaactgggccactatgtcatggagctctaccaggattctatctttgaaaggggtgtcttatgaaagaacatagtttttattattatgcgttttgactagtctttcagctggtgatctgggaagaagtaatctgaaggcaacattcctaacttactataaagcaatgtcttatctcatgcagctggctgcgaatcaaatagggtcacagtctacacaaaccccctattcataactcttagatctccatttccgctcttcacttctctccaaaattctggttccacatttgctgctgttggtttgccaactgtagcaaataatatttcacaaaaaaatagtggttaaattgattcttcccctgttgtgaaacttgcattttttttcttcctctattcttacttaaaacacttagtaaattccttatttccttaatgagattagtatttattaactaccatctgccatatatctttctttgataggtactgaagatacaaagatgaatcaaacagaatctctgtcttcccagagctcacatttgattagaagagtcatacattaataaaatatccatactagtagaaatataattatgaactgtttcatgtgacaaaatttagggtactacggaagctcatatcaaaatgagggacaatggggatcaaagaaggctcccctggtgagctgacctctgagagtgggctgggttggctgagatgggtggtgctccttccagtagagtgtatggtttgtgcagaggttctcctatgagggaagatggggtaaggaggaactgaaggaaagtctggctggtataaaggggataaagtataaagagagtatattttatacagagtataaaagggaatgacgtgagaggggctgtgagcagactgggtccagatcactcttggacctggaatcctaggctcatggctcttctctttgccttaacgcctcaatgcacacaatctgccaccaaatcctgtcaaaaatgacacacactctctctctctctctctctccctttccccctctctctttactctcctatggcctcagagctagatttccctttttaaatccaatcttgcctgaactctacctccagccctccagccttttagatgattttccacctccaatccttctttaccctggggcatcccttcattgagagctgcagtttttccttttgatttttctaaaatacattttagactactctgttcttaagaacatttactgattcctgaaacttctgccttataaaccaaaacacagtgggacagagtgaaaagccctttagcatctgacccagcccggctgtacgtggtgcactgaacttcccatcagaagttcccatcaacccttttgtctgaactagaatgtactgtcaattgtgaagggcttcttggagagctccggagatctttgctaaatgtgagggaactcaaactcaattacattttatttttctttcaaggaaaacacacttgtctctttttcaaccttgccataagtgaacaaatacatgtgacaaggtaaaaaagtgacacagttttctttctatgcataggttttctgaatcacatttatggcttcatttagcaggtatttaggcagcacttaatacgtgtaaggaagtgaggagggggaataataaagcttgagaggatgtgagtctctttagcatgaagtataggacatcaggaggagattcctggagagatgactgacaggttgagataagtttagaacatagggcaggtattggactttactgtgttgatagctaaggatgtttattcactgtgaagcaacactatcaggtatggtggaggaagacaactttgctgctgatataggggatattctagagaaaggatggccagtgggaaggcttgggcattacagaatacaagggagatcctcttgaataagctggccctctctctcgccattgcatactgcctcagagcctggaatattttctctgggtcatgacatttgttttgtttgtagatgtgagctccatgaaagcagaggcattggctatgtagtctcagaatccagcaaacgaaaggtggacagtatgcatttagtaagacatgctggctggctgcaactaacaaccttatcacatcacagaacaggtggactcagaggcagaacatggagccctgccccctcacaatccagaaaagctttccacctgattgtctttatgccggtaaacaggattctctgcttatgtcttgacaacttaacgttgtgaaaacagaccaaagttattcatgagctagttacacgatttgttaatgattttagaaaatggtttaggaaatcatctctaattgaccatcatttatactttcatttatgaaagtgcctggagccagcactaactagtctgtcttccctgcacttagcaggctgcatggggctgacagaagcaaggaaaacatgaggaccaagcaatgtgcagaccattctgaccaagttacatcattgacatctttaaactttaaaaattatcattctgagctcaacatacattttttgaatgcatattgagtggtgcacatgagatgagatgctgaggatgtgttgtggagttggttattaaatgcagtgtggctcagcttcctgttatgtgatgcatttgtgctgtgggtcaagttgccacctaccccactccctggaatgacatcattggaaaatgtatctaagccaccattcacagtagtgcttcttttgaaattacccccataaataacattgggaaaaagcaaatgatgggttggttaaaaaaaagtcatagctcaaaagaagtaatgcctcccttcaggatcggagtttggtttcacctctcaaattgctcagcaagtactttcttctacttcttccaagcttacacgcccaccttccacccaaccatagatatgcactccatctttttttttttttaatccctttgctttggacatgctctttcatttagtaagatcctctgttttcttctccttctcatggctaatttttagggtcttcaagacccttcaagacccatggctaataattaaggtcttcaagaccctaattccgggtttatctttccttccaagccttctctgatttcccaactctcctgcctgtggatgttccctcgcagcattcctcttcacagtattataatagtctgcttattgttatgagtaactcatcactagatttgagtgtcatgggagaaagtctgtgtctccttctgtagccagtgtccacaccgttgtccctggtacatgacaggtgttgactatctgcctgttgtatgtggatggaaggtttgcttcccagctgagccctgcactgggatcacagagatgttaataatgtgagcatgagctccttgttagacagaagtgtcactgtcagtggcatttcaaccaaccaggtaacaaaccacaaatcgtgacccaatatttctgtaaaattgcatctctttatactgtcagtatctgtagttaccaaaacttaaaaaaaaaccttcagaaacacagaatggctgacattagttccaaatattaaaaagttttaagtgtcatgctcaaaagcatctatatttaaaagcaattggatcataaaaagtgaacataaaatttacacagctgcctcatcctgaatactttaaagactaattactctgttgagtcctaatgactattgccttcaagccctgtaaattatatataaataagagaagagagtttgtaaatgtaagtgactctaattgggtctcagaagaaagaaaaacagatctttagtagctcgatgaaatctctaagcccataaaacatcggtcagtttctcccatggagttttgtggagtgtaccttttatacatgcaacagagactgaattcaaagggcaggcctgaaccaaggaacctgtttgattttgcttgtatatatgaactgaaaaatataaattaaagaaactcctgatttcataattcaatgtatttttatttccttgaaaaagggctgccattcagtgaagcatacagtaaggaaacctgtcagaacagagtcccatggaagagtagcagttggtctgtattcattcccagtaatgggactctttttctatgcaaatgcattttgagttaaaggtaagacaggttgtagaatattttgtgcaaacgtaaacagaagcactgaaatagaagaagataattgttgcttattaaagtgcttagaatagagctgaatcaagtaaaccagaacccatcactgaatagtttggggatttggtacctgtttactacttcctttgagagttttcaaggttgtttttgaataagaaatgaatcgagccctagaaaaccatcatagttgagtggatctgaaaatgctcagtgcagtgcagttactgcctcatgagaaattctcaaaaagctgagaatattctctctctttttaattttttttttaatttcagtaggttttgggggaacaggtggtgtttggttacatgaataatttctttagtggtgatttccgagattttggtgcacacatcacacaagcattgtacatggtacccaatatgtaacattttattcctcactatgcccccaccctttcctgagtccccaaagtccattgtatcattcttatgcctttgcatcatcatagcttagctcccacttataagtgagaacatacaatgtttggtttttcattccagagttacttcacttataataatagtttccaattccatccaggcatttaggttgctgtaaatatcattaatttgttcctttttatggctgagtagtattccttatccactcgttgatcgatgagcatttgggctggttctgtatttttgcaattgcaaattttgctactataaacatgcatgtgcaagtatctttttcatataatgactttttatggctgagtaatatcccttatccactcgttgattgatgagcatttgggctggttccatatttttgcaattgcaaattttgctgctataaacatgcatgtgcaagtatctttttcatataatgaattcttttcctctgtgtagatactgggattgctgaatctaaccgtagatctacttttagttctttaaggaatctctacattgtttttcatagcggttgcactggtttacattcctaccaacagtgtaggagtgttccctgttcactgcatccatgctaacagctataattttttgatgttttgattatggctattgcaggagtgaggtgatatctcattgtggttttgatttacatttccctgataattagttatgttgagtagttttctatatgctttttgtctatttgtatattttcttttgagaattgcctaatcatgtccttagcccactttttgatgagattgtctgttctttcattgctaatttgtttgagttccttgtagattctggatattagtcctttttcagatgtatagattgtgaatattttctcccactctgggttttctgttaactctgctgattatttcttttgctctgcagaagctttttagtttaattaagtcctgtttgcatatttatatttgcttttcttgcatttgctttggggttcttggtcatgaagtctttgtctaagctaatgtctagaagagtttttttcaatgttatcttctagaatctttatggctttaggtcttagatttaagtctttgatccatcttgagttaatttttgtataagatgagagatggaggatccagtttcattcttttacatggggcttgacaattatcccaatacaatttgttgaatagggtgtcctttccccactttatgtttttgtttgctttgttgaagatcagttggccgtaaatatttggctttatttccaggttctctattctgttccattagtctatgtgcctatttctgtactagtacaaagctgttttggtgactatggcctaatagtataattttaagtcaggtaatgcgatgcctccatatttgttctttttgcttagtcttgctttgcctatgtgggctattttttggttccatctgaattttaggattgttttttataatgatggtggtgttttgatgggaattgtattgaatttgtacattgtttttggcactatggtcattttcacaatattgattctacccatccatgagcatgggatgtgtttccatttgtttctgttgtctatgacttctttcagcagtgttttgtagttttccttgtagtggtttttaaaatttttttttccaccaatgtgaaatgggttgagattttgatttgattttcagcttctgttggtctacagcagagtagcagagctactgatttgtgtacattaattttgtatcctgaaactttgctgaatttatttaccaattatgggagctttttggatgagtctttagagttttctaggtatacaaccatatcatcagcaaatagtgacagtgacagtttgatttcctcttaccaatttggatgccctttatttctttctcttgtctgattgctgtggctaggacttccattactatgttaaatagaagtggtaaaagtgggcatccttgtcttgttccagttctcagggggaatactttcaatttttcctcattcattataatattggctgtggctttgtcatagatggcttttattatgtaaaggtatgtctcctttatgcccattttgctgagggttttaatcataaagtgatactggtttttttctaatactttttttctgcatctattgagatcatcatgtgatttttgtttttaattttgtttaggtgttgtatcacatttattgacttatgtctgttaaaccatccctgcattcctggtatgaaatctacttgatcatggtggattatctttttgatatgttgttgaatttggttggctggtattttgttaaaaatttttgcatctatgttcattggggatattggtctgtagtatttttttttttttttgctatttccttccctggtttttgtattagggtgataatggcttcatagagtgatttaggaaggatgccttctttctctatcttttggaatagtgtctataggattggtaccaattcttctttgaattaatgatagaattaaactgtgaatccacctggtcctggccttttattttggtggctatctttgtattaccatttcaatctcactgcttgttattggtctgttcagagattttatacctttctcatttaatctaggacggttgtgtatttccaggaatgtatccatctcctctaggttctctagtttatgtgcataaaggtgttcataataacctttaataatcttttgtatttttgtgttatcagtagtaatacctcctgtttcatttctaattgagcttatttggatcttctctcttcctttcttggttaatcttgctaatggtctatcaattttatttatcttttcaaagaaccagcttttttttttcatctatcttctgtattttgtcatttttgttgttgttgttgttgtttcaatttcattcagttctactctgatctttgttatttcttttcttctgctggctttgggcttagattgttcttgttttatcagttccatgaggtgtgaccttagattgcctatttttgctcctttggactttttaatgtagacatttaatgccataaactttcctcttagcaccacttttgctgtatcccagaggttttgatagatattgtcactattatggttcagttcaaagaatttttagaattttcatcttgatttcattggtggctttgttcattttaaaaaaaatttttttgtctttgttgaattgggttaatttcacagccttgtctgtgagctgtgaagatctttctcccgcttgtttgattggactgctgagactttccggtgcatttctctaagtgtgtccttcatttccaggagttgtaattgtttttattttactgtctatttcactgaggaatttctctttcatatcctgtatcaggtttttgatttctttaatttggacctcacctttctctgatgcctccttgattagcttaaaaattgaccttctgagttctttttgtggcaattcagagattccctcttggtttggatccattgctggtgagctggtatgatcttttgggggtgttaaagaaacttgttgtatcataatgccttaattgttttactgattccttctcatttgggtagactatgtcagagggaagatatgggattcaagggctagtgttaagattttttcattcatggggttctcctttgatggggtgttctcccccttcccctaggaatggggcttactgagagccaaactgtagtggttgtttttgctcttctgggtctagccacgcagtagagctactgggctctgcattggtattggagagcttctgcaaagagtcctgtgatatgatttgccttctgatcttgcagctgtggataacagcaactgctgcagtggaggtagcaggggaatgaagtggactctgtgagggtctttggttgtgtttttgtttagagtgctggttgcatgttggttggcctccagccaggagagggcacttttaagaatgcatcacatgtggccctataaggaggatgcattcttgccttaggaacacctggctgagtattcaggattttcaggtggggagcagggccatagagctcccaaaagcttctgacctttgtctttcactacaaggatgggcacagaaagaccaccaggtaggggcagggctttctgagttcagcctctctttgggcagggcttgctgcagctgctgtggaggatgtgggtgtgacttcgagtccaatggagttatattcccagggggattatggctacctctgctgaatcatacaggtcaccagggaagtgggggaaagcaggcagtcacaggcctcaccccactcccatgtagtccatagtcctgaaggctggtctaactttcattgtgcccctccaacagcatcgagtctatatccaggcagccagagaccagggctgagaacttgccccaaactatgagtttcctagcagagaaagcaagccgacttacaggcttttggtatctcagggaccctgcagtggtgatccagttccttcaaagggtctgtgggttctcttagctttcctggtacgttcctgtggtagttcttggagcaaaagtttacgacgtgagtctccacacactgctctgtccatccaagtggcggctgcaagctagtcctgcctgctatctgacatcttaattctcgagaatattctcttgaggatatctaattcttttctgttctaatcttttcttaccttgcttaagatggaaattatggaaaataaccttaatgtttacttttgtcataaaaattggctttattttccatagaatttataatttttaagcataaagtgtctctttttccaaaaagcttaaaaatatttatttttaaaaaaacttggagtcatatcattgcatttaaaaaaatgtttacttgactaataaggattgaatacattcaagatgtacaatgtgatgggtcgatacatataaacactgtgtaatggttaccacaatcaaaaaaacacatctatcaccacccatgctttacattagattgcctgaacttgttcactttgtaattgaaaatttgaccaacatcctctcgtttccccaaaccccagtccctggaaaccgctattctaccttctgcttctatgatttctacctttttggattccacatataagtaagaacatacagtgtctgtctctctgtgtctggcttatttcactttgcattatgtcttccaatatcatccatgttattgagaattaaagtatttttattatttcctgtggctaaataatgtaccactttttctttactcactaatctctcaatgaacactctggttatttctatatcttggctactctgaataatgttgaaatatacatgaggtgcaaatatctctttgaggtactgatttctggatatatatccagaagtaggattgatggatcatatagtagttctctttttaatttgttgaagagtcttcaaactgttttccataagtgccataccagtatatgttcccaccaacagtgtacaagggttcgcttttctccacacccttgccaacacttgctacctattgtctttttgataataaccatcctaacaggtgtgaggtgatatcttattgtggtcttgatctgcatttctctgatgagtagcgatattgagcaccattttgtagatctgttggtcattgtatgttttctttggaaaatatctatccagaacttttgctcacttttgtcattgtttattctttgctattgagttgagttctttatatattttggatattaaatccctgccagatctgtagtgcaaatattttttcccattctctaggtcacgttttcattttttcaactgtttcttatattgtgcagaaacttcttagtgtgatgtggtctcatttatttattttggattttgctgtgtattcttttggtgtcatataaagaacaaatattgccaagactaatattaaggagtttttcctccatgttttcttctaggagttttatggtttcagatcttatatttaactctttattttcaagtaaatttttgtatgtggatccaacttaatacatgtgtatgtgtgtatctatcttttccaacaccatttattaaagaggttgtccttttttacattgtgtattcttgctgttcttatcaaagtttagttgatcacaaatgtataggtttatttctgggatctctcctctattactttagtctatgtgtctgttttgatgccagtaccatactatttttttgttttgttttgtttttgtttctaattaggaattcagcatggataacataagcttttgatcactatagttttgtaatatagctagaaattatgaagtgtgatgcctccagccttgttcttctttctcaaaattccttttgctatttgggatcttttttgattccatatgaactctagaattgtttttctattgctttgaaatatacaattggaattttaataagaactgcattgaatttgtagctcatttgggggtggtatggacattttaacaataatgattcttctaatctatgaatgtgggctatctattaatttatttgtgtcttctacaatttctttcatcagcgtcatacacatttaacatttgattgtacatgcaatggttccaggacaagttcttaacaatgaagcttggcctcagaatggtcacaaattgtattttagtcttttgctctgggacgcctaactgagtgggattatctatgtctttatttaaataattttcattaaatgtttttattttctatgatgggggctaaggaaggatgtcaagtatggctgctaaccttcaggaaaattgtaggccacagccaaattagagggaagaactgtgtgaaatggcccatatttaaatgtccaacccaattaaacagacctacagttgtcccatatgtaaaattagcgtaaagttaattataagtaggccatatttttcagattgaaggatgaaatatatgaaatacatttgagatagttcctagaacaaaatgggcaaccaatgatattttaacgatattggtaataacagtaaaaataggtcactaattttgtttcccccaaattcatgcccacctggaactgaggattttatttatttgtaaaataaggtcttaacagatgtaataaattaagttaaaatgaagtcatactggataaaatgggttctaaatccaatgactggtgtctttttaaggaaaatgagatgtggatagagagacacagagacaaatagggacacacagagggaagagggccatgtgacatgaggatagaagcagagattggagcaatgcacaccaaagaacaataaggattgtcaggagctaccagaagctgaaaagagacaagaaagcatcctccccttgaaccattagaggacaagtggacctgctgatatttctgtttcaaacttccagcctccaaatttctattattacagttgcccaggagacaaaacagatggtaaatggaaccacagcactggatgagattgtgaaagcagtgagtattgatagagaagttcctagaccgagcccggggactttaacatgaagaaagcaaggtgacatcgagaaatcagcatggagagagagaatgaatgaccagtcaagtaggaaggaaactaggagagaaaaatattaggaaattgaagcattttagaaagaaaagaatgtgactgtattgaatactaataaaaataagatactgattatgaaaggaaaattcgatttatcaacatacagttcattggtgaattaataataaaatgaaagttttggtggtagcttagggttaaaatctgactggaataagtttcaaaagtaaattaaaaagaggcattagagaaagtatagataacgccttaaaagttttactgtaaaccatcagggagcagagaaatgtgacattagctaacattaaaagagttgcaggccgggcgcaatggctcatgcctggaattccaacactttgggaggccgaggcaggtgggccacctgaggtcaggagttcaagaccagcctggccaacatggtgaaaccccatctctacaaaaatcagctgagtgtggtgacaggtgcctgtaatcccagctactagggaggctgaggcaggagaatagcttgaaccctggaggcagaggctacagtaagccaagaccttgccactgcactccagcctgggcaacaaaagagaaactccatccaaaaaaagaaagaaagttgcagaagtttccttttagatacaaaaaatgctaatgggaattatatagcagaaggaatcaaattttaaagagaattgtaaaggaatggggtgttgcctcagtagtgtctttacaaggtgataacgatgagaaggaaagaatacgttggcatcagataaaaaatgaggataattcatctaaattaatgaaaggaaagtcagcacataggggttcagctattgacacgtcagtaaatgtgggggcgggactttgtggttcttttacaaatgtttcagttgtcttcgagaagatggagacaagattattagctgagagtgaggaaggagaaggcagaaatgaagagaaggcattatatggtcgccttagccaataggtgaatggataggagaaagaagctgagattaagaggagggggaaggcccacatgaagttggcagtcctggatataaagtggcttataaacagtgtgcatggtttgtgttttcttccaccagataaaccattcaaaagtagggtaagcaggcattgttcggacaaacaaatatccactttcaagaagcaagaatgggccaagggacttgaggctgtaaatgagaggatagtgatggaccagacaatatgagctgggaaaggagagaggagaggacacaaaggagttaagagctctgagtagatggtgagattaacccttacactaagtattggagaagtccaggcattagaggaagggaattagaaagggaagagattgtagtcagaaaacaaaattcctacagttgcaattacggagggtttgcaattattagtactaacaaatactgaagtctgatattgagtccatgatgcactaatcaattatgactgacagcttgaaaaacagttagatggaggtgctgaagtgggtgtgcatggatatggagacattattgtgtggctctcatgggacctaagatgtgaataaggaggggcttcctggcacagatctgtatcaggagcattctaggtgcagagaaaagcaggaataaagtctccaaagaaggagtgagctagcacattaggggaacataaagtaggtcagtagtagttggagcttagtgggtgagggcaagtgtggaatgaaatgagaccaaagaggtacaagggaatatgatatagtttcttgcagaccatgtcaaagaatttggattttattctaagtgcactggagaatcattaaacattttaagtagtggcatctggtttatagtgtaaatgcttattttgactgctgtgtagggaatggatgggtgtgggagaatgaggaggtgaggctggaatctgggagacaagttcagatgtgttgtagttgttcaagtgagagctggtgatggactgccttgcggcatggtgaagacctggaaagaagtgcaaagatgcacaatgtatttagtagagaccagagggctgtcgatgacttggtgtggggcacatgtataggggttctggtcaagaaaatgaaacaaaagaaacaagtatggctcctagaattttaacctgagcagccagcacagaggggtgccattatgtgaggtggtaaaaactaaaaggggagctttttggtgaggacaatctggttagcagaaactgaaagatgcataggaagctgtctaagtctaggattgacatgaactgatgtggaatagaaaagaatcaacatggagaagagcctgctctttcaaagtgaaatggtaaagcaagaaactagcaatgccgtagtaaagggagaatgagagcgaactcttatccctcagtggtggtccagagtctggatcagtcatccctttgatgatgtgagggccatagtgctttgtgtctttccctttagatcttatatgtacattgtggcacccaggctaacattcttaaatatcactttgtgtcacacatgtgtttgctgctcctaatggaatccccctttacagaaacaggtaaaatttccttggcattccttgccagtgtggtctctttctttaacatttcattccaagttcccattccttttgtggggtcacagtttccctacttttcaaaatgatgaggttggttgtgcaaatggctgctaaggttctcatccgctccactgtcctacagttctacagcttcaggtacggtgagatccagctacatcactctgtttacatcatagttaatagtatatcactttttgttttccaaactaagttctatcttgcttctacaaaacttcttcccagacaaactctttctaattacctccacgcattttttttaacttttattttagattcaggggtacatgttgaggtttgttacacagttcaactcatgtcacagaggtttgttgtacagattattttgtcacccaggtactaagcctagtatccaatagttgttttcttgatcctctccctcctcttaacctccatcctcacgtaggccctggcatcttttgttcccctctttgtgtccatgagttctcatcatttagctcctacttacaagtgagaacatgaggtatttggttttctgttcctgcattcgtttgctagggataatggcttccagctccatccctgttcccacaaaagacatgatctcattcttttttatgactgcatagtatttcatggtgtctatataccatatctactttatccaatctgtcattgatgggcatttgtgatgattccatgtctttgctattgcgaatagtactgcagtgaactttcatgtggatgtacttcaacccttataaccacttattgattttgaattcacaaaacatgtattccgtagcactgatcaaatcttctccctttccctctgcttatacgtccattcctctatccatccactcatccttctatgctgccacacatctcttttgaggtagcatgacatagtggaaagggcacatactttatatacatctgcactccttggtttaaatcccatttcattatgaatattctcattacagttttacttgtggagtttttatacctctgtaaaattccattttttaatctgaggatttaatgaaaaacctatctttagtaccaggttaggtgcctaatacagagtaggcacatcagatcagccagtgtgactgttgcttttgtctccttcaactagattataaggtctttgaagatagaactgtagcattatagccatttgtttctctagtgtcttacaccagcaggcattgaataaatgttagtttataatttgggggaagtgttgataacattctccatagtggctattttattcaacaaatgtcttctggagatttaagatagcatgtcccatgttattctctttagacacaaagatgaataagcaacaattcctcctaggggagcttagattcaagaggatgagaaagacaaaagagtcttgataaattgagatttgtattctacgtgaccagagtggcaatatggtgaaaagaaagatgttattagtctttggggcaagtggggacctgggtcacatggactgggtcttaaataatgaggaggagcttgccagacatattaggaggcaagtaggtgttttcagctaaggggaaaagagaaacaaaataaaacaaaaacataacaatgtgcagaggcaaggaaaagcatttggagggatactgcgtgttcaggtgtgtgactaagatataataatacatacataataaagttggaaaggtaagaaaggacattgaatgtcatggtaagaagttggactttctcatatagaattagaaagccttgggcttttgctttttttttttttttttttttttttttttgacagagttttgctcttgttgaccaagctggagtgcaatggcacaatcttggctcactgcaacctccacctcccaggttcaagcaattgtcctgtctcagccttccaagtagctgagattacaggcatgtgccaccacgctcggctaatttttatattttcagtagaggcagggtttcgccatgttggtcaggctcgaactcctgacctcaagtgatccgcccacctcagcctcccaaagtgctgggattgcaggcatgagccattgtgcccagccacctcggagttttttaggcactagagtcatatggccacatatgtgttataatattcatattaataaaagtgtggaaaacagattagagtaggaagagtagaatggtgagaaaaggtaaaacagaaaaattatgttcttgtacaaccaatgtacgagagtatttaccctaagtcccagctcaagatactgaattagatatttgaacttttaaatttaattaatgtaattttattttatttttcaaaatgtttattttcataggtttttggggaacagttggtatttggttacatgaataagttctttagtggtgatttctgaaattttgctgcacccatcacccaagcagtgtacactgaacccaatttatagtcttttatccctcatccccctttcacccttacccttgagtccccaaagtccattgtatcattcttatgcctttgcatcctcatagcttagctcccacttatgagtgagaacttacaatgtttggttttccatgactgagttacttcacttagaataagggtctccagttccatccacgttgctgcgaatgccatttatttgttccttcttatggctgagtaatagtccatggtgtgtgtgtgtgtgtgtgtgtgtgtgtgtgtgtgtgtataaaaaaataaagaaattgtgtgtgggggtgtgtgtatatatacaatttctttatctactagttgataaagaatatatacctatacacatgcacacataccacaatttcttaatctgctagttgattgatgggcatttgggctggttccatatttttgcaattgcaaatgtcactgctataaacatgcgtgtgcaagtatctttcttgtataatgacttactttcctgtgtagatacccagtagtgggattgctggatcaaacggtagttctacttttagttctttaaggaatctccacactattttctacaatggttgtactagtttacattcccaccagcattgtagaagttttcccttttcactgcatccatgccattatctattattttttgattttttgattttggccattcttgcaggagtaaggtaatatcgcaatgttgttttaacttgcatttccctgatcatgagtgatgttgagcattttatttggacttttagaccctgagttcctggtccgtcatccccttgtcatgtgtagctgaatttcaagtaggatataaataataataaaatgccttgctacaaggtactgggtgatccttggctgagtattagaggtgctttgaaatagatccaacatatcctacttcaggaggagtgtagtatctcttccatgcgaggttctttcttgaagctagttatgtctacttagacgtatacagagtctaacattgatcaacttaaagcctggccaaatatccatggcaagcttgtcagatctgacctctggatacttagagcatgaggtcctgggggtcaaacctgcagggaggcactggtttctgggctgtggctcatggggctcacaggagtgatacaaaaagctgtcctggggatctgtgaccaaatcccagtaggctgagctctctctgaaggggcaaatggtttccactgtattccttggagaccaaggcattgtgttggccaaatgaagttgtggggtggagatggggtgacgaggaagagacagtgagcctccccataagtacccctcccacttcaactcgtgcagctctacatttttttttcttttctgtactagccttcactgtccgcatcatttgaatacagtgttgcaattggaaacaaatttgaaaactactggactcggcatataaggcaatctcagatgcatgcaaaagagatggaaccctaaacacaggcaatagtcagcaggttccaggcagttggtgggagcccaaacctgagtaaattttctgaggtgttacagcctcagatgcaggtgagaaggaggctaaaccagtgcagagactgctcaactccaacaggaccaccagattctagcaagctcctttggcatgccacccttgggattttcaagatacgtatacacccaactcaggccaggcaggggagctcatgcctgtaatcccagcactttgggaggccgaggcgggtggatcaactgaggtcaggatttcaagtccagcctgaccaacatgatgaaaccctgtctccactaaaaaaaaaagaaaaaaaaatgaatagttagctgggcacggtggcaagcacctgcaataaggaggctgaggcagaattgcttgaacctgggaggcagaggttgcagtgagctgagatcgcaccactgtactccagcctgggcaacaagagtgacacttcatgaaaaaaaaacaccacaaaaacaaaaacatatacacccaattcaaggataacacactctaggcgagacagtgtataagaacaagtcaagtgaattggtctctggacttaataaaaataagtactatgagagttgtcctgttccagagaaattattttttagatattaaaaatttcaacagcccttgatgctaaaaactctcaataaattaggtattgatgggacatatctcaaaataataagagctatttatgacaaacccacagccaatatcatactgaatgggcaaaaactggaaggattccctttgaaaactggcacaagactgggatgccctctctcaccactcctattcaacacagtgttggaagttctggccagggcaatcaggcaggagaaggaaataaagggtattcaattaggaaaagaggaagtcaaattgtacctgtttgcagatggcatgactgtatatctaaaacaccccatcatctcagcccaaaatctccttaagctgataagcaacttcagcaaagtctcaggatacaaaatcaatgtgcaaaaatcacaaacattcttatacaccaataacagacagacagaaccaaatcatgagttaactcccatccacaattgcttcaaagagaataaaatacctaggaatccaacttataagggatgtgaaggacctcttcaaggagaacaagccactgctcagtgaaataagaggacacaaacaaatagaagaatattccattctcatggataggaagaatcaatatcgtgaaaatcaagttaaataatgggttatacttaaagtaatgggttataagttagtatttgcaagcctcatggaaacattgagtcaaaaagcatacaatggatacacaaaaaataaaaagaaactaaatcatatcaccagagaaaacttcaaataaactatctaacaatgcattttaaagaagcagcaaagtaagagcaaatcaaagccaaaattagtagaagaaaagaaataataaaaactggctagacatatgaagaaagatgaaactggatctcttccttacaccttacataaaaattaattcaagatgaattaaagacataaatgttagacctaaaaccatgaaaaccctagaagaaaaccgaggcaataccattcaggacataggcatgggcaagggcttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaatttttgcaatctactcatctgacaaagggctaatatccagaatctacaatgaactcaaacaaatttacaagaaaaaaacaaacaaccccatcaacaagtgggcaaaggatatgaacagacacttctcaaaagaagacatttatgcagccaaaaaacacatgaaaaaatgctcaccatcactggccatcagagaaatgcaaatcaaaaccacaatgagataccatctcataccagttagaatggcaatcattaaaaagtcagggaacaacaggtgctggagaggatgtggagaaataggaacacttttacactgttggtgggactataaactagttcaaccattgtggaagtcattgtggcgattcctcagggatctagaactagaaataccatttgacccagccgtcccattactgggtatatacccaaaggattataaatcatgctgctataaagacacatgaacacgtatgtttattgcagcactattcacaatagcaaagactgagaaccaacccaaatgtccatcaatgatagactggattaagaaagtgtggcacatatacaccatggaatactatgcagccataaaaaaggatgagttcatgtcctttgtagggacatggatgaagctggaaaccatcattctcagcaaactatcgcaaggacaaaaaaccaaacaccacatgttctcactcataggtgggaattgaacaatgagaacacttggacacaggaaggggaacatcatacactggggcctgtggtggggtgaggggagcagggagggatagcattaggggatatacttaatgtaaatgatgagttaatgagtgcagcacaccaacatggcacgtgtatacatatgtaacaaacctgtacattgtgcacatgtatcctagaacttaaagtataaaaaaaaaaaataggcctggtgtggtgactcacgcctgtaatcccagcaccttgggaggccaaagtgggtggatcatgaggtcaggagatcgagaccatcctggctaacatggtgaaacccatctctactaaaaatacaaaaaaatagccgtgcatggtggtgggcgcctgtagtcccagctactcaggaggctaaggcaggagaatggtgtgaacccgggaggcggagcttgcagtgagccgagatagtgccattgcactccagtctgggcgacagagcgagattctgtctcaaaaaaaaaaaaatttctaagacccaccaaattattcaattatttcctccctgcctccctctctcccttccttccttccttccttccttccttccttccttctttccttccttccttccttccttccttccttccttccttccttccttccttctttccttccttccttccttccttccttccttccttccttccttctctcctttctttctccctttcttccgttgtttctttctttcttttcccttctttccaaatttactgggtacttaccatgggccagacactagaaacccaagaaccaatgagatatgtcctggctcccaaggattttattgatttgtgcgagttaggcaagtaagtagacaacacaacacagtacatgttagaataaaggagatggtagggcctattggatcagttatgggcagtttacagaggccagggagggcttcttatgagagggaaacttatgatgaattctgaagtatgggagagtcaacctaatgagaagggcattctgggcagcggtgatcaccatgggctgttgtggcccttgggaaactcatgctctttggaaccggctgaatttagtttttaaatctgacctcatcatttactgagaacaggaaaagttatttacttcccagcagctctattttttccgcagtaaagtgaagaaaattaaagagaaaaagcattctagatgaaagtggagtattgagtaggtgctcaatcatgatggaatacctgtgctaagccaaggagtgtaacgatgtctagtaagtgaaaagggatcttatcagggtgtgataaaccatcggttcttttaagaggattccttatcatgtgtttaagtacttttttaaatatagattttcaattttttagaaaaacagcatttataatatctgttgtttatttctaaaaataatgatgctggccaggcgtggtggctcatgtctgtagtcttagcactttgggaggctgagacgggtggatcacctgaggtcaggagatcaagagcagcctcgccaagatggtgaaactgcaagtctactaaaaatacaaaaataaataaataaataaatagctgggtgtagtggtgcaagcctgtaatcccagctacttgagaagctgaggcaggagaatcacttgaacccaggagatggaggttgcagtgagccgagatcacgccactgcactccagccagggtggcagagtgagactccatctcaaaaacaaataaataaataaatataaaaataatgatgatgattttgcctgaatacggggaagaagaagaagaagaagcagctagatttaacttgagtgctccaacatggataggacctttaaaacttcgagagtagttgctagtgacaaaagtttatttctttttatacatatttattccagaagcaactaaggctcaaattagttttatttttatttattttattctattattattagtttttgagacagaatcttgctctatcgcccacgctggagtgcagtggcacaatctccactcactgcaacctctacctcccaggttgaagcgattctcctgcctcagtctcctgagtagctgggattacaggcatgtgccaccatgcccagctaatttttgtattttttgtagagatggggtttcaccatattggccaggctggtctcgaactcctgacctcaggtgatctgcctgccttggcctcccaaagtgctgggattacaggcgtgagccatcacacctagcccagttttatttttaaactaagttttattttaagctaaggctcaaatctcttttattgttaatttccacattgtgaacatcttatctctgtttatatgaacaaaaaatgatgtgtgtcctttatagtgtagcaatgttaatatataaacaacaagaaaatgataccaaatagacaataaatgcattacagcatgtcagagaaattgcatcgcattcatggccagaatattcaattcattctttgctttattagacttagggacaacaccttccctctgacaattcactgtctgtggaattataaacttgcaatgtctatcattgctgtcaacctaatgaaaggggatggggacagaaaactccagggaggaaatggaagctcacagatgaagcaagccgagggggtagaggaaggcctgaggatagcgggaataactctgggcccaggattctccagagacaaatagacatggcaatgccaggcaagaagctgatggtgatctgaaccactggagtgcacagctgaagaggtggaaatgtctcttagctccctaacaaagccactgaagaagacgctcagggaggtgattaatgagcccccagctctgacccacatcccttctggaagttagcctttcatggggtcaaacttactttgaaaagtcatggagtgaatttgcttccccaagagtcatgtgaaatgagttagtgggaggtttcagaacatcacattcgcgggtggagggatactttaagaggcactgattgcatcaaagctcctaagaaggcgagtgaagtatttgtatggctttggaagaactagctgaggtgtttttttgtatcacgaacttggatattgggggaagcttcagaatactttagcagataggaactctgctgagattactaggtcctaagaggaatggtggcaagagggatgccagcaaacatgtataaaatgaaagtgttttcaaaaatggaaaaatatgtaaagaatatgtgtgtgaatatgaattaccagaacagtaagatgttaagagagttcaacagccttaaggaatgtgggggtcgatcactatgtctggcacgtaattatcacacactggtttattttatgaggttgaattaaatgttaagacacacagattcttagaaaagtgtggaagggcatattgcccagcaacccaccagtgcacgagatgggcctttccctgccaggggcaggaggggtaccttgcccgtgatctgcacagtgactcgcccctaccagctcctgtctgcacaaaatatgctgctcttgggagcagccattactttttaagtagtaaaataacaaaaataataatatccggaaatctgcgtggtcagaaccacagaaagagaatgaaccaggaaaaccaggaccaggtatagagagcttctccttctggcctcagaagtgttaggcaatggcctcatagctccaaactacatttttctattcttaatttattgtttcacatgcatgtattctgaaattctatgagtagcaacttatatttgaaatggtctctgccctctccccgcaaaagtattcaaatacttgggtgaggactggggatcagtcagggacacggtggttactcacaaccctcttgccttactggattggcagtctgggaaagatgggcaggctgagagagttcagggagtttttctttgggatgagggaatatgagaaactttgaggggatgagaaagagttactttagttgttctcagctcaaatttgagcagatactcctttctccccaatggccatcagcttatgacatcgctcctcaattccaattattttccattcccacatatgtccaagggaagagctcctgccattttgtgtgtgggactccagtgactccagaccagatgacccctacagacagaaaaggacagcaagcagcatgcagttgggctgcttggctcaactctcacagccagtgacgctggggaaaggatcagatgaggaaaagtgcctgtcacagtgtctgagataaagtagcatctcaacaacttattaccccatggcaatttttaaatatagaatgtctttcaaacatttttttaaattttatttttaattgacatataatacttgtatatatttataaggtacatagagatgtttcaatacatatatgtatagtgatcagataagggtagttagcacaaccattatctcacacatttatcacttgttttggaaacattcagtattctccttctagctacctgaaacaacatacaatatacttttgttaactctagtcatcctacagtgctatagaacactagaacttattcctcccatctagcttaatcttatttcccttaacaaatctctctgaagtggccattttgcattgtgagctaatattctctctctctctctctgtctctctctctctgtctctctgtgtctcacacacacacacacacacacacacagaattgatacacttctatttttaatatgtctcctgggagtctcatatgtctaaattctgtttcattttgtaagaaatgctgactgagacccagtaaattgatttcctaaccaacaaggaatagctaacagctgtttgaaaaacgcagtcctaataaaatttgaatgttccagtgggctgtaaagggttaaaagggttaatggaccctaaagggttaaagtgaggcactgtgccctaatctggccacattcccatcatgggcattatatatcaacgggtgataacaggactgagttctctttccagtccttagatataaaagggagacagcaattaggaagaaagagagttataggaagtggtaggaattgaagagaaagtagaaaagatcttaactctaccttattaaagtttcatgatccaattacaaaatagatgttttattttctaaactggcattttggtttgtgataacaccacacacacacacacactctctctctctctctctgtctctctatttttgcagctctcttcagaattttctttagggaccctgataaatatacgtgatatatttttaaaaattgaataatggaaggattaagacctggggccctaataatcaattaaaagataatctgatcatgtctttgcattttataggtgctgctttatattctaatttctaatatttttctttcaaggaagcttacaggttcgctatcacctaaacaaggaagaaacccatgtattcaccattgatgcagataactttgctaacagaaggatgcaccacttgaagattaaccgagagggaagagagcttaccattcaggtaccttccttactttctcctgcttcagccaatgtgccttggctactctatcaaacttttctaagcttctaccccatgccagtgtagtgcctagtgctggaaacatagttacaaatcacacttgcccccagacttggaagaactaggatagtggttctcaagatgtgcttcccatgtcccaccagtatcagcatcacttgggaccctgttagaaatgcagattcttgggccaagtgtggtggctcacacctgcaatcccagcactttgggagtctgaggcgggcagatcaagaggtcaggagttcgagaccagcctggccaaaatagtgaaaccccatctctactaaaaatacaaaaattagccaggtgtggtggcacacacttgtagtcccatgtactcaggaggctgaggcaggagaatcgcttaaacctgaaaggcagaggttgcagtgagcagaaatcacgccattgaactccagcctgggagacagagcaagacttcattaaaaaaaaaaattaaaagaaaaaaagaaatacagattattggctaggtgcagtggctcatgcctgtaatcccaacactttgggaggctgaggcaggtggatcacaaagtcaggagttcgagactagcctggccaacatggcaaaaccccatcaatactaaaaaatacaaaaattagccaggtgtggtggcacgcacctataatcccagctactggggaagctgaggtaggagcacttgaaactgggaggcggaggttgcagtgagcagagatcccaccactgcactccagcctgggagacagagtgactccatctcaaaaaacaaacaaacaaacaaaaagaaatgcagattcttgggttccacagcagatctattaaattggaggctatggaagggggaaagcagcaggtgatactaatgtctgctcaggtttgccaaccgctgggctgcattaaagtgaggaagacgcatgggcaaagaggaaatcataataggctgtgggaaggcatgtggtggaagcaggcacaggtgatactgaagagggtgctgatcccacctgggcatcagtacttacttcctggaagaagttaggagtaagctgagtcttgaagatgagtaggagttggccacagggaggaggagagtgctcaggaagagggtccatgtgagcgcaggctaaagctgtctgaaagcatgttgtgtgggaggcaccccatgagatctcagtgggctccatataaagggccagcagcagatgatggcagagcccaacagagaatagacagagtccagatcatcccctttaaaatcatgaccctcagcaagcccttgcatctgcctatcaatcactccatgttttttaatctgttctcctgttctcctggttgaccattttacactctctcctctttacttatactgctaacaattgccagtttgtcttaactctgagcagatgactttgctttcttatttcttgtaagaatttacactcttacattcagaagagaatatccgcacattctcaagagcacattacctacctaccacatgtgtgtttgcactctctctccctcctgaatagttcatggttctagctaaggcctgaccttgctacctgtgggtcagatctgataccctactgaagaaaatcactctagcattctccttcctccctccctttcatcatttattccagctctactgaatggctccccaaagcctaaaacaaataattattacatgcattaagaactaatatacagacaacaatagctaaacaagcaaacaagccagcatatctctgggtaaagagaggaaacctttctcttatctgacttcttacagtgttccattctctttgtccttttcttgcccgaatttttggaaatgttgtttatatgcttgttcttcatattttccctacctttttcttatacccataccgaaaaggtattgcctctgcactgcagcaaaattgtacttctcaaggcatcattgtgcttacctggcaaaatccagtggtcatgtctcagtgttatctttccttgtcctctcattgacaactgacatagggattccttcctgttcttgcaacttgacctaagtctttattgcttgcccaatacaactctcgcctgttgatccttctgcctgtgttagttgctcactcttgtctcttttgttggtttcccatcatctctcaaaactctaccccaaggaactctcagaacgcccaaggactccagcttctgcttttgatctacactcactccatactcatctcattcgatctcacatctttaaatttcatgtacatgctgatgaatcaatcctgaatgtgtatctaacactaatcctgtccctggattccagaccttataccaactacctactgggcatatctatatgaatatccgttaggcattggaatatttaagtaaatagttaaaattgacttattaggaagttctcctgaaacaatgacctcatcccctgcaagcatgtcccagttagtggcagcttcatttttcaagtccatagtttcaaaattgtggtattctccttttatctctccttctcttacatgcagcatctcgtggatcaacagcatctacctttccccaagccacccttgccctttgcttggattatcactgtttacagttgccttttgattgacatctccctgctcctctttaggttccctggctgtctatcctcaacatagcagtcagagtgatcctggtgaaggaatagatcctggcattcttttgtccaaaccctgtcaatgatttcctttctcgtacagagaaaaagtcaaaggtcttccagtggcttataaggatctccattatctgacacccctgctcatttctggttgcttctctaacctcatctgattatatgccctctggaactctagttgtgccactctggcctctttgctatttgcagagcccttggactcactgctttgcctaggatgctattctttatatatactcatgtccagttcttgtacttccttctgcactcaaatgattcaaaaggtcattctcattgaggccatctctgatcagcttatttaatagagcaacctatttccttgacgtcaaccctacacccccccttattcttgcctgcattatttttttctctcagcacttaacttccaatacaatgtatttacttatcaaattttctgtcctgtctccctcctctagaatgtaagttgcctgagaacagaggagggtcgttctgagcagacgtgccaaaggaaaatcatggcaggggagatgggaggactatgtatgagtccctggtggattgcactcaagctgtgcaaagtcaggcacatggctaatgggatcttagtctcctcttcttacaggtgaactgtaaaataatgaggactctttctgggaatagcaccatatgcatagtcagagtagagcctggaagaaaccagtaggatatggctagcctgaaaaagtgagaatgaatggggagggctccctaggaatgggaaggggactgaacaaatggagctggaattagccatgggtgaagtaaggagggatctctaaaggatggtcatagaaataaagtcctactgaagtcccagtgttggcttttgctcacccctgcaagatgggattatcaatcgtccatgttggttgcagctaactgttcagctgccctctcctccccaggaccacatgttttgtcagactgcaatccttgcccaggaaaagctctctgcccacaactaaatgagaccaggtcagaattatgggacaatggggacagtggtggccctaaggacaaacagagagaaagggggagaaatggaaaatgagttcctgcttcctattaatgttaatcttgcacagcaagttcctgagcaggtttcatttgtttgcttgtttgcagcaaagaatttggtgagaaaatctctgtggggagataaatacctataaaacgctgtatacagtttcccagggagaagacttgtgtgaaaacccttatttcacaaagaagaaagaaaggggtattttatgtgcgttgtgggcaaattagcgagacctgtctaatctctcctgagagaaaatctcagaggggggtctgctatctgtatgcattttttcaagctatttccagatgggatcgttttatgcttcttacctgcagacctctgctgatgtgcctttgttttctgttttcctgcagatggaccagcaacttcgactcagttataacttctctccggaagtagagttcagggttataaggtcactcaccttgggcaaagtcacaggtatgttgttctagttcatacctttccagtgggctttattaaaataaatgaatgcataattttcattagggtgtttaaggattcaggtctggagccttttgctcccataatatctgagatctgaaaccaagatttcttattcagaaaatgccaagatgtatctgtggcagaaataggcaatgcatttctatctactttataaaaacttgcaagaggtaaaatactaaaataatttagcagaatacttaaatttttacttaattttcaaatatatttttaagttttacttaattttaacttaaatgtatgagtgcatacattaaggatttgagcaactcaatagttcatcaaaaattttaaaggcattgtaatttcctattataatagtgaatctttttttttttctattggaagttctgtcaattttcactttatatatgatgacagtattcattacatgcatacaagatagaaattttttatctacttgatgaagtgaacattttatcacacttaagtgacctttttaaactttagtaatgtctttttatgcttaaatttattttgcctattattaatatgcctattacaactttgcttaacttagtgtttgcctggcctcttttctcattctttttctttcaatttttccttttctttcagctttgtaggtgatcttgtgaagaacatactgctagattttattttttatactcaactgtccatccatttttttataatggcaaatgtaggtccttctacattgtggggctacttgtaaagttggattttgtttctgctacccgatttcctatgtatccagctcttcctgtgattctatcatattctttctgactctctctctatcacagtacaatgcagaaaacattaataactcaatgcatggtaagcagaaatacatttaacacgtaagttagttgcttacaagattgttgtagtacttacagtgtgggttctttttggggtcttttggaatgacttcctcgtgccccatactgtatgcaaattcacaggtagaaggaggaggtatctgaaaaatggctgtggaaaaagcatcacgggcccctgcttttgcttgccagtagaaagagctgaaaaggcataaaaatgattcttgctacagccctcaagcttcataaagggtttataatttccagatgtaatgttgatccagaaacctagctgaagtagggtcaaaaaaatgtccattttagttccccaaatagcagttggaagaaccaatcaacactgatccctgattgagtttatttctgattccattcacagtcctaataataatcatttttatatttttcagatactgcttatttttgatttattaatatagacactagtttatacattcctcatttcttcctgtatctcagacttttctatcttctgccaggctttatttccttctttttaactaaattcttttgaattattttctgtttaaggttcccttcattatacatacatatacatatttacttacttatttatttattttcctgaacaaaagttttattttacctttaatcttggaagataattttgctagatcttcaatgcaatattgaagaatattttctctcaggtactgagaaatcagtcagaggtgtaacggagccagtggcactggcctttaagaaccaggtatacatgtctctccccaactctgcatccttcagtggtggcaggatgccagcttgaaatcagctgtagtaggagggtttacactgtggatatcagaaatgctaaaagccaggactttccctacctcttcctactgaagagccagtttcaaagactcactggcacatcagtgtcctcttgttttctggcttccccggttgctaccaagaagtccgctgtccatctgtcctgctattgaaggtgctctgaccacctccatacctactacttacaagttgatttaaagtcatccttttttctttgatgttttgcagttttgtcatcacgtatctgcttgtagatttctttttaaaatatcttacttgatatttttatgtttcctgttcgctatgtcatatgtatctatgtatccagttcctatttattattcatatgtatctgttcatcagttcttaaaaattctcaacatatcaaatcttgcttcctcctattctatctactcaattcttctagatctaaattatatgaacttagacttgctaattctatcatcatatttcttaccctctttttatagctttcattctttgatataacatcttgcattctgggcaattcatttggctttagcatcacattcactagtcctctccttatttaggcctaatcccattcaatgaatcatttcttattgatttcatctttcatttctaaaaataatattttgttctttttgaagcatggctattaataaagataatttgttgtctctgttcttttgtttgtttccatctttttatgtatttaggcatttcattaatagttattaaacattttgtctctgataattccaacatctgaagtctgtgagggtcccagtctgttactagctgttttctaaatttttcctgtggtaacttgtttccttatgctgtgtgtgtgtgtgtgtgtgtgtgtgtgtgtgtgtgtgtgtgcgtgcatgtgcgtttgttcatattgattacaattaatttgtgacaactctaaggatcaaaaattaagacactctcctcaaaataagatttttttttttttaacttctgccaggtgccaggaggtactaccaatttaggacaattttaatttctcactttttttttctgaacagagaagaaatataaatttgagctccatacctgaatgagatcagtcttctggttgaagtcttagcggaaatgttgttactattaatatcattaaccaaattaaaacacccttagaaagagggaaaatgtgggcttacggaccacaaagcccagacctttttcatggcccctgctctgtgtaatggaagttccaataataccctcttgttaaaaatgaaaaaaaaaatcctcattaaatcttaccactgtgtatagcattcatatgacccttcacacttttagctaagccaacaataaggctggtgaattgaaactttacagcaaggtactacagacaacttgttattttatttctggtgctttgtaattatcaggtagaaaagaactgttaagattgaggaggaatactgtattagtccattttggcattgccataaatacttgagactgggtaatttataaagaaaaaatgtttaattgacttatggttctacaagctgtataagaaggatgatgctgtcatctgctcagcttctggaaagcctcaagaatcttaaagtaatggcaggagacaaaggaggagcaggcatgtcacatggtcagagcaggaagaagagcgaggaggaaggtgccacacaattttaaacaattatatctcaccaacttactcaccattgcaaggacatcaacaagaggatggtagtaaaccattcaggagaaatcctccctcatgagccaatcaccacccaccaggtcctacctccaacattagggattacaattcaacatgagatttgagtgaggacacagatacaaaccatatcaaatacccaataaaatgtcttcattgttctaagaatgggagacatctgctcactgggctgccttcccatttgaactgccgttgaacagatggaaggattttgaccaacacttaaccttaacactctggtctatgaaagttccctagcagaaggtaaagggagacaatatgaacattcaggcttattatttagaaaggacgctaatcctgggggacctttggaacaaggaaaccaaaccctatgtatcagaaatagagtaaagtagggatggagaaaacaggaagagatggtattaaaatggctacatggaattaatgataaatgcaactgaacttcacaattttagaaaagattgctttgtaggacatttccaactgtaaatcaaacactagaaagcatttttcatggtagatatgaaaagaaaacatacgtagtaaatctagtgtctcagttttcttcagtaccatcaatagcatttcattgcaaagcaaaagcaagtttgttcattttctttttgtctgagaaaggaaaaattccttactaaagaggactgtggtttagtacatactctataccagccacggtgctacagatactgttataaataaagcagttttttgtttgtttgtttgtttgtttcctgaaggtccccatgatgtagatactggcccatgaaaaatagcagatttaattgtgtacattaaaacttcactgttggttctctaagaatgttgatgctcaaatccatcaagttacgggatattgcaaggtttattctttggtttactgacatttcttaactttcaagagagattacttggttctggcctattgcatcagtgaatttaagaaaaataacattaaaagagagagagagcacatatttagggaagtaatccatttggaagagataatgtttctggaaacttgcttatttcatttgaaagtatagatgtgtatgcctcagattcaaacatagtgtgctttatcactgttatttctaagtctctgtttaacttggccctgtcacaagagcgtagacagccaggcagacataggaattgaaaaaacttgaaacttctgaaagaaactctgccttttttgtttttaatttattttttttctggtcctgttgtccccttctttactcttctaaaatatatcaagaaaatttgatttcaaaacaaaaactactattgtttggtgaaattaagaattaagttattattattatctcttcttaaagaagacttcttgccaatctgcagaattaagaagtagctactttttaaacatatggaaacaggttaaagtttaggtggaaaagaattatagtactgcctttaaactattgctaccaaattctgaagagacattaaaatggaatttgcactcatggcatgctgatagcattatttttttatgcagccaacgtttgttaatctcctacttgccagtttgataggcctaagctcacacctgacagaggcattattcttctgctccaatggctgtttgcccatctagatttcaatatttacttgcctcaaaaaaaatacagaaattgaaagaatttcttctcaagatgcataaaatttacagctaatctgtaaattgcagagctatctgtgagcacttacacatgattttgacatgttaaaatgagttctgattgcatctatagaacagggttctttaattctccccaatccctcaggtttaaactttgagcctactgtgtcttgtccaacattacagtatcattgaatgaaaaccctgaatgctttcacataaaatcactttacaagcatcttgcagaggttgaattatggctgccatttatagaaagcacagaagaatttatgcatataaataaaaggtgtgtacttcaaaatgctcactttggaagactgaactctaattcctttttgattttggacacagagccttcttatgattcaaatctgggagtcaatgctaaaccaggaagcaaaattctacagtggaagatgctcagctttttggagacaaattgacccatgtttgcatctctcatgtagttaaccattgtgtgaccttggtgaatttatctaacctgtttatggttccttattggtaaaatgaggatagtaatacttaattcatttaattaattcacagagctgtgtaagtatttcttgaagctttatatgcaaattacttggtatttagcatatactcaagaaatgttggcttatttttttctttactttcaaggttgtagaaacgtaaaagagaaccatgagggtttttttttttttttttctgttttcttttttgttaatgtgtctgtcaaggtgactgtaagtgtaacttccagggaggtgctcaactgtgctccaaaagagcaattctgaaccatggtgagtcatacagaatctagtgtgactcattatcaattagcactgtttcaagggtgtatcaaactcataccagcttcaacaataacaacaaaagagaaaacaatagttggtgaaaatagaagtttcaaggtgtaagatctgcttcaggtacagctggcttcagaatctcaaatattatgattcgggtttttccagtctgtctgtttctcactccacatttgactgcttaccgcttggaggtgcttcatttgcaggcaagatttcagtggtaatgaaggtgaaatcatcaactccaggtttaagtagcagcagttcaacattccatgtggaaagaaaacctcccacttttaaagttccagaaaactttccttatgttaagtcatgggattgagttttcaaggaccaatcccagaccatggcagtgttcaggtgattgggatctactgcatggccatggccaaattattcacccagctatggctgtgaagagagtggagatagttcagcgttaattgcatgggttgaaaacagggaaaggctacttctcagaagcaagttgagctgttcttaccagagaaagagaaagatcaacaatgatctagtaatgccacctcttcttctcttttgcattttgctctcccttttttaagaggagagaagagggtgcagttatagccatgggctaggaattgtggctcatttggggaaaggattgtgccggtgtgcatcaacagttcaaatatgttgcggtatgaaaaataatagttgagctatgctcttttaataaataaatgcatgtaatcttctttagaacaagtttatagcttccaaagtgactcctctaaaagattatttcattttaaatgcataggcttctcaaattatatttcattttgtttatggtcatacatagttctttagtaaatactaaatctccaaaccacagcctttttcagactcaaatcctcacattgtgtgtaattgctttatattttgtccagataatttttaatgatactgtctgtttgggtaataaagtattttagattcgttaatctaatttgaccttccgcatcatgaaataaatggtgtgttttagagcatcctgaaatatcagatgtcagtaatcatcctaacttcccaaacacgcatgtcttatattttctactttgtagataaccagcactgaattgcaactgggttagatgggatttttgttatttttttcctttaacaataacaagttacattttttccccacagagaaattcagtagatgatttagtttctcctcatgcaacaggaatgtgtgttatcttctgatttaagatgcaattttatttctgtgtgttaaatgaatcacctcatgatagcagtgccagcgtgctccatgctctgcactgctctgtagaagttgtctgttttttctaagagtgaaaccactctatgaatagcatgcccttgagttactcattttatatcgtcacttgcctgctctgtctatactagtgactaaaaaaatgaatgaagtaaaaatatcaatgatatgttgtttccaaatgcagactgtcttcagctgggaggagctgttagtaatctccttctaagaggggtggccttcacggatttgccagacattacacatctttgcctgactgtgatagtgaaggatgttttgtgtggtggcccagaagtcacatgacatgactctcattgatataaacttcaaattcgttctcaagcaaaaactattgagcattactatggccacacaatgtgtgaaacaaacaaatataacagcaaaaaaactgtccttgttctaaagatcttgcttatcttaaaaattaattctttcaaaggaaagttatttgggtgggatctgttggtagtattaaagtttttcaaggttttgaagtatcccgtgtaggctatgctaaatattagattttcttcactgttacaaaataatagtactaaaaatggtataatatttatagcatgctaataccaatagtatcataaaactagtagttactgttagtattattatttcataatatctttctgtatgctaaatctaaactcgttccttatgctaatttatttttcccctggtcattacccagggagataagtaccattcttatttctatttttatagatgagaaaattgagtcacagaggttcagtgactttctcaatatcacataaccagtaagtgtctggattccaagctcctaataaatcctgccacagtttggtttttaaggaatgatatgaaaatttcacacaatgcacagttcatttttctgctgagaagctctgcatcaaaagtttgtctttttagacttaatgggcttaaaagtagaggtagagtgagggagtctttaatcatggagagaggatgacacatttcttgtaagtcaggctttggaatcagctctgggttcaaattatgacttcaccactgactaatgtgacctggacaaattactaaatattccaaacttcagtcgtctcaattagaacacaggtatatgttattatgacaattataattccaaaaatctggtggtaatgcaaatgatgtgcctaggatgatgcctgccatttaataacagctcagtaaggtttgtaacaccagtataataataatataagaagccacttcatccaacctagcattttcccttttggactctaattgccttccagctaaaggtatcctagtctttatgtaacaaagcttaaattttactcttctctcccactctaggggaatgaatggataaggcaaggtgttaacatgactttaattgatgattggtaaacagtggaggtggtagtgtggacaatatatttttatttttttatttgttgttcttttcttttttttttttggagatggagtctcactctgtcacccaggtgcaatctccactcactgcaacctctgcctcctgagttcaagctattctcctgtcccagcctcccaagtagctgggattacaggtgtgtgccacctcgcccggccaatttttgtatttttagtagagatggggtttcaccatgttggccaggctgatctcaaactcctgacctccagtaatctgcccatctcggcctcccaaaatgctgggattacaggcatgagccaccacacctggccaataatacttttgataaaatcatctgaaaagagttaactagaccaaaacccacctgaaattatttaaacttatttcctcaggagtcaagctgcctctgatgggttataatcatgttatactttgtgagtcagtcaagcttaaaatcatcaaatccagtccgatgcttaaacaccccagacattaccactgtccctctccacttctcagcatggggtagtcatgaggttccaaagacaagaccccagcctcatttacggttttatcttccctgctactgtattggcagacacatattacatgttctataatgtatgttgaaggaaaacacacacaggcacatgcatgcacacacatatatgtataatgtataaatattagaactgtggttacctgaaaggttatcacactacccatgactgggcccaatgttgtgcagctagctgcctcccagacttggatgagtatctccagcttcctcttacaatgtatttttctcacgaatgtgtgtggtagtgagatgggaaatgaatgggttgggagtcagacagtgctgagctcaaaccatagaaaggttgcttcttagctctgtcatgactaacatcacctctctgagccttggtttcctcatctgtaaagtaggagtagtaatacttgctttatttatttgttttgaagatatgagataatgcctgtgaagtgtctggcgcttagtggtatttgaaaacagcagctactgttaataagatcatacaaccatgctgcctattgattttctttgcctgatatccctcttccttgccgatggctctgctattgatttgtttgccctttgcctggggaatctgggccagtgttataaatgtcaatgttgacaaggtaatgaagtaaaaaggatccaagctaagagtaatgaactccctgcggcggccttatagggacccctctgaagcttggtgagaatggaagcactgtattggccagaagctgaaagaaacaagtggaacaagcacagattagaattctaggtgctttcccacacagaaggagagggaattgaggctcgaggagtgttgtgtggccactggttactcatttagtctaccaagattttatttttgcaggatgccattaatgataataaattgagttttaaaacagattaacataacgtaaagctcactgtcacttaggaatgattgtatatgccatttatccatttctaagaatgatttgacctgaatctgtgtatttttcctttacacttgcacaattatcattgccagtgatcagtgtcagagctagggtcttgtggttaatattctaaagttctctgcctttttcttgataaagaatcacatggcctgcttcttagtgaggaaaataaataagtaaatcattctacctaggaaattctagttttagttaattcccttaaaatcaactgctgcctactctaatcaactctaatcaatcatatataagacttgaatatatgccttatctttctcacttattttcttacctttttcttcaaaatgattccatagaatataagccttgcacagagcatgcctcccataaaagataaacattatataaatatttggaatcagtaaattgctccctaacattgtttgtagataattcattgaatgcattattgaatacctattatatacaaggtgatataataagagaaaatatgaaaactttaaagaagtaaagcctatggatctttgttcccaaagtgataaaacaagtatctgtgaggataagacatttatttaattaggatataaatagttttgataagtgctttacagatggagtgtgcttaatattcataaaaagaagagatcatttctagctgagatgacccagaatgttattgtgtggaagatcaccttgactttagtcctgaagcacaggtttgacctcaatagatggagtacattccaggaaggaggaatggtgtgaaccaggtaagactgtaggaaaacaaagatagtaggatagaaacagtaaataggccatctgagagggtttcatacatgcagcagagtagagggagacaagggaaacaagaacagtccattgggagaatattacagaggacatccagtgctctgcaaaggcattcagaatctattgtgtagagaggagagagcatggaaaggagctctcgtggtcagagctgctgttatcagactctcttgttagtaacaagcaagatagaggaaagagagactggtatgcaggctatgctaatgcctaacctttggatacgaaagagatagcaatggaacaggggagcaggtgcaggtgcagtttgtaaaataagaattggaagatttgggtaattcactgggtaggtgggtggcagagtacccagggaaggaatggagaggacaagaggaaaggaaattacagcagatttttccagtcattacagagggaaataaattcgttctggtctggcctgagcccgagtttactgacttggggcataagttacaatggattataaagctgataccttaccctcttcctttgagccagctctccagtcctgctcagctgcttctggatttgagaaatccctgtcatcaagaacagggggaagagaagtggattggattgctgtgaggagagtccagttgggggccttcactgtggcgatgtccacagtagtccacagctgcatgggacagatctctcccagccttgaattttttaccattgcctgacttgtatttcttatctgtgtatgtagctgcttccttgggaaaagtgtggtccttgaaggcaggaacattttgttgtcaatattcttatcactcccactttgaaacatgggcctttgtgctttgtctatgcttctatgtgtttcataatacacttcttctgattagtaatgcatcacaggtggtagacatgttttcaattcaagggggaaatgcttgcactcctattcctgattttaggatccctactagtgtgaccagtcatgctagtctactcaagactgcgggattcccagggatgtgggattataggtcctaaaactgaagcagtcttaggaaaaccagcacagcctgtcgcctaagccacactcagttcaggggttttgaatagtttaatggaactggacccagggctttgaatgccagatgaacaactgagtttcatgctttgcctagccacagctgagttcaggggccaacatccctgaggatatgctgtggtttgaataggtgaggttagaaaggagcgagaatgaaccactcagcccactgaccagcactcactgagtctctgccggggtgcagcatagagcaccaggtgtgctgagatgacaggaggggggtgtgggattgtttattcccttaaatattcagtgccctgggtggaaacccaaaattgtgtgcaagcagtaattacagaacaattgatctttaaagcatggaacttgtattcaaagggcatcattaaaagactagagaaaggagaaatcagaagtaaaactatgtgtaaccaaggtcctgtttccctactgattttgggtggaaggccagatcttctctatgaaggatgacacactctgtctagcgtatgcagagatgctgtcttcatcagagagaagtcctgcaaatatgcacatttcagatgcagatcacatcagctgctttaggtctgtgaacaggaagttccatatgtgtacgtctgttttcacactgctaataaagatatacttgagattgggtaatttataaagaaaaagaggtttagaagactcacagttccacgtggctggggaggcctcacaatcatagcagaaggtgaaggaggagcaaaggcacatcttacatggaggcaggcatgcagtgcagaaggggaaaaagccccttataaagcaatcagatctcatgtgaactaactcactatcacaagaacaggatgggagaaactacctccatgattcaattctctccctcccaaaatacatggggattatgggaactacagtttaagatgaggtttggttggggacggagcctaaccatatcaatatatatcatccattctcttttttttttttttttttgagactatctccttctcttggccagactagagtgcagtggcatgattttagtaacctgtgcctcccaggcttaagcagtcctcccacctcagcctctcaagtagctgggaagacaaggtcatactgccaagtacagctaatttttgtattttgtatagagatgggctttcaccatgttgcccgggctggtcttgaactcatgggctcaagcaatctatgtgtctcagtctcccaaaatgctgggattacaggtgtgagccactgtgcccagcctgtatgtgccaattctaacaagagcttactttatattgggagctgcagaggttactttggcttgaggtgggagataggggctttggtcatgtgtgtgggtagagtgcttctcaaaacatgagtgaaacttttatacacggagacaccaagctaagctttcagagtttaatatggaatttccagtttaaattatcttctttataactctgggtatagcaatgtttttttgtgtgtatacatgtatatgtatgtccatgtgtggtgatgtacatcctggtacaggtatgtatgtgtacgcatatgtgtatgtttgcatttgtccatgtgtgtacacatattggtacatgtacacatatattcgtgcgtgggtttgtacatgcatgtatatgcatatgggtgcatgcttgcatatgtccatgtgtccacatgcataaacacgtgtgggcaactgtgtgctataactgtattgtatatatgtatatctggatatctatgtttctgcgtagttgtgtatatacatatgtctgtgtgtgtacaggcacatgtatatgtgtgtgtgtaaatgtatgtctgtgcttgcaaatgtacatgtacacatatgtttctttctgtatagtgtctgtgaatacatgtacatgcatgcccatgcacgtgcatatgtgtatgcatgtgtgcatgcatgttccactctgtgtgtatatgtgtatgtgcatatctgtcatgtatgtctgtgtgcatgtacatgtgtgtacctatatgtgcatatttctatgtatatgtgtatttgaatatctgtacatgcatgtctgtatgcatgcacatgtgtagtcctgtacacatgtatgtcagtgttttgcatgcatatgtatgtgtgcattcatgtttctctctgtgtgtatgtgtatgggaatacttgtacatgcatgtctctgtgtgtgcatttgtttgtatgtgtatgtgcatattcctttctgtgtgtatgtatgtattcatatctggacatgcatgtccatgtgtgtgcccatgtgttttgcttcttttctgagtagtcacatttcccaatttgctttttctctgttatatcatgtgatctctcattcttgctagaggctttactcatgcttctgatgatcttggactgtgctcatgtttcaaaaggaagtgtctggaatgcattgccttggagccaccctgaagagtagggctgggcctttagttagataactccaatgtctttatctttagctcatttatcttgggacaggcacatttcctataaaaaaaactttcccatcgcttgcttagagagaaagaggttctgaaagtcgtagtgcagacaagagctggtggatgtcagggtctactaggtaaaagtccctttatgtctcattttttggtgagcacccttgcctcatctatcaacattactctcacctacctgtaataacccctcagtctcatagcacttctttattcattttccaagcagtatagttatttgggggatataaagggtactttttcgaactattttctgtttctctaagattgctttacttgcgagagaattgctgtgaagctggctgggaaagaacaaaagacttttggatgctaagtcttctaaatgtagaacccactcatatcagtcagggttcaaccaatggagcatgactagtaggagataatatattgagatttattgcacagaattggttcatgcagttatggaggccaggtatgatgtctgaaatccactgggtaggccatcaggaagtgcagctggaactctcaggcatgagtggaagttgctgcccctaggtggaatttcttcttctttgggaagtcttaaaagccattctgctcataaggtcttgcaattgattgaatgagacccacacagattatctaggataatttcccttacttaaagtcaactgattgtggatgtcattcacgtttacaacatacctttacagcagtacttggatgagggcttgattgaataagtagggactatagcctgctcaatttgacacatcctcagaccattataataccctctctttattttttattgaagtgaaacgcacataaaattaaccattttaaagaatacaattcagaggcatttagtatatccacaatattttgcaacaattgtttctatctagctccaaaacattttcatcacacacacacacacacacacacacacacacacacacacaactcagtacccattaaacagtcacatctcatcttcacccctcctcttagctcctggaaaccactaagctgctttctgtctgtattgatttacctatttgagatatttcctataaatggaaccatacaatttgtcacattttgtatctcacttctttcacttagcatagttttgatatttataatattgcagcatgtaacagtactacattcctttgtatggttgaataatatgttgtatgcatatgtcagggtgttttttaaaaaatctattgtcctttgatgaacatttgaattgtttccatattttggctgttgtataaatagggctgctgtgaacatgtgtatatatgtatttatttaaatacctgtttttaattatcttgggcatatctctgggaggggatttgttgccttttgaaagccattaacacgcgagggctagcccagtggaatcaatcaaggaaattgtatattacaaactgtgcttcccacactcttaccattctccttgtcaaaacaaagagatacttaaagatgattctggttggatttattcttttaattatcctacatttgtgtatccaagatcagggatgccacactttaccctatcaattctcaaatataagttaatgaggataaggataatcatggggtaacatcccaaggttattctctaatatgtggttcaaggagattttgttaacaactagacttggggcaagtggtggaattggaggcaggagtgtctctgcactcatagagcactgtgacagtgagcagctgccttacatctcttggttgcaaatctatcctctttgaaatgtcagagactgccagatgatctttggagtttattctagttttgaacattatatgattttgtgatgcatgaaaatgttatgaactttggctttgaaaattctgatgtcaaatctgaccccaaagtcatatttcatgctactttttaaaaggggagaaaaagagaattgaaacccaatttgctgacccaaattgataaatttctgggctgcaagcaaacctacttttcagtaggtgatgaaaaagaaattgagcttgatgatatttacagttaaaacagtaacatgcatttaataatcacatgtaaacacaagtgtgaatatcttatgatattttatacttttatcctgtggaattccaaactccccctgcttacctcaccgggaggcatagttccttacctttataactgacacctgtgcatgtactgaccacatgtcctgggcttcccatggaagtgctcctttcattgactgctggctgcaaacacatacccagccactttgactgttaatgagctctcattctcatttgaaatatatcattacttctgtgtgtggtcatcctggatactcttaatctttttcctttttcttggcatagtgaaaaaaatatggaatttggagtcttatgccaccaacttccattgtagtctggactctgaagtatggttgttaagtggaccctgaaatctttttgacagaaattcctaatttatagtactgtggtgactgaagctgtgtaagctcttagttccaactttgagtcccagattccttcaacctgcccctcctaaagtgtggtctttgaaggcaggaacattttgttgtcaatattcttatcactcccactttgaaacatgggcctttgtgctttgtctatgcttctatgtgtttcataatacacttcttctgattagtaatgcatcacaggtggtagacatgttttcaattcaagggggaaatgcttgcactcctattcctgattttaggatccctactagtgtgaccagtcatgctagtctactcaagactgcgggattcccagggatgtgggattctaggcctcagttttcttatctgaaaaccaggaatcatcatagcaacctaccagagttgctctgaagattaaatagctgtgtatgtatgtattatatgcttttacacataccgcttagtgcacagtgactgctaaatatttaggtgccatatggaggcaattatagctggggaatctgaaaatgaggatgaaagaaggaactcctgtgaaattcattctagaaagaaaacttggcagaaaagaaacttcacacctcctattctctctgttttaccacattttcattcctggcatgggagaccccgtgtacagcctggtcttgcagagccaggccctgtaaagtcaggcagtggaggtggaatgggacagacaggcgagtccaagacctgaaaagccaggattgttttttgttttactttatctaaaatgcaatgagaagtcatcaatgattttttttaaagaagattggtttctttttcttttttaataattttaacttttataatattttagatacagagggtatatgtgcaggtttgtcacttgggtatattgcatgatgctcaagtttgggatatgattgacctcatcacccagtattgagtatagtattcaacagtgagtttttaaaccctttctcccttttaatagtcctcagtgtctattgttgccatctttttgtccatcctaatgtttagctcccacttattagtgagaacatgcagtgttttgttttctgttcctgtgttaattcattcaggataatgacttccagctgtatccatgttgctgcaaaggacttgatttcattctgttttatggctgcatagtattcaatagtgtatatgtaccacattttccctttccatccaccatcgatggacatgtagttcgattccatgtctttgctattgtgcatagtgctataatgaacatatgagcacatgtgtctttttggtaaaacaatttattttcttttttaatatatacctagtaatgggattgctgtgttgaatggtagttctgttttaatatccttgaggactctccaaactactttccacagtggctgaactaatttggatttctaccaacagtgaataagcttcttcttttctccaagcctcatcaatgtttgttgttttttgactttttaataatagctattctgattcatatgagatggtatctcattgtggttttgatttgcatctctctaacaattagtgatgttgagcattttttcataagtctgtcacttgtacgtcttcttttaagaaatgtctgatcatgtcctttgccctttttttttagtaaggttaactgtttttagcttgctgatttaagtttcttataaattctgaaaattagacctttgtcagatgcatagtttgcacatattttctcccattgtgtaggttgtctatttaccctgttgatttcttttgctgtgcagaagctctttagtttaattgggttacatttgtcaatttttgtttttgtcacaattgcatttgaggatgtggtcataaattatttgtcaagtctaatgtctgaaatggtgttcctagcttttcttctaggattcttatagtttgaggtctagcttttttttttttttttttttttttttttgagagaaagaatctcgctttgtcacccaggcacccaggctggagtgcagtggcaaaatctcagcttactgcaacctctgcctcccaggtttcaagtgattctgctgtttcagcctcccaagtagctgggactacaggcatgcaccatcatgcctggctaatttttgtatttgtagtagagacggggtttcaccatgttggtctccaactcctgacctcaagttatccgcccgccttggcctcccaaagtgctggaattacaggcttgagctaccacacccagccttacatttaatctttaatccaccttgagttaatttttgtatattgtgaaaggtaggggtccagtttcattattctacgtatggatagtcagctatcccagtgccatttattgaatatggagtgagataggattcttaaatatagcattttccttgtgttttcctagagagctcttttctaagctcttttctaaattttatgcttttgattttaatgtaaaatatttttgtaggcattcactcaagtgctcctttatgatatagctggtgtttattgattaaactaaaatgcaaacacacttcttgtctgttagtgctaatgccaataattgctatgataaaaatagtagcaagtgcttttgggttttattattatttcagataaggtttgtcctctggatcagtgatttttttttgtttttattaaagtatttgagtgatttaaaccaagacagtattatcgccactgttatatgtgctaggatgctgggaataaatatttcaaagacagtcacatactgtcattttttagaagaattactgagttttagtcaactggcatttatttcaccaaagctatttatccaactctattgacttatatctgtaaattctataggggtagaactttgggagtattagaaataatatacatagattttaggagaatagctctttagatttattatttttatcctgatttgagaggtgagaaaatccatgttcagtatcttgtccaagctttctctagtacatgctattggtgctctatcatagcccctgactttaccacttcaataccagctcagttacaacctccacacttgaaattttgctaaaatctttctctggtcatagaagcttgttttccctatctatatggcaatccggaagtgcccaggttttgcttcctcctgggaattatcttcagccaattataatgtgagctgatgcattaatatcttagctccctcaccatccatagagataagtctgattgtgttcttcactggctcctggagttttcctagtgagtttaagctctcgttgtccagtgctggttggttcccttaatgtttccttcccctccttatctctgccaccaccctatcagtgctttcttcacttctcaaataaactacttgcactctaatgcctgccttggtatctgcttcagagcaaatttaaactgtaacagtcaccatccattcgtcaattggttgacgtggtgtgcaaagccagatttgcttgatgccaacaatatgtttattccactatgtgatgtagccttaaataaaaggcatataaggcagaaaccccatttcgtagagcttctaattttatatagacaatacattagtgcaggaaggttgaaggagtaataaaaagagctgaatcaaagtaaaatgctagctgaaagactaattagaacagccttagtcataagctggtaagtgtatagagacatacatgggtggggagtctccttctaccgacagacatgttagatcttagaatatagtgtataaacaagtgctgtgtatttaccatgtgccaggcaatgagctaaaaagagctttaccttcattattacatttaatgttcacaaaaaaagtatgtggtagaatctattgtggtgtattaaaccacctcataatttagtagcttaaaccagtatccattttataatatctcaccattttgtgggttagaaagttaggcggatcctactagagttcttcagctacttgtgacattgactaagtctcagttgctaggtgatatatggctagtggctgggatagtctggaggatctaaatgaatttgctcacatgctgggtgccttgatggggatatctgggggctgagctcagttggcctttcttgctccatttagtctgaggacctctccacagtctctctagtaggcagaaagtaccagccctcttgaaagctagtctcagaactggcagggaataattttcaatgtgttctagtggagaaagcagtcacaaatcagctcagattcaagaggaagggaaatagaccccatcgctcagtgaagggcgtgatgacgatgatgattactgtcctttttgatctacaatatgcaggcactatattcatccccattttataaataagaaaattgagcccaaaagatatcatgtaatctgtccaaggatacaatgttaatgttgaaccctggaagtctgattccttggtgataaaaacctgttctaaaggggaaactgtgtacatatttaattgaaggcaggtgtagagaagaagaaagtttatttgttagaagagagttgaggcagggactgcctatccagcattcaatattcactatctttttcttaattaaatacagtggtgtttatggtttgttgtttttgtttttgaggaagtaatattcccaattagaaacagtacatttcctagcctccattgagttaataatggccatgtgacattgtcctggaccatgtaccaaaagcagaagtcacaagagttttccaattggcccggcttcacaattatgggcccttcaccgtccctgctttcttctccctggaacataggggtgatggctagagcttttaaagtcattaaggctatctaaggctacagtctatggagagggaagtataagtctagaaagaattctgggcctctgatgatctagaagcaagataccaaccttggactgcctaatatcagacttctcattaacctcaaatgaaataaactctgattttctttgagccactgttttcttcttgatatatgcagtcaaatgtaaatttaacttatgaggatgatttatgtttttgtactttctggaatcagatggagaaactgggaaggaaatgctacaattatagcaaaatcaacagctgtactagaagaacaatgatataaatttccaagaactgatgactctgtgagctggacaatcccttaggggttccttgccctacagaaaagtcagtggatgaatttatgtttgctcacatctgggtcactgaaaccagtttgagctccattatactggcagccacctcatcatgtagcaaagaaaaaaattcaagagacaaaacaagaaagtataacatgagttctgaagcaagagctctagataaagaattctgtaggaggcagagaagggaccgttctctttaaactgagctgggcgggaggttttctgcaggtggaggcttctggactgggccaagccctacaggtgagtgctatactgtaattgtggcatgcttgcttgaagagctaagcaggcaacctttatgcagacacaatatccaatgttttgttctcagttcgacctcaattagtatttaccgaattgaatttgtggtgtgatttgaagcgggctgcaaaacacactagttccaaaatgcctcctatacagaaatcccagaaatatgttttttctttgcatgaaggcgttgaagacttttaaaatataaatatgctgtcttgaagaagagcacagtaagcgatcatcacgcattatcaccttattaggttgccagtcagttaacaacttgtttcattaggaaggaagggtgtttgactctctgggatgggcaaagtttgctgaagaaggttaataagttcggggggaaaatgattgctaaattatgaaaaacgtgtatagaatataatttaaagattcattcactgggagcattaacaattacaaaaggaagccagtgtaccatcctacaggctgggactgggttcacagaggctgggttcaaatctcagctctgccactttctggctgctattttgggcaccttatttaatgtcttttgtttccatttctttgctttaaaatgggcagagtaacacagaagatggtccagtgtcatcaggcccttaaagcagaatttagtgcacattagagatcgatttgtgagaaatattatgcaaacagtcttcattttactcagtacagcaggatggtaaaactgaccacacaagctgaaactgggtaaagcgatcttaataagaactatggtagttccatgacctttaaaatttgtcatcaaagcagtgtgttgtctttccatgtcttaatgctactgtatgccatttctctgcatgatggtgtacttaacctggtggaagctccataattagtgtctcctagtattattatggagcaataactacaaagggcatcctgagtggaatgtaatattgccttgtagtatgagataacctgctacaggttagaatcagaatgcaggagacttggcactaaaaaacacagaaaggcaagtagcactggatactgtatataatggtcacctgtgggaccattctttttttaggctggactccagtcccagagaatagttccacttttccaaattgataacagccaaatttaggtcattcaacttaggctctctggatctttatagaggccagtatacgactcatcagaaataactgacttttaaattgtaaaaagtgtatttcataaaaatgtatatgataaaattacatatatatattagacatcagaatatgtatagcagttagatataactcatcaaaaatgaccacattttaaacacatacatcatatgtgttttattacatatgtgttaaaaaatctcacttggctttcaaagatgggcttacatgtgtgtaactgactgttggttgcctacccagcatccattttgactccctttcctttaccaagagtgctgttacttgttttagaaagacttttaacaaataaaatttgcaatatgcttacatctgtaataaaaagtagataatattaagtcactgaagatgcccagtatggcttttacatttttttggtgttcttaacttcacaacttataattcttcattggagtaggatatatttctatgattaattttaagctttgctaaaaaacctctcttggaatatgcagtacccttgtcttgctcatttcctttaataaagtaaacaacatagctgtaaaccagtacacatgagtcatttattctgactccacatcaagtaaataatgaacaacctaggaggaattatttttgtttctttcagtcccaaagaaatgagattttatatcaacgtgcaaatcctgctgttttttattttcttttttctttttcttttttttttttaagacaaaatcttgctctgtcaccgaggtgggaatgcaatggcctgacgatggctcactgcagcctcgacctccaagtttcaagtgatcctcccgcctcagccaactgagtagctgggactacagaaacacaccaccacacctgcctaattttaaaattctttatagagacgagtcttgacattttgccagggctggttttgaactcctgggatcaagcaatcctcctgccttggcttcccaaagtactgggattataagagtgagccacagcacctagccttcaagtcccagtcttaatgccaacaaagtgatttttatataaaaataagcagaattggcattaggagtataatacctaggagttttaaatttggttatgtagctaaggttttactgattcagcactcactgtcttacatccatccaggggcctttacataatgcatgttatcaagaaacccaattaaaaagtgaaaaattaatttagccaggtagttagtgttcagttgaaataatgaattctcaaatggtagaaggtttgtttactgaattgacttggttatattttttttacttcttgtatcattaatatctacctatcatctatctatttcttcatccttttatctgtcagtatgtgtgcatttttatataagaagactcatggaagacctgtgaagtgccagaccttatgcaatgtcgacccatttgatcattcaaaaacatttatttcccaacttctgtgtccaaggtactttgctaagaagtaacaccaggtatggtggctcacatctgtaatcccagcactttagaattctaaggtgggaggattgcttgagcccaggcttttgagaccaacttggcaacatagtgagaccctttctccacaacaaattttaaaaagtaaccaggtgtggtggcatgtgcctgtagtccctgacactgggttggctgaggtggaagcattcttgaacctgggaggatgaggctgcagtgaaccatgatcttaccatttcacttcagcctgggtgacagagcaagaccctgtctcaaaaaaatagagaaataggtggttagttacaagcaaaacaggaaccctttcttcaagaaactgatgatctagagtggtacataaaggaagacttgataaccacacacatggacacacatgcaattatgaagttagtggaagaatcagaagggaaatcaactgtttttagtgatagagaataagacagtgggaggagggaggggtgctccttaggaaggtgcccaaggaagtcctctgtgaggaaaggactttcagtctggcacctgaaaaaaaggagcctgtcatacaatgcttgggggaaggccaatgggcactgtgaagagtcggtgcatgggccatgccttgtaaggcttgtggagtcactgtaaacagaacagacatcgtgatgtgtggcaaccgggcttgcattgccattccggttccatatcaacagttcatttagttttaggtatcaaaatgctgagaataatgaagaggaatattccctgtgcactcctggcaaagttgtaagaaatattaatgaagttctaatcagaacttggtttgcttcatcaaagagagcgttctggataacatgttgtggatgtaaatgtaaaagtaaagaaaatatgtttatcaaggtcaagaatgaagaagtttgaaatgcatgcacacacacacacacatacatgaatgtcactgattagatgccattattgttgatattaagagatatttattttttcattcactaatttattttactaatattggcttgacacttactctgtattggacactgtgttctggttgatgtgaatgaagtcttgaaaaggacagcctttcttaaagcaagaaggggaggacagacaaaatggcaaagcaaaggcagcctaatagaattaagcaaaatgccttaggaatatggaagttcttttttttttggtttcttttgagacaattttgctcttgtcacccaggctggagtgcagtggcccaatctcagctcactgaaacctctgcctcctaggttccagtgattctcctccctcagcctcccaagtagctgagattacaggtgtgcaccaccatgtcccgctaatttctgtatttttagtagagacggggtttcaccgtgttggccaggctggtctcgaactcatgacttcaggtgatccacacgcttcggcctcccaaaattctgggattacaggcataagccaccgcacctggctaagaatatggaagttcttaacttgctttaactcctacctatctcttcagtgtcatcttttgccttatttcagacagagttaacttcatttttcagtgtcttaaacgtgacgcactacttctctctttactttgtaaaggttttgttttgtgcctgaaacatgtaaccatcttctattcatcatttaagcctttatttgaatatatttattccaagcaatcttttttaaatcagtgtttctcaaaatgtgttccacgaaccatctatatcataattacctgaaaatgtgttctttaaattgcaggtttttgcacacatccccaaccacaccctctgaatgagtagggaaccataaatatacatgttagtacattttcctgaaagttcttttgcattctcagtttgatcactgttaccctagatttgtcaggggtctcttttatgtttccatggacataatgatctccctctactataagatttattgcctgaaatctttgctggtctgctaaattaatccaccaatatgattgaaagctcacagagataggaggaatgtgtttgctagtcattgtaagtccactatcaaacatggagctgtgtctaggtggccaataattagatgtatgttttgcagagcaggtacagaagttatccaggtcataaagggacagaacagtcttccaggcagagagaatcatgtctgagcaagttagctcagatcatacacagcagacaggttggatgtgtagctgggagactgggtgttagtgagtgaatggctgttaagtcaggctagagaaataaaattgtgtttagcttatgaacaatccatacctacagaaaagtgtcacgcatagcataatagaaaaaaaagggtggagggggcctatggccatgaaacctaggtttcaggcctgaattggccttggactgattaatttactttaaacaattacttgaccttatgtgttttgtctttccaaactggaagttgtgtataattgtctcactttctcactttataaggaaaaatatttacataggacatacaaatgagcatactaagataaacataaaagcagtaagcaaatgccaagtgtgtgtgtgtgtgtgtgtgtgtgtgtgtgtgtgtgtgtgtatgtgtgtgtaactaaatttgacaatcctctttcaggattgaaagatttatttatttcttggattttgggtcctccttgtagttaagttttcaaactgtttgtcccttacctgaaagccacaatgaactccagagggaaaaatttttacttgtatatacttctcataccttccattaacattgattctgcttaactatattttaccttgatacaacattttactcttataagcccctgttgtatgggtctgtatggttttgtgttgttacacttcagaattcaagtgtcataagtaacttttcacacatagaaaatgtcatgttacaatccagagcaatgtctgtttttagcgaatttctgatcttttcgtgtttctttcatataaaaaaacacacatacacacacaaacctgcctgcacaaaattatcctggattcattctatcactctcttcctgtaaaacaattgcgaatgtgtaaagtgttgtgcattctgaggctacacttgactctttgctactttctctggcatcacagatctactagatttaatagaggagcatagctttacttacaagaaataaaggtgtttgcaaaataatgtagaaagtcaaattttaaatgcccaaaaacgttagtttaaaataagttaactaagtcattcaaaatttgagtgctacatttgttcaattgtgaatcagtagtaaatggaaatgtagtagagttccacagcaagcatattagtatctacaccatagttctaaatgcaacagtacttgggcatgttgaggggcactgaagccaggcaacagagcttggaactgatgaatagtaggaggagtaaaagattttactattactgctaactaccactccccccggcctcctcctcctaacagtatgctttcattatggcgatatgttagtcaaaggatgaacatttagttagactggagaataagttctggagaaaaaattcaagggacctattgtgcatcatggtgactgcagttaatatattatatatttgaaaattgctgacagtagattttaagttttttcacaccacacacaaatggtatataaggtgatccgccatgtcacgttaaacatcttgacttagccattctacaatgtatgcatatatcaaaacatcatgttgtgcaatataaatatatacaaaaaccaaacaaatacataaaacaccaaagctgcattaatggttattgagctataaatttgatttatattattgtatttatttctgacataattcatgtggtaggtactattatccctattttataggggataacattgaagaaacatggaaacagatatcatatgggcaagttcatgattcatcaacttaggtagacctaatttccaacctgtacctatcagcagctcgtgctgtttttacatcacccttggaggacatggggctaaaatcaaaagagaatcaagaaccttattttgatgatatttaaaatgtattgagtgacagaaactaagtcaatttcaaataagacatttggatatgctgttgttttttctttccaagatgcctttggtttcttaaggcagtgacaagacttttgaacattgtaattctttttttggataagatttttatgttagtagaaaatcttgggaaaaatgaaacagggaacactggtatttttcagtggtgtcgcctttgcttgcattcccattttgtcagcttttgaggagccatattcactattaagtttgtcttcaacatccattctctaacacagcacatgaaacagtccccttatctaactccacatgaatctaatgtaattttaacctaaaaacagaaaaatgaattaggaaatacatttgtctttaatgtaatacagagttcagtgaattctgtgaggcacttaaccaaaataacttgtgctttccttagtttttgcaacccattttttagataatttatgtaaaattattttactctatacaggagatattttggagggttttttttttggaggctgcattgcttaaatacagtttggcatttaaaatcataaagacttgggtttaaatctcaaccctgctacgtgatcttcagtacatctttgaacttcttcgagtcctagttacttcatttgtaaattttgaaggttgagaacacatatccggaagaacttttgaggggaatagaaataattcttcgacaacaattattgcagttgtatgtagctactcagtgagtggtgaatgttgagtattttgcagctttaaaagtattgtttttatcaaattattatagcatactacatatcagttaatgctattataagaaactaaaatcatttagaacctttctaacttttgtcttatttttgttttttttcctctccatctatgtaagaatctgagaaatcatgatctcgagcatcatgcagagcatattttctcctatcagggattcttgttctttgcatttcttttcagaaacacctcaaggtttctgtccttatagtacatctggaagaagcacacttccctagagatagggctttatttaaaacatctcttcattcaaggtgagaatgtcatttgctggcatttcccccgacttatcaatgtgcctattcttacatctggagtatgtcatgacagtcactatagtgatgtcctccaaggacctggacactatgtaggcttctttcccactgagtcctgggaatgagagctggcaatgttgacttagatccttcaggcagaactacaatgacttgccattttccatgttctgaaatcctacaatgcaaaaacctcatgatagtttatgctcctcttcccttgtcttctgcctcttcctctaaatatttctgatctttaactctaccaccaatctgtagctaatgcatattctgaattgtatctgggtacagtgagttctggtgccaccagcaaaaaacatctagtccattaaagttttttgtgagatgctttatgtgggacacagtcttttaatgctcatcataccaaacaaacatatgtgatcctttcatgaataagtagcaaatatataccaatgctgtaggagatttatttgaatatttggaagatagaagttttctcatacatctcagagtccttttatatttgaagaagtgacacttcacattattattggattttcattatcatttttgggaaagttctcacaaaatctcagacctgaagttgtagacagaattatagagcacaaagatgtctgtgtcctaatcctcagaacccaagaatacattaggccatgtgtcaaagaggaagtaaagttgcaaaagtaattaatgttgctcatcagctgtatttgaaacaggaagataatcctgtattatcaggatgaattcagtgtaatcaaaaaggtcctcaaaagtgaaagaaggagatagaagagaattataggttgaagtaagtatgaaagaaaggcacagagaaatgtaacattgcttgccttgaaatagagaaggagtctacagaagccatgggatgtgggtggcttctagaagctagaaaaggcaaggaaatataatattccccaagagtgtcaagaattaatgcagccttgctgatacttgatttttagcccaatgagatcgatggcagacttcaaacacacagaactgcaagatagcacacttgtgttttaagctctttaaagtcatttaagtttgtggcaatttgtcacaccagccacataacaatacacgatttgatttttttatgtgaaaagacagagatgataagttggctcagtttacatgggtgttgatggaggagagtaaaattagagcaaaacttagaaaaggcattattaaaggaggttaatttctcattttcctccatatccttatcatacctcttaatgttgccaacataatgcatgcttatagatcagtggaggctctttgaccatttatgaatcaaaataaaattataatctatgccagtagatgagagagtccctactgcctttcagaaaacaaacacattatcttaataaataaccatctcggtacgtgaagactattacaccttaggaaaaaagatggctcattatgcattgcagttttatataattgcatcatagcagtttgttcaattgactcttttaagaaaaagaaatggaatactgagtaatcttaccaccaatcttgaagaaaacaagacatttgatcttgctatgaatcccaaattattgcatgtccatcttttataaagtctcaaagatactttaggaagttgaatgctgtctgctgtcataaaaaacccatgcacaccaatcagttccatggacagaaccaagcaggtggaaatcttgaatagaaggtcagtctacacaggtggcttaaaataatttacacaataaatctttggaaggacaacattgacttctaatccctctacctctttattttttttctcttgctacatttttgagtgaagtgttgtaatgaacatcatagggtgcttgcactaatcaccagtatccaaagataaatgatgatgcagataatgatacaaattttataaagcacctaaaatacagaacagatttattgtctttgttacagttcataaaatacatgaatgaaaatttagaagttggggaaaatttttatctcaaagcagaaatggccctgacaattttctatgaaatgtagttgatatattgatgcttgcattgggagtggaggtggggaaaggagataaagagagatagataggggagggttttctttactcaaacaataacaaggtaatttctgtaattttagatactactcaaagaggacccagcatataatttggaaaaaacaaaaaaagtaaaggacttctgattatcttttacattgcagagaatcttggtttggattctgaagttgctaaagcaaatgccatgggttttgctggatgcatgtcttccgtccagtacaaccacatagcaccactgaaggctgccctgcgccatgccactgtcgcgcctgtgactgtccatgggaccttgacggaatccagctgtggcttcatggtggactcagatgtgaatgcagtgaccacggtgcattcttcatcaggtacactcaagagcatgcacaagggagcttctgtcactagcactactttttgtgtcttcaagaagcttccagattaaagagttggctaatgtgactcagtttttactttgtataataacaggtggctaaaaattatgactgatatttcatgggtgattttatacatatttgatgtagttttatttttaatatgatgagtaattaaaactaaatgcatagttgtgtactttgcttattatgcacgtatataatgcattgtgtatgtgtgtgtgtgtgtttgtatacatagtcactactgttgaagtggatactgctccgagaattgaggtatttagagaacagggaggcagcaagctggtacctgaactaacatgataattcatgtgattaaaataaaccttttttagctttattaagaaataattgacaaataaaaattatatattttcaaagtgtaaattgtaataatctgataaacatgcgcattgtgtaattactatcacaattaaattaatcaacacatcactgcacagttaccctttgtgagtgtgtgtatgtgcatgcacatctgatgaggacacttaagattaactattttagcaaatgtcaagtaaacaatacagtatgaataactgtaatcatcatgctgtacattagttcaccaaaatttgggccaggtgtggtggcttatgcctgaaattgccgcactttgggaggcaaacgcaggaggatcacctgaggtcaggagttcgagaccagtctggccaacatggcgaaaccccatttctactaaaaatacaaaaattagctggccgtggtggtgggcacctgtaattccagctacttgggaggctgaggaatgagaatcgcttgaacctggaaggcagaggttgcagtgagccaagatcatgcaactgcactccagcctggggtatagagtgagactctgtttcaaaaaaaaaaacaaaaaaaaaaaaaccaaaatgtatcatcttctgactgaaagcttgtactctttaaccaacaactctccatttcctgcacacaccagctcctgacaaccgccgttctctctgtttctatgagtttgacttttttagattccacatataagttatatcatatagtatttgtctttctgtgtcttgtttatttcaaattggcataatgtcctctaggttattccatagtgtcacaaatggcacaatcttttttaatgctgaaaatttccaattgtttgtgtatatgccacaatatctttaatcatttaagcattaacagagagtttgtttccatatcttggcgattgtgaataatactgcagtaaacacaagtgcagaaagctgcaggcatctcactccctgatttcaaactatattgcaaagctgtagtaataaaaaaaaaagcataatactggcataaaacagacacatagactaatagaatggaatagagaagccagaaataaacccaggcttatttaatcaactaatctttggcaaaatttccaaaaatgcataatgaagaaaatgttgcttattcaataaattgtgatggggaaattgaatatccacatgcaaaagaatagaattggacctttatcttataccatataaaaattaacttgaaatggattaaaaccttaaatataagacctgagactgtaaactccaggaagggaacataaggacagatctccttaatattggtcttgaaaatatatatatatgtttacatgacaccaaaagtatgatcaacaagagcgaaaatttaaaaaatgggactgcatgaaactaaaaaaccctctgtacagcaaaggacacaatccacaaaaggaaaaggcaatctacagaattggaaaaagaaatgtttttaaaccatatgactgatgaagggttagtatccaaagcataaaaagaattaatataactcaatagcaaaaaaaaaaaaaaaaagaaagaaagaaaagaaaaacacttcaaaaaataggcaaaggatgtgaatagtttttttttgtttttttttgtttttttttttttccacaaaaggcatacaaacatccaacaggtacatgaaaaggtgcttaacatcactgatcgtcagggaaatgcaaaccaaaaccacaatgagatgtcacctcacagctgataatatgatggttagtatcaaaaagacaagaacaacaaatgttggagaggaagtacagaaaatggaacccttttacactcctggtgggaatgcaaattggtacagccattatggaaaagagtagagaggtttgtcaaaatattaaaactcgaatcctatttctgaatatgtaacgaaaataaattaaatcagcctttcttaaaagtagaaaaaacccacagcaccatcatccatacattctctgcttcactaccctctaagtgccttttctatcttttcttagtcactgtcattttgggtgtctgaaaatgtatctgggattttgtcttaatcaggtatgataaggtgacaggcatgagatgattgcctttgaaagaaaagtttatttcttacagttctcaagaaaaagagatacattctaccactcagagccacatggagaagtgctagggttggtcaggagggagaaagagaaaggggaaagtgtggtggggtggctgtgttgcagcttccatgggaaggaatggggtgaaccaggtaggcaagcttgagccagttagaattggatagtttgaataatgtgggcaggatctgcgctacaggggtggtctctagttatctaatacctaatacttggccttgagtgatttaaggcaagagaaatactgggttgtgaatgtgagttagataaatggattagtgtgggagatgggctctggattgattggtttgtgtataaaatgcatgcttgcaggcctattgtttgctatctctaggaatcagctagccctgagaggggcagtgtctccctggccagcaagatcctcaagatgtcaaagcatcataaatactgattaaaaaatgactaatacactgagataaaaccaagacatcaacatgtatcaacaagtcaatataatatagatagaaacagtgatagtgtcttcattctgattatgctttaaagtggtttgtatatgggtgagggagtattatcagatttttctaggatgctttttctaaatccatgggatatatattttgttcagattttgctgctaatattggtatgaaatatgggttttgcaagtagtggtgatgaagaggctaggtctgagatgtttgataaagctcccattttactatggtattgttttaccctccccttgcttcccagcacacactaagaacaatagtggtaggtgttgaagggttctggaccacagtaattttctattacaggcacaattcccccagcagtggtctacgataggtcatgatgtgttagtaggaagataaaaggtgggacatcttattgcattaaacaagtctaggagattttaatatcttgggaaatatattgagaaacacgcactctcttttatatggcaggactcttagccaagacttttagcctgagatctgtagtgcccagtccaatattttgtaaaaattgagaaataaattttttaacaaatttggtaacctgagtaggatatttaaatatttctatctatctactcttccagcaatgtattgcccactcctttactgttttatgtttcaccattttattcttcaaatatgattttgagttctttcaggtaattcttgtgattctcctgttaccttattcatcacacatcttttaagcagctacttagtgttaacttccatagttagtggagataacaaaaaataagaaacatttaaagtccctaattttagaaatctgtaaagatgatggaaggcaatggttcagggaattagggtgtgtcattggatgcccggcactatatcataatacagtgtgagcaatgctaaaggaaaaatatgaacagagttttgggttgtatggaaccaagaaaaggcagtaaatacattttagatgaactaatgatagatttataaataatctggtcatggcaatgcttagggagaagggtttgcaatgttcagaagacagaagcccattacaaaaggaaatatgtaagttaaaattcaaatttctggtacagtgtagcatatttagtaatcagtgaaaacccctcacaggtaaatcattaggtgcaagtgtagaagtccaacatatttcagtaatgaggagttcttatggaatgttagctctctctctatctctatatatacatagatatttcatagagatagatacagatagttgctcaatgtctatctatattattatagtatacaataaattctattctataagaatagatatatagatatagatatgtatgtataatatatacataatatatagatatagaatatataaaatatatagatcttgatctatatctataattatatctatatctatatttatagatcaagatctatatatatgatataaatagatagatacatttaagctgagtcattctttttttgagagggggattaaaactaaaagatagctctaaaattgttaaagacaatttagacacactgtgaagagagaagtactattgaaataaatgaataactaccccaagggttactttgccgaaggtgtccattaagcatggatataggcatggtatttttaacttttgtagtcatgttactgaagctgtcatcatactagatctgaagtattttatttgtagctttaataaatattagttagaattaacaagctgggttaatatatattaatgtatcattagcaaaatttgctagaaatggggaaatctgttgtgaaatcaatgttaagtaataaccaaggttattattttggttaataatgttaaaagtagtacatagactcaataagggagaaaccattgtaagtcggagtaagaaaaaaaagccatgaggctggatgcagtggctcacacctgtaatcccagcactttgggaggccaaggagggcagatcacaaggtgaggagtttgagaccagcctgaccaacatggtgaaaccccatatctactaaaaatacaaaaattagctgggcatggtggtgcacacctgtaatcccagctactcaggaagctgaggcaggagagtagcttgaacctgggaggcagaggttgcagtgagctgagatcacaccactgcactccaacctaaatgacagagtgagactcagtctcaataaaaagaaaagaaaagaaaaaaacaaaacaaaacaaaaaaacagaaaaaggtcatgatctaataaaccataatggatgattcagatttgaatacagtcatgtaccatgtaaagataatggtctgcatagacagtggtcctataagactataacggagctgaataatttctatgacctaatgaagttgtagcaatcataaggtcctagtacaacgccttatccacatgtttgtggtgactctggtatgaacttactcctcaataaaagcctcaggcattttcttcaggaaataactcagaagaaggcattgttatggtagcatgtggtacctcttgcatattgttggccttgaagacctttcagtgggacaacatgaggaggtggaagacaatgatattaacatcatgaatccacataagcctgatctactgtgtatgtttgtgtcttagttttcaggaaaaaagtttaaaaagtaaaaaataacagtaaataaatttaaaaatagaaaaaatcttctagcaaaaggatataaagaaagaaaatatttttgtatagttgtatgatatttgtgttttaagtgttatgacaaagaagtaaaaaagttaaaaaaataaaaagttcacaaagtaaaatagttatagtaagctaaggataatttattattaaagaaagaaaaaaagtcaataaatgtagtgtagcctaagagtaaagtgtttataaagcccgtagcagtgtagagtaatgtcctggaccttcaccacttactcactgacttgcccagagcaacttccagtcctgcaggctccattcatgataagtgccctgtgcaggtgtagcatttatttaaatctcatatttttactctgctctttctatgtttagatatgcttaggtacacatatactcacaaatgtgttatagttgcttatagtattcactacagcaacatgctatacaggcgtgtagcctgggggcaatagtctatactacatgtacagcctaggtgtgtcataggctgtaccacctaggattgtgtgagcacactctatgatttccacacaacgacaaaattgcctaatgacacatttctcagaatatattctcaccattaagctacacatgactgtatttataaagaagcaggaggcattttaagtaggtggagtagcacagggataaacaagaataacaagcacagtggacagtgtgatacaggagatctaataactaaatattttgaatttcctctcttcctgtctccctccctccctttctttcttctttctttcctccttgtcttctacccatcttttaccatacctcatcccctctctccctcccccttttattgactcctctgatttctcattttccttctctttatctgcccgctctctctctgtctctaacacccactatcatcattatcaccccatcgttatcaattggtgacatatatatatatatatatatatatatatatatgttcttctccatgtatgtatgcatgtatgtaggtcatccaggtgtacagagatgattaataatatcaatttccaactccaagttttttccaccagacccaccttatcaatgtcaccagttctgaatacctgctccatggccagcaccttctttaattacaatacccttcccatttgaccccatcagcctctctctcatgttgatttgtttctgctccgatttcaagagtcctaggaaaaggccacccctggacaccacaaatggcataaactaccacactcccttcacttgaagacacaataaatacttaccaaacatctttcacgtgtgtctccacatggctgtgtggcaagtgctgtggtatgaagaattgcgtgtcttggttttttcattagcaagcttgaggtcccactcgtgagactaggatgtgcatgtttatacacataaatgtgtatgtaattaatagtaagcaaaattataagaagaaacaagatttagtgagcacttacgttgtatcagccactgttgtaaaaacaagtatattaacttgtataattcttacaaaaccttttaaggcaaagactatcatttttaccatttgacagagaagaaagtttaaatgacacctgacaggactaatgatgtcatatgggggcttgagttctgttgctgcctgcacatcaccaatcttgatatttttcaagcagcagagaggagtaatagaaagactctgagtgcagtagttggatagctttggtgtgaattttgcctctttcatgaatgatctgtaggacttggacatgttatttgattgtttcaatctagtttccttatttgccaaaggggaacaacaatactcatgttgtagtcattttccaatgatcaaatgatacaacaataataatcatagtggctacttataagtgtatagtagccacaaggtcctgaaaatttagcatgcattatatacacacatataggtattactactctcctttaatacatgtgcaaatttatatttaaaaagaggtcttcctcaatgtcaccagaccaacaaacaacagagcaaagactcagattaaggcctgcgtacccttaaacttgatgctttttcttatatcatatatggtactgtacacacagtacaatttctctctcatcagtgaggcctgctcctgaaggtgttaattctccagcacttttgttctttactgtcaataaactcaggatccttttgcatctgaagaaaactctcaagcagagcagggcatcatgcataggaataggaactgtccagctaggcaacaggggacattaggagcagggtgagggcatgtggacaggataccaccatcctctgttttaaccccttatcttacaatttgcacataaacaaacagggccattgaactatggggtgtgagcagtgcacttcaaatgctttctgcttgtgcatgttttttgagttccttgcaacatatcaactcacaactatttgagggcacctggtgtaatgcacaggtgtgtcattccaggtgggccacactgtaggcttcttgccagtgctttgagtgagaagtaaagtcccatgtcttttactcctttcagatccttttgggaagacagatgagcgggaaccactcacaaatgctgttcgaagtgattcggcagtcatcggaggtaaacaattcattgttgttgaatgcaaaaagacataaacgatcctgtattctggagaaagttatctgaagctttccttaattatggccatccagcactcagagccccctacattacctgcaagactgtgggcttttcatgagtagtcctgtgtgctgaatgatcaaaagcaccctctgccgacaccagcagctctgcggattcatcttgcctctgattcatgaggcagctgagcactgagtcaacagctggagcatttacttacagacagcagctcacattctgctcatttcatacagttttcactgtttctaaaatgcaaacaaagcaaaccaataaaactaaattcggggaagaagccatgttggggcagacaatgggtgaagccgcagtcctgtggagtattccccaccaagtgatttgggttaggtctaatgagcagggtgaagcccacagaactgtagttgcaaatctcactgcacatatggttacagatgcagaccttgtctgctctgctgtgagctcagctctcctgcttttccattttctcattgcctgttggcctccccacttttttattctgcttcagcttggcttcctcctgctgtggcttgatttttccatctgggtctaccaacacagaatgattcccaagctttgcttcatgtaagatgcctgtgaaagaccaaactcatttctatctgagaaacataaccttagcaggtgccgccatccctgccttctggaagcctagatgaactgatccttggcagatggcgttttccttttaaaaacctgcagtacctctccatttagcttatatttaatgagccttgctatgggtcaggctctgtgctaagtagaggaatatggggatgaatgagccagcgaggagatgggtaaacagacaacaagacaaccagtgaagtctgttctgagggaggaggtacaaatggctatgggagcacagaggtgcactcctgagaacatgaagaaaggaaaaccacgcctttccttaaggaagttcctaaaacttctgacctgaatttttgctccagagaagctggaccaccttaatttttgtttggcatagagaaatgtgggaaagaattttgtgcctatttctctttcaataatttcccatttgacaagtggaaaaagaaagacttttgtgactgctgactcctctccagctatttacgtgctctatgagtctctttaaggacagggaagtcatctgaccccctaggaaaattcctggaggcttgcacagctgctgactctgactatcccatgcattgaaggagtaggaaccagtttcctatttcatctcttaatgcagcatcccactcatgggaatcactcactaccacccagtttattcatagacttgctaacttagatgattttactcttacttgttctaacatagttgtagaaaatgccacaaaatgatttaggaacatatatttataaaaataaatcttaatcatggcctcagttctaaaaaaaattggtggaagacatgcaatccatttatgaaacttacaaatgtccatgcttctgtaaatcataattcattatgcccaaaaatagctttctgaaatagacacttttcctcaatatctcctctccttagaaaaatgaaacagcaaaatatagaacttattacaagtaaattctttgcttatcatacatatttttaaatattttcatgctgaaatactacattcatgcagagacacatctgccgcttccatgttttcactattcctttattgatattgcctttcatgttccaagagccttcctggcaaaggtaggggtgagaccctagggtaagcaagaatagcttgcaacataatccagttaaatcacacacagtcagaataaaggggaatctgatgggtctggacagaggtttgccatctcagttgactttgagtttctcaagaacagaggcatcttgtcactgaatgagccttagtttaacagagttcagagcagtgtaaaaatgttctaaatttatagcgatcatttcattattaatgaaaatgttttagcaaaacaaacgtaacataaaacaaatttacatcaggagagcatgtgttaagatgtgagatatttaagtaccattttctaagatgctaaagtaactctgaaatacttagttgtgaggtgacaaaaaaatgggctaattacaaatgattctgacacattatttatagcagacttgaaaaatttacaaagaaaccccttgctagtccaattccatatgtataagatggtattctcagttctttaaacaaaaccttctatggttgaaagtgtctctcgcccccagttagtctgaaagaaggaggttttatagtaattgaagacagggcctttcagcaggtctttatttctgggcaggtggcagagttgcgtttgtgtgatttgttttgttttgctttctctcctacgcattcccctcatctggagggaatccactctcctgagcagatgactcatgacgatttccttctctctttccttcccctttctctccaggggtgatagcagtggtgatattcatcatcttctgtatcatcggcatcatgacccggttcctctaccagcacaagcagtcacatcgtacgagccagatgaaggagaaggaatatccagaaaatttggacagttccttcagaaatgaaattgacttgcaaaacacagtgagcgagtgtaaacgggaatatttcatctgagaaactgcagggttcctactactcttttttcttgttgttcaattatctcctccccctcttctctcctgtcttttgatttggtcattctctttattttctgcttgccatgtcttttctggaacatacttgcatccaccacagcatcaattcccttgatccagcccaagagaccaggcagccatggccactgccttcctctctgatgaacctatcgggtgaaaacgaccactcaagagactgacttcgccattcaagacaaggaagagacacatgtgtgcactcctgcatgttcagttctgtacttccagtttctaaaatgcactgttcagttttccaaccacttggtggttcaggcttgctttgaacctgagctcttaggcacatgacggtcattcctgacatcctccccagctcaagtctattcttaccatagaacccagggcagggagagaagaacctagaggcctggtttgctttggtggcattgtaaaaagagtaagagaggtttggtttgtggtggtttgctttctttaccataagcaatcccttgccttaactcatcaccctttttcactatgacccttagaccctgagtattttcaaatatatgattgctgatagtagtgaccaaaactactttgttcctttcttaccactctctcctggggccgacacgttgggacagcacaccatagcataaagctaggggatgcatggaaatagcagcttgaaactaggaggtaacaagaaagcttctaggaagtagatgttccatatcttcaaaatgcctcctccaattttgtaagaatgctagctaggtattcctgggattattatactgagatatatatatatacacacacacacacatatgtgtatatatgtatatatatatgtgagtatatatacacacacacacacacacacacatatatatatatacacacacgcacacatatatgttgctgcagcataaagaaattgaaataaaagtttaa

SEQ ID NO: 86 - DNA, 896661 bp, Homo sapiens
gtgcaaatgtgatataacttttattcagaaaggaaacaaaaagattttttaaagtctgaaagacaaggacattttacataattttcatttaagataaaataaaacaaattgcacaaattaaccaaataacactgatcatacaatactctttaaagaaacaattatgtgctaaagtagccatatagatcctaaaaatatttctattgggcctagtttacaagctcctgtacataagtaattataaatagttcacatctagaaaaaatacacataacctttaaaatagaatttatccttacatataaacagtctttgtagaaaaaaaaggatattaaaaagaattcttcgtagcaccattaattttatttttaaaagtgaacattgcaaatagaaatttgttttcatttttagagtgcccagattttaataaaaagagcaagaagataaaaatcaaataatattcaggatcatagagaagcactaagtaaaagacaatctaaagaaatgtctggaaggaaaaactggtattgggaatagaattcggtcatttctgatacaatgtcacactcccaatcagtgtccacacttcaggacccttttcatttttcagcagaagcagaatgacacttattactatcacctgaatctctggcaacgaatctgaaattacactaaaatgaacatttccatcaaattgagatttgtgagatggagatgaggaggaaccctccgattttttggcaggccctgttgtaggtttacagagtgtacccacaaacaatttgaggaccaggacaacgaacttcacaaaaacttcagttgggattttaaaaaatatatattatcatcaacttctaagacttagtacattatttcaagagcatggcactgattccatttattgctgtctttttttgctacaaatataatttctcttccaaaaaatttacaacttctgtacaaatattcaaaaaaagtgcaaaattaaggattctgtatcatagatgtgtttacgcttaatcctcttgaaacacaataaatggagtctatctttattgccctgtcagagaaataagctctggtgggttgcctgctgtgaatttgacaaggaaggctctggtactgcaatagtttattgttatctctatcaagcggtgcaccccccaccccccacccatcatttcttaagcgctccagtcccagctcactaagggaagagatgtcctttatacatcatttgaaccttgactggcacaggaagagaagctatcatataaagaatcactcaaagattccaagttgtctaccccaggcctatctgaactactcaaagatgtctcttcatttttttctttttcttccttctgtccttcaaccttgttcagagagttcttctctttttctaataaaatcacagtattgctgttaaatttattgaatgactctagggaaattttcgataatctattctcgggatcgtcttttgtttcttcaagttgtctcaatttctgcaataaaaagaagaaaatattagaaacatatttctttggaaaatcaagttatcctatctaatattcaattattgtctgtataaagtacagtttaaagggacagagaaaacctacaagtctttaataatcttctagtataattagatgtaataataaagccaattttagggataaatcaggactttaatcattttactgagataaataggtcccaatttgcaaattaagtgccacttaatttcattttaaatggatccatttgaaatttgttcaggtaaagtgccttatttttcttcatcaaagtttcaaactcctctctttccttgctaagtattagctgtactttttctaaatatgagtaggtattgaatttcagccagaagttatggtaatatgtttttttctaataaaaaaaagacataaaaatcccctaacttgccatttttgaatacatgttaagcttgttagaagcattgccattttagtattttgtccctttataggacttaagatatttgaaagagatctccaggtttttgggtgtagatcccagaaggcccaagggcttaaaaattaaagcggcaggtgaacagctgagtaacccctctgctccagaaggtctagtaataccagtttatactgggatattactgttattaataccctgtatgatgtataaagcactgcaccaaattcaataattatcataggtaaaccctgtaaacatgaatatattcggttgctcagttggctcctaagggctaaggtgaggacagagggaggcacacttgcgaaaaacaatgagaaaaacagacatgtaaaagtgtctacaatatttctcatcttcttttcctctttccagcagaaattccatccaaacacaggaaagaagcaggcccgggggcttggagatgatagtaagtgttaccatttattaagcatccactaggtaaaagacacttaacagattctatcagctttttcacaaacctacaaggtaaacgaccccattttaaagagaaggtatgcaaggctcagagtgacagagatatttgcccaaggttgcccagcaagtggcagagaacaggatttgaatttctgtctggctgccttccatgctcttgttctttccattaaaccatgttcttaggtaataaaggacacaatgtcctgttttccattttgttacccaaaaattccacttaaataacttgccaaaccgtctctaacatgtgcagttctgctgtgcaccatgctccccacccccaacattgttatgctggactcaacaaggttgcaatgaggaaactgtcttttgattgggaaaatagatatagccaaagcttatggattctcacatgctaatgtgaagaatggaaagagaagagagagatggaagtggatggcttctgtgttccaagagcagacacgggcagaatttctctgctataggaaatggtataattctatgggaatatttgaaaatcatcctagatctagtgcttatttcattatactactaacgtgcagaaacattactcacagagctaattttcaatcacacacagctaccctgaaaccagaggcgggctaaggaacagactcctagctgattacagaaaagtggctccataattagaaataactccatccaagggcccctttcaacaccatgccaatttgcctacatttaccaaatggatgtaaataaatggcattcaatgcaattttctctttacctggatgtcttctccatttttcttcatttaagaaccacaagtatttttcttgcctatttctcatctatgtggatctcaaattcattcaacacacactcattagagaagctactgcaaggcaggctgaaggctttggtactgaagatacacagctgaataaaattgtgtcctgcagggtgatcattgaggccctgagggcagacaggctgagcttcgatttcagcttggccctttcacgggctgagtgctacaagcatccttcttcaggtgtaaaatggtgataagatacatctttatttcaggactgcaataagtattagaaataaagaactttaaagctctggcagacagtagtgggtgtgcaataaatgtaaggctggattcttattctagaatggtggttctcaaagtgtgttccccagaccaacaacgtcaacaacaccaaggagcttcctggaaatgcaagttcttggatcccacctagacctactacaccagaaactctgagggccagcaatcagtttttaacaagattaccaggtgattctgatacatactgaaatttgagacccactggtctagaagaacatgacccctggagggaagacagacaggtggaaatcataattcgttgtgaaatggtggaatttgggaagagttaattgccattaaaacactcactgtcatcaggttttcaaatgtttcaggcttacagatttgttgcttcagttaattataacaaagacctacactggccagagaggttatagaaatgaaagaagggaccattatttaaaaaaaaaaaaaagcaaacaagaaacatgaacttctcgggtttccttttatttttacagttttgatgaaaagtgactgcagacatattacttgactgtaaaaacaacatccatgcaaaagtgaccatatggaccaactagcattcagtctctaggcagagcagccataaggagtggtgagggctgcagtcagctcaggagtatgtgctggatctaaaggtggtagcagctacttagatctagctatgcagaaatgtgggtgcagatctttcgatttcaaagatgaggagatacatctagatcaatatttgcttatatttaaaattcacttacttttaattcttggctcacatttaaagaaaataacaaaatacccagtatgtataccgaattgcaatctttgcactgtttgagtttctgagctagggatgttgttttatccttttttttttttttttttttttttttttgcagtgtcctacttcacctcatccactcccctatttcccttcccccagctttctttttgaaggcctagtccaatgctacatcatcagtagtttctcagtggagactttgcctaggatcagaagagtcttaactatgagtctgggctcctcaagtggtgctgccagctacgaataaaaacactgaagtggcttacttttctgcctataggagcataccgaacctcaacattgtcttgtcagatctcagatatttttaaaattttgtagttgaataacatttagatttaacatataaggagggattgaggtgaaacaataatgtgttaatgatctatctggcaaatgacaacaaaatagtgcacattagtttgcagcaactatacgtgaaagtgctttgcaaactaatcatggtaataacagttaccatttaacagtgtgtgttctgtacagacactctgctaagcatagtgcatagattatatgtttccatcctcacatgaattctacagggtaggtgccattagtatctccatttataggcaatcaaggcttgaggaaggtaagtaacttgtttaaattcctgtagcagtatgggatggactttggatttagagctaggcagtgtgcctgcagagatgaagctctcaactttcatcttggaaaactactttatgaatattagccaatattatctttaagggaagcatctgaaatagcaattacagaacaaaaacaataatgatagacccggtgaagattagtgtttgatgagaattgtgtaggttccataaaacatcgccaattccttcctgtgttgtgcttcatcagaattatgataaaattaatatactacatttgtcacctataggtggcaacagttgtacagatgactttttggtggatttttttttcaactacacttgggaataaaagtagggctaaacagacaagatgcaaatacattttcaagcttaaataaatagctttgcatgttcttaaaatattttcctgcctttagtgtaaccatggaattattagtgataattcaagcaagaagtgtatagtggcatattctccagaaatctcttgagaattagacctttattaatttaattccttgtagtcaagcagtcattcaatcaaactaatctactatgtgaccagctttgtgcaaacagtcttgtggtcttgattctcagaggaagttttatagaaaagggtgctcttggaatggttttgaagggcaaataggattgaaatacacagtaaggaggagggagggaattccaataaatattcatctattatgcctctattgcaactgtgcaacactgtgtagtctacttcaggaccatgagttgcccagagggtctctccctttggggattctgtagtagacaatcactataaagacagaaattgagacgtgcctaccccaagaggttctaggaaactcaaccagactcatgaaagtatcagcccgtacatgggttataaaaagttttgacttccaaactgcgttctaatctatgactcactttgctcttccatcagcctggaaggtgaggaaggccagagtcagctatactttccacgcgatatttatggaatctgtgattcacacagattcaaatccaagtgaaattagaccttaaaacttagttttctgatttttcacacaaaaattcacagtagttttttttatagttcacaatagtcatgaagtagagatttttgactagaacaatatcctgaataccaaggataaaattggaggagatatggacccttgccataatgaagaggtggaaaatatgtacggtgatacagaaaaactcaagtgataaaccagcaaaaaatatatgcatgatggtatcagcttcaaagagatacatgttatgtgtgtacagccagaaactcctgttcatggtagaggagaacaaatagcaaatttatgaaatagtgcaatcaattattgttctatgataaatgctactctttcattatttcaaatacatttccatcctttgattatgtcttaaaaatattggttagtatatctagtgtcaggaagagatccaatctatttgtgaaattcaaacacagcattgttcctcagctgggcactaacatttataatgaggattggagctcttagcacaagttaatgcaaacaggactttaatcaacataatttcttatttctctattgctatagagattcactgcccatggatcaagaaaatatgtggtaggaaaatagccctatttataaagtgtttttactatgagtcaggtactgggttgaatgcactgcatgaaatacctcatttaatcctgacagcaagcctatgagatagcactattatcatccccattatacaaatgagaaaatgcagatagcgaggtctaaatgttagtccacatatatgtggctaataagttaggcaatcaggatttgagcagaaacagcctgactacaggacttgggatcttaatcactgtgtattaccccaggtttttaaaaaccagcgtgcaactcctggctttgtgctaattagctgtgtaagccctctgacccttagtttctttacattaaaggtttttttgaatcttcccagtctataaagctctgtgactctaaaatattcttaattggatatcttctgggcgtctattattggaatttgaggtggcacaataaccaaccctaacacccccttccctactttagttctcaatgacttaaaaaaataaaagaaaaaggctgacgggaggccaaaagatcagctttactaagagaaagtttgattggagaacaaggtttccatctgtaaagaagtgggtttcctaacactgatcccaagatatagacaagcttagtaattagcagccctgggctgggaaacaagtgtcttcctgtaaaaactacagcatgaaggaacagaacagaaatttgtgcttctgacagtctgattccagagggagactaggaagagcaagaagttcccttcctgaacttgctaggcaagtcagtccctcattccctgggagaagtgaataaggggggcccagagactccaggagggttaccctaggaagctccttccatgtttttctcaaacaaaagaatgtttgagaagaaggtgtccaaggtgtcccctactaccacccaacatctctgattacatatgatgcagattttaactagacagtcatatatggatgaaggccaagaagatgctggaaaattctggtgctgcagggagttagtttgcacagagaagtgtctccatgggcaaagaaataggaagatggtgatccagcaggtgtgaaagatggcagagcttccatttggaagcaaataaatgaagtctaagagacggtctgtttaatcaagggttttgggctgaagctgaacatgtgatttaccccatcccttttctgatgaacaaatcttgagcactgggaagatggattcagggaagagttttatgttatgttcttgttgtgggaatggtgaggaggtattttaagccaaggtctcttagttgaagatttgtgcacatctcaaagtctatgttaagtgctatttgcgaagggcaggccaacctcaagggaaaagatgcaactcaagtcatttctcttttctcagaggcactagttaatcacttccttaatgccgcctcttactgcattcctggtgaagctactttctagatgagacataaaaatagatagaatgacctttggtgatcactagagacccctccacacttttctcaagagttgtgatattaaccctgttaacctggtcaaatttcaacttggatattactttctcccggtgctcggttccctctattacctcaactggacacattactcttgacttgcccttctgaaaaattaaagtgacgcattggtaatagagaaccactctctccctccaaccacactcacggagatgtgatttggcacttgggggcactctgttttcttactggggtcctagagattcttcagtatcctcagggcaaacagattttattaggtgaaagagtaattttcagcagagatgtgcttttatgactatattaactatactgctgtcctttactgtgatcgatggtcctcaatgacctctccttgaacccctaaacccagaggggggaaataaactcactttttgagaaaaagagcaagcaaagagaaggtcagtgggaagcttagggttgttagaaaataatacaccttgtggaaaggaaaaggatgcattttgaagataaacaatggctacaaaggacatttaaacaccagatcaagagtactgaaggaaagagaagtcatttcatcagtgataagaaacatccccatatatggaaaacgggggaaagatgggaggggatgtcccttagtaggaagataaagtagcaggaagaaaaccgcaaatttgcttatggcacagaaaggcatctgggaagaggaaaggcatgtaagttgggataaaattgttataagaaacacatttgtgatttctgcaaactctgatgttagcgtcatcatttccaatgcccatttgaaaatttggattttctgttttccaggggggaacagatccacaaagacaatttaaaacgtaggttgactgcctttaataatgcttccgatttgatgagttgtggtcaatttctccaaaagtaaaatgtgcactattttctgatgatccagaattgggcaaacaagacagctcattgctatcagcctgtgtaaacagcttaactaaatggaacatgtttctcggtgttgttagattcctttttcttctagcacagtaatattaattaaacaatttatgcaggaatgataattgagcagttcctgagatgagaacttctaaatctactcaagtaaggttaagaatttcagctgacaagagttagggcatcaagattttctgcttttcatttatgtataccatatgagtaaaaataaatatacatactactcacttgacttaaaagactgattagcctttttttttttttaactaccctttgcatcgttttatgtcttaaatatgtcttaaagcctgttcagcaagccgggccatggcaggcttaggtgtcactgtgcttgtagcataaaaagtccgtgaacttttgtcagatgaaaatgcagcatttacttatgtattataacatcacagtgctatgttttcattttggagtgatagattttttactgtttgtaaaagaaaaaaataatttttttgtgtggatcaggtgaatataaaaaaagcttatactactatttttcccatggaagttccccttccaaaagaaaatctccaataccattggagatgggtggacatcatagaattatacctgaaattgctaagtttttatgaggtatgcggcgagtgccaaagctagggaaaaacattttatgttattcattaacctatataaataactagatgacctggaattacttccaacagagtttggtaggccatttaggagccacagtgcattatggcacccaatttattaggcactttacaacagccatggaattaaatgggactgcaagctaaggttcatccaggaacatgctgatattggagggtgcaagaatgtttgctccactgatgtgtgattcatttcctactgcaattcatgttttgggtcaagagctggtcagcttttcatttggataaagttatttgacatattgaatcctgacagccaggacaattcagaattggaacaaatttattgatccttattctaaaaagaagaatttttttttggtgggaattgttttaaagattctttcaacgatcaattctgtgtggcactctagtttatggcagcaattgtaggatgctcttaatggtcactacccaggaagcactggggttctagaatggggagacatgctggtggggaggttgccgatgggaatctgcttccgttccagattccatcccttgctctaccacaatgtgacagtgacaatcaccacttcaactctgtacccagattgtaatgaatacttaaatggggagtctgctgttcctgccacatcctttgtttattctttaggtatttaccaagtacctacaatgtaccagaaagtattctagatagtagagatacagtggtgtatgagaaaagtcacatggaatacatgttaaggactttttaatatgaagcaaatatggaacaaagcattagatataccagaaagtgagtccctgaaaattgctttgttgagttagaatcatctacccagtctgctctttggtctaataatggcacctagaacacaaatatcctgtcaaattcagagttatggatgtgcccaccccaaaggtatttttggaataactccctggattttctaaagcttcttttgatcttcttccattttcagtctgtaacatcatttaggcagatatttttcataggttaactagttactatttacactcaactttcttaacctttctgagtctggtgactttctgaaattgacatgtttaaatcagaatttctttctttttactttttttttttttttgagacagagtctcactctgttacccaggctggagtgcagtgatgcgatctcggctcacttcaacctccacctcccagttcatgctattctcctgcctcagtctcccaagtagttgagattacaggcatgcacctccatgcctggctaatttttgtatttttagtagagatggggtttcaccatgttggccaggctggtttcgaatacctgacctcaggccatccacctgcctcagcctcccaaagtgctgggattacaggcgtgaaccaccgcacataaagatagtctatagatggacgaatatgctatccgttctgacatcccgaaaggaccagagggagagggtactgcttgaatagaacctaaaaaaaaattcttccaatctcattagcccaaatggatggaaagaaaaggagggcaggcagattttaggttagcatcaagaaacctcttggattaatggaggtctgactattggttactttggcaacagcaattttctttttgtcaagagcaaagacatgtggattcacctcccatggtcacactggtttggcagctctgagccatctggggctttctcctgcacctctaggtaggcttggtcagcagttgggtgaggcagcagctgccactgctttatggaaatccaggtgcaatagccaatacaataagctcctcatggggcaaaatgttactgaaaagaacaggcccaggatattaccttggttcaaaagtaattgcaccaacctaatagatggtatagacattgtatctacccttttcttaaattctttcttcagccagcaagtgtcacctcacctggtctgagccaagtccaggcaatttgctcaaattcagattcctagctacttcaggcagaggaagtttggtgacccatcttggtgcttccaggtgacaatagaaacatcatgctgatgacattcttagaggcagcaatgagattgactacctgagtgataaacctacaaatattactggatgtatcaaaccaagaaattaaactgtagggagattaaattatagctgtcgtagtacaaaattctagtaccaggtaccacacagatgctatttagtctctctctgccacatgaaatatattcattcagcaacttgaatattgcattataaaaggtattctcttcaactggctttatgccactttatcaagtttaagtcagccatttgctacaataaaaataaacttcatttttgtctcacatgcacaggacaatttaatttttaaattaatgtagaagtgaaaggtgctttgctccaagagaagtatgtctgccctgcatggctgtgtaaacacaatgcgattgctatgagaattaaatatggatcagcaaaatcaatagttaattgtgtaactcagggtctttcatttcagatctaatctgtaaagaaggtccaggggatgtttgcttttgattttcttaaaatattatttaaaacccttctgtcaggcaagaaagttcacagggtctttacattatttccataagttatttggcttgtgagtagtcaaggtcatattgatcgcccagcctttccagctgtccttttaaaattcagtatctttatcagtcaaactgcctcattctgagtatctggcttgcacttaggctaaacaaattttattgcaaaaataacccaacgtaacaggtgtcttggtaccagacatggatggactagttgtattataaactgccttttggtctatgtaataataccattcggagtggctaagcagtccccttcccctacaaagttgacaaaatatactgtgctgtgaaaatgcaagatgttgtgtgacatggcaagaagtactgtagggttgggctgagtctatagatggacgaatatgctatccgttctgacatcccaaaaggaccagagggagagggcactgcttgaatagaagctaaaaaaaagttcttccaatctcattagcccaaatggatgagaagggaaggagggcaggcaggccttctcttgcaaaacgagtagcacagtgactgcggaagactgtgggggtaacaggcggactgccttgacccctgtgatatcacagcagagctaaaaatgtaatgtttgaacttcttttccctttaaagtgtaacctttcatataataagttaagccttgctctctcttacatattgttagaagccttcatccattttggggactgaaggcaaaataattcttgaaataatgaatcatttttctcttaccagcttgtccagaaatcccatgattattttgctatagcagacgatgaccttctcaaaggaagcctatcaaacgctcaagataaataatgagaaggtctctctctcctgcctccaggaaaaaactgcacagaggaaaaatgtttgctaaaccattaatatgttcatcccaggatgggaagcagcttggtctaaaagaaacagagtggcacatgtgtttgtgtgtgaccagtggccccattcaacaggactcctggggcagcatccatggaggggcctcaggagacacacctaagccctttacccagtaacgtcggaaatgaatgtttctctggtggcagacagggtaccttctaaacctcttgactcatgagcaaattaactcaaggtaaggaagcactgggtaatgccgtctctcaacaacctagaaaaaacatggttctgctttactaggccctggaactacaattaatggtaatgaattccctcttccctcacattcccaccttcccaccaggcagcaaatactcaggtggcaaaagaagctttctgtctgtttttctccccatggaagcaaggtttcgcagagtaggtagagagctgcagtagaaattgcaactttcccatgatttaagtgctttggctgccctggagaatggggctgatttctcagggcaaaagtcaactctccatccatttatggctcttgtccaatctatggacagctgaagacacagatcttaactccaggagttggtgtaagatccttcccagcagtgaaatggaaagagttttcaaagacatagggtcctctatgggaagaggtgggagagtcaggaggtgaggaagaaaattttctattccaaggcaagctcaggaatcaatgggctgaaccaagtagtacccaatggctgggtaggggcaagggtaaaaaagcaatctcaaaagtaatcaggattcaaatgatccagggatttgcagataaaattaaaactgctcagcaacacttcaggagaaaaagtcagtagcatgcagatagttatcaagcacattattttgccagccagctgaggatggcagcaagctaaattttgagtccagaaaggtggttagggtttctgtgctctggattgtacatcttcctctctctaacttgttctccccaccttttaggatggccaacaccctcttatcacttgagactcagaagaagggaaatctcctctgaattcttttctgaccaggggccctgatgactgccccttgttgtcccttcatccctgtgtggaccattctcatggcatggtgggtatttactgtgtatatcggttgccatagctcagtctcccttgtagggactgaacctatttatcttcacatctcttgtggccagaacacacctggcatataggtggtccataaatgctagtggaataaaaggaggatgctaattatgtttatttactggtcatccttttcccccctatcactttaactttcacctctctaatgccctttaatgtccttgaaagcgattgaattcctaagacaagctgccatactttctggtggagaatacacatttatttcctgaagggtagttaatgtctaatcacccagaagacatttaggtttcttttatttagaaagcggagataataactcccccagtaagtaaacaggaaaatagactttgttcttcaaaaaaaatttgattaacatagtttcaaggaacatttctactgttgtaaaccaaggttcttgaaataatcaacaacattacagattgcaaggttagagattaaaacatgcaaaataagtggaatcataccatttagcaatggaaagacagactatgtcggtgaggtgttttaaatacccaaacagttttatgacaaaaaaaatcctcactataaacaaaatgaattagggatttgccttggaatgaaggtttaaaaataatgggatgagtttaaagaatactgcaggcccttaaagacgatgagagattttgagaggcctgagtgacttcagtggggtccatccctaaaataatgaaggactaagtaagtcaaaccttagggtcgcctctgcagatctttagcctggcctgtgcaattgtattgcacagaggaatacaatatggcaggaacagaccaatgtaacaggtagcaattgttcacgcaccagatctggcaccagctaccagagggagggtgaaagaggggaaaattatcttttcttcaactctgtgaagacttagagtttcagatagttaaatgtgagtgggctggtgtttcctctttgctagatttagtgtgtgcggtttctctgccatgtatatctatagttctctaaagtgactggagaaatacttttccttaaatcagtggtaaagaagttactggcaaaatgtcccttaaatattcctgttgggtgctaccaaaggattatttaaaatcatgaaaataatccaaaagctgctcccactggaaaatgactaggagaaagatgtttaaattcaaaactgctaagcacggacacctacctaaacacacacacacacacacacacacacacacacacacacacacacccttcctctgaagctttccagggatagctatagaaatttcattttaagcaagggaaaaaaaaatagaatcaccccctcacaaaaatgtttgagtatattttggtctcttggtcagggccaataaagatctcttgttgtgagccaactagaacagaaatggagtgagagatgtactactttatgtggtctgaatgtgattagcgattagcgctggtggcttcagtcacttgggaatggcaatcagggttttgctcctgcaactctgaacgactacaaaacacccttggcttccatcccatatgatgatgggatattaactgaaaatctaattaatctgtgaatgaattatggcctaagaaatataccattttataatcaattttaagcgagtccctaacagaagataagatgaagaaaaagctgtaaaattgtaagaggttggtacattctgttcactatgactgatgattttaagggggataattttacaatccatcacatttttgtcattttaaaaatcatgcctcccaatgaatgttgtaaattaactttagaatttacatatttattaaaaattgtatagaaaacagcaggaactgtgccccatttgaataataaaataacttgttattccactgaagacaaaaacacacaaaaaaatcaaaagattttattttcaggtaataatcatattaattgctatctgaattagttaaaccaagaattaatattcaccagaggcagtgacacagcattaaagataatcctccaaattcccattttcaaacatgtctcagaacatgtaaaagcaagggaaagacaaatggggaggtgaggaccatgttcttagcctgcggggttgggcagcagcagatgtttgaagctgagctacatcacctgggggaaggggaggtgcagacagcaaaacacatgatttggctctgagatgaagaagcacaggacttcattttaaaagcctctttgcttgtgaggctgaggtgggcagatcgtttcagaccaggagttcgagatcaccctgggcaacacggtgagactctatctctacaaaaaatacaaaaattagctgagtgtggtggcaggcacctgtggtcccacctacttgggaggcagaggtgggaggattgatcaagcccaggagattgaggctacagtgagccgtgatggcaccactgtactctagcctgcgtggtggaatgagacaccaactcaaaaaaaaaaaaaaaaaaaagcctctttccaaaaagattctctactctacttctcctactttggttgaactccctacccagaatggaaggtttgctggaggcaacagaacatcccagatgactccagagcatgcagggaaataaccagaagggcatggaaccatgccacataacatgtgggtgaatacaaccattcactctagattaacctcataatggactgtcaactcaaagaactggctccaagataggaactgcatggattcatccacagaaggatgaaggggtcaaggggaatagaactggtgtgttaccacatgtactcactagtaagagtaacccattgggctgaactgacacaagatgttctcttgaaattcctgagagatgagggagaaggataatgcagtacatgtttttcatgaacttcagtttaatcatgattccttctttccatgagggattcatgataggctgttaccactatttttaagaaaagagcagagatccttcatgaagtactgtagttgagtgtgaggcttggctcacactgcctctgctactcagagttcattgcttcagtgcagacatggctaatacctggcacttgtgcggcaaccaactcctctcatgcccacagcaggcattgcttatcagtctctgtcatctgtcatctgtcatcccaagcatggatagggcctcagaatccttcttaacaccacaattcaggcaacctctgtctattgattgtccttggcatttgagatgaaagctatcttgcatccttgtgtgtgtgtgtgtgtatttatacatgggaaatatttatatattatcagcatataattaaatctagctagctatatattacatctatatacagagatccaaatacctatattatatctaactgtctgctaatggtgtagtcatattccttagtatctgcagctaatatgagatatagattgatatcttagtatatgaaaacttgaagtcacctttgactcttctctttgtctcatactccacatctaccagtcttctggtaaattgcctgtttgttctcagaaacagcaagtccttgaataatatccttttgttcaatgttatttttttataacattgatgagaaaaaaaaatcaattcctgccaggccactgtctgtgtggagttggtatgtctccccatgtctgtgtgggttttctccagggacttcaggttcctctcacatcccaaggctatgcgtgagagataaattggtgtgtctacatggtcccagcatcagtgagcataagtgttctgcaaaggaactgtgtcctgtccagggctggttcctgctttgtgtcctaactgctgggatagattccagccacctgcaaccctgagctggaataattgggaaaataatggacttacttgtttttattcacctttcttaagtacgtgtacagttcacatgtgtttcaatgtttaatattagaagtgttctggtctctgtttagaagtttagtaatgtttctgtgaccaggaatatgccctaggaactcagctcttgcttgtatcaattagcctcggataaagttggtttctttatatgttgttttgcctaaagtcacagcttctgagaacctacaactttaagcaaggacttactgtgcattcttctcctttcccctgctccactctgcaccataggaactacattttccaggctccctttatttctggcttctgggaaggttcagccaatgggaagcaatagcagaaggcagaagcctggacagtaagaggagggggggaaacaaggcatttctccccttctctgtgtcctgtgctgttcctagcagcacccacttctccctcactgctctaacttccaccatgtgccccttcccatccatggttttagcttccattggacagtccagcttctagactctaatgtcactctgccatttccctccatccttaaagagggtggtgacttcctgctctgctaatttctagatcatgactgtctcctgttgagtatctcagctattccattatttggataagccgtttactgtattgaattccctctactgaaaggcctaaaatagttcccattccatgctaggccctgaccaatacaatcaggaaattctgtttgtgcaactttaatccagtcattcttcaccatttgttttttgctaccatcagctcttgcctagatgaccacattagtttcccaactgtgcttccactctctcctcctgatagcctgttcttcatacaaaagccaaggcatcccttagaaactgtaaatcaggtcatcccactcccctgttaaaactcctcagatggtttccctttgctgacaatgaatcctaaaattctccccacagcctataaggtccgatataagtggctcctagattcttctccacactatttctcttcctctctgtggttctgctccagccataatggtccagggacacgtcacacatacccctccttcagggcctttgcacttgctatacccgctacctaacatgttcctctttcgattagtcacgtttcagtgtttcacttcattcaaacctgacagagcaagagaatcaccatcttggacaagcaccgccattttaaaatgccccttgatcaaaaaccacctaaatccaaagggcatcagcctaatggctaagatcagcatgaccataaatcacaaatgacatctccgaccagaaacattccaacaataagataaacccctccctgactggagggatgtcagccccaagatagcctctcctccaaccacagacattcccaccctgcaataaacttctccccgccacagaaatattccaagcccgtgataagttctctcaccctgaacccttaaatactattagtctgtaagagagagcactcttgacaaaaattggccagaagcccctgtcaggtttattctccaaaataaacctgtctttgacctttcagctgcttttcatgtttctttcctttctttacctcttacaaaacctctgttcaaatgtcccttcttcagaaaggcctttcccaatcagtcactctgaagccatgccctcattatatcccatctatgaagcctgcttgattttattttattttattttattttattttattttattttattttattttttgagacagagtctcactctattgcccaggctggagtgcagtggcgcaatcttggctcactgcaacctccacctcccaggctcaaatgattctcctgcctcagcctctcaaataggtgggattacaggtgtccaccaccatgcccagttaattttgttgttgttgttgttttttagtagagatggggttttgccatgttggccagtctggtctggaactgctgacctcaggtgatcctcccacctcgcccttccaaaatcctgcttaatttttaaataacataaatcattacttggaattacattacatttttttattatctaccttccatattaaaatataaataccataaaggcagggaccttgtcttttttttttctcaaacttgctccatccacaatacctacaatgttgcctattaaatagtatgaactctataagtagtcttgaatcaatgaataataaatgatgaacctatgtcacactgtgaaaaacaagtggcaccaagaaatagttgtcttattaaaataaaaacgaagatataaacatttctctaattacatcaatactcatgtttaacgtggaaaaccactgcaaaccaaggtactgcttggtagttattacacgagctaagttaataaagttgactgtggccagtgagaaattctccatgatctattctttccacatctctgctatctttctttctcaggcactattccatggtacctatgttcagtgcacttggaactgatgtggtcagggaaccatacagactgtgtctatagccctttagtttgttcattttaatcataaagctagaaaaagatatctgagatattcagggttactggcctaccaactatttcttttggccacaaattacagctggaacagccacttgtttatgaaatatgaaactgagaaattcctaagaactcagtaggccaaagtggatttcttcctgctgaagtcaaaattcattcatttctctatccttccatcttctgcttcttggcttcacgtactctcatgggttgaactaggtcccctaaaaagatacgttgaagttctagctgctgatacctgtgaatgtgactttatttggaaataggttttttagattttattgagatgtaagttaaggtggatcatactggagtaaggtacaccctcaatccaatataactggggtccttatgagaagagaaaaagagacacaggaagacatgcacggaggaaagatgacaggaagagacacagagaagaatgccatgtgaagacagacacagagagaaaacagagacaaagatgagagctgtgcggctgcaaaccaaggaagaccagggattgctggcaatgacagaagctaggaatgcaagcagggccctgccgacacctggatttcagacgtctaggctccagaaatgtgaaagaataccccgaataccccaccccgccttttttttttttttttttttttttgagatggagtcttgctctgtcacccaggctggagtgcaatggtgtgatctcagctcactgcaacctccgcttccccagttcaagcgattctcctgcctcagcctctcgagtagctgggactacaggtgcctgccaccatgcccggctaatttttgtatttttagtagagatggggtttcactatattggccaggctggtctcaaactcctgaccttgtgatccacatgtctctacctcccaaagtgctgggattacatgcatgagccaccgcgcccagcccctttctcttgtgttaagccctctcgtttatggcagctcctgggaaaccagtaaaagcactctctggattacttatcaccattaacaggagctgtttggagacatgaaatttccaggagttgcaaaagtgtatttatgaggtttttaactgatgggaaaaggaagacaagttttaagtgttttatttatttatttatttatttatttatttattttttgaatttcttttctttatttgacttaaaaatgggatgcttgaagatagaaatttttgttcaacactgccatgtgaaataatgattacattaattctctaaaatattaaaagatgcttcatttgaaaaggaaaagtaatcaggaaggaaatgaagatatatttagagtatcaggaagcgatgaaacgcagcatttcatgggaagtctatttggatgcacacatcagcacgcctgctgtgcagtgtgctgcacagctcaccttgtttggtcactctacaaatgacggaaagattgtaattggcattttcttgcaaaggtgtacttggcccaaaacttttagtcccaaggctttctttctttaaaagtaaattcaaaatcaattccctagtaaaatttgaaaatgctggaattaggcccaggattcgattcccagttagaatttctccccacaatatgctaggggaaaacactggtgggatttagatataaatggcttcacttccttcaatcacctaagaatgataaccaaacaaataattgagttactgactcagctggggtgccatctggcataatgaacagtgtatgaccaacgcctcactttgaagcttttcctaaaatgaagtaaaatatgcataggctctttatagagtctctgttgtgtcacaaaagttaggttagtctagcaattttggtaaaggccgagcttagtcgccaccctccagtctccagcatggaccttgtcttaatccacctgggtagcttataaacaagagaaatttatttcccacagttctggaggctggaaagtccaagatcaaggcactggcagttttggtgtctggtgagggcttctggggtcatagatacctgccttctggctatgtcttcacatggtagaaggaaggagtgaatgagctctctggggcctctttcataagaacactaattccattcataagagctccaccctcatgaaataatcacctcccaaggcgccacctccaaataccatcacaatggggatgaggtttcaacatatgaattgtggggggacataaacattcaatcctgaataaagttgtggatccatgtctgtcaaatctatgcttattgtgaaggaagaagtcttttctctaaacggaaaaaaaaagtctgttattttctcggtaaagagtaaaaatcttcagaataaacagcagcatctctgccctggaaggtcggttgagagtggcacctggttccacgatgggaaaagcaatctggggaggctggaaatgtcagagcccatgctgtccttatgggagaagtggctttttgatcttggagcttccttttattctatgtgtgattcctggccatggctgtccccttgtgccccataatccctaaataaatgatagctcctgagaaatcctcagtggaattgcttcttttgcaaggaaatgtgccagtcttaattctactggcttcttactttgacctttggtggataaaggcaggagcgaatccaaaataggaagcgttggtagtttggggccttataatgtaaaattgtgcctgaacttgaaacaggatccaaggatacttttaccgttctgttacctccagctcagccaccatcacccatatttgcatttcccccatctgtccctttcaaccgtttacacatcacacaattttacatcttctctgatgatctattgtttttcatttattttaactctaaaaacctttaagagcatctaatttcagagatgtatacccttctactagctttgttgattatttttcttctgaagattaaatgtgtttcagaatatcacctacactagcagttaactttcatttgagtattttggcttcacccaacacaaggtaataaatcctgggttgttttaaaaaaataacactcagtgaaattaatttggaataaatgtgatggtgcatatacttattttaaagtggcaaatatttatctacagggacacagcctgaccaaaccaaatgcattacctttgtatgcaaaaatgatgccatgatgactccagagaagggcagatttcatggcttctattttgcagtaagcagtacagattgtggttggttgatccattctacagaaaccagtcctcatgagctggagctcacacctacaaaaggtttgctagtatggagatgtttcaatttttgtgagcagttaatgctattattatttttattgaaaactaattggcccttgtggagagagtgattagactactgcttattgaatacttcttatgttcaatcactgataggacctgtgttcaatcactgataggagctgcatctcctgtaaagtccttcatctcctttgaagtccaacgacttcactgaggtagattctcttatgcccattataatggtgagaggttcagccaagttaagaagtttatgtggggatggaagagctttctgattccagagcctgtagtcttttcactcggatcattagcagagagcttaatcatcgtacatgattcactggcttaaatgtagacagattaaaaaagctctcagaatttaaggagagaaaaaaaactcaaaactcaagaagaaattctcctaaactcacagtttacatctttttaaatgaccatggtaaccatccataagtgaggacacactggggaaataaagagagggcaagaccaggtagattccagggtggtgggtggtctaacatcctcatgcttcttattcttcttttttatttgggttgggggaacatggtctcactctgtcacccaggctggagtacagtggtgtgatcacggttcactgcagcctggacttcccgggctcaagcgatcctcccacctcagcctcccaaatagttgggactacaggcatgtgcaccatacccagctaatttttgtatttttttgtagagaagaggttttgccacattccccaggctggtctcaaactcctggcctcaaggaatttgcctaccttggtctctctaagtgctgggattacaggcatgggcactgcgccggccgacatccttatgcttctaacagttatcccttaaagagcagtcaccttggaggagctggtcctcagggcttcctgtcaggacagtgctcccttgatgcatgggggtcagttcacacacccctgataagtgccacttgagtttacatcatacttttatattttgtacatttaaattttatagttgttaactcacaaaccatccaaatcatctttgtcattcttcactactaatagtgctgagctctcaaaggggatgtcatattagattctatttcctcttgttgaaaatctgaaggtttctcaagaaatgaaagtaacttggggaacattaacataaatagaaagaaaaatggcatctttgttttctgttgagcctttgtgacctttctagaggctactgtggatgaacttaaggtcccatctttttttttttttccatgtcctgaaggaagctaagtgtatgtacacgatgacatttttcattttgatatagttggtctgttttccagactatagaaaactgggaaatgaattttctttcaaataaaagttgaaaccctttgggaaagtaaaagaattcaagaaatatagagaaatggctgtttccaagccaacaggaagaagggagagtctttttggttttcaaattagttgttagggaaaacgtttttcttcccatcaaactttcactttttcttctttaaaatagattaatcatagctgtgtaggtttagttttctgcctgcttgttaaaatgtggaaaatatgaacagtggcttcaaacttttatgagtaaattgtcattttgtgccttttattggcccgtatttcaaaccccacattgcaggaactcactgcttacttctgcgctattcactggcaagagtatgctaatgggttatgcagaccatgtctttatgaattgacaataaattccaaaggacaaaacagcttccaaccataattcagtagtataaaactgttctgtcaacaaatctgatggtttttttggtgttcacacattttaggaccccatcatgcacagacacctgctcatttttcctgcttaaaaaagaccaaatttgttctgtcttttttactcttaaaaatcaaaatagcaccatggtgaaattatactacctgctttagtcttcaaaattattctttagagcacaaaaggcagacatactgggcagaccagagagtgaacactggctgtgtcactctggacaagtcattattttttctgaatctcagttttattatatttagtatgggggaatgataaggggtaactgtaaagccatgtgtgatcttaagactagcaccaccagcattgactgggaacttgttagaaatgcaaattgtggccgggagctgtggctcacacctgtaacctcaacactttgggaggccgaggagggcagatcacaaggtcaggagatcaagactatcctggctaacatggtgaaaccctgtctctactaaaaatacaaaaaattagctggatgtggtggcacgtgcctgtagtcccaactactcaggaggctgaggcaggagaatcacttgaacccgggaggcaagggttgcagtgagccaagatcacgccattgcactacagcctgggtaacagagagaaactctgtctcaaaaaacaaacaaacaaacaaacaaaaaaaaaagtgcaaattgtaaggccctacccagatccagtgaaccagaaactctgggttaaggcccagcaatgtatgttgtaacaagccttccaggtaattctgatacacactcaagcttcagaatcatttctgtaaagatttaccacaatatacacaaagggcttgtttgccacattgcagaagcacaagaaatagcagctattctccttttgttattatcatcattgtacagaagaaactgaagcacagaaccaggtgcttcagcaacagcagtgggccttgtcactcagccgagtggtggggacagcctgctcctccactctgcactctctctttatggatgatagtagacagtgatataaatcctgattctaagtgtaaaaggtgtcccacatagcatgttgcctagttctggcatggatgatgcattcaggctttaatgtggagactatagctcttttgacatgatagattttttttaaattatattttaagttctagggtacatgtgcacaatgtgcaggtttgttacacatgtatacatgtgccatgttggtgtgctgcacctgttaactcgtcctttacattaggtatatctcctaatgctatccctccccactcccccctccccacgacaggccctggtgtgtgatgttctccatcctgtgtccaagtgttctcattgttcaattcccacctatgagtgagaacatgcagtgtttggttttctgtccttgcaatagtttgctcaaaatattggtttccagcttcatccatgtccctacaaaggacatgaactcatccttgtttatggctgcatagtattccatggtgtatatgtgccacattttcttaatccagtctatcattgatggacatctgggttggttccaagtctttgctattgtgaatagtgtcgcaataaacatacgtgtgcatgtgtctttatagcagcatgatttataatcctttgggtatatacccagtaatgggatggctgggtcaaatgatatttctagttctagatccctgaggaatcgccacactgacttccacaatggttgaactagcttacagtcccaccaacaatgtaaaagtgttcctatttctccacatcctctccagcacctgttgcttcctgacttgttaatgatcgccattctaactggtgtgagatggtatctcattgtggttttgatttgcatttctctgatggccaatgatgatgagcattttttcatgtgtctgttggctgcataaatgtcttcttttgagaagtgtctgttcatatccttcactcactttttgatggggttgattttttcttgtaaagttgtttaagttctttgtagattctggattagccctttgtcagatgggtagattacaaaaattttctcccattctgtaggttgcctgttcactctgatggtagtttcttttgctgtgccgaagctctttagtttaattagatcccatttgtcaattttggcttttgctgctattgcttttggtgttttagtcatgaagtccttgcccatgcctatgtcctgcatggtattgcctaagttttcttctagggtttttatggttttaggtctaacatttcagtctttaatccaccttgaattaatttttgtataaggtgtaaggaagggatccagtttcagctttctacatatggctagccagttttcccagcaccatttattaaatcgggaatcctttccccatttcttgtttttgtcaggtttgaaatgatagattaatattaacccatctttctcttttgaggacagtactggtgactacattctgtcaataaacatttatggacttcaaaccatgttcaaggcttgatgctgggccaggcaatgagtaagaaatgatctttctcctaaatttctgacatcacaaattttgacattactaatgatctgtttagattcatatgtttttagaagtggaagtcgttttcttaagacaatccatttcaactttcaaattctgcctttcagagagctaaggcagtgggtctctttcctgcatgctggttacaatcccctgggcgggggggggggcttttaagcaatactaatagggatatccatccaagaaattctgatttaatcggtctagaatttagtcggcaataggtctgtgggtaggaagcttttaatataagtaatatacttaacgataaatacaataagtattacatatataaatataatatatacatagttgggatatacttaaactaaaagctattccttgtttatctgatattatagtttaaccaggcagcctatatttttatttgttaaatctggcaacaccgtggaaagattctaaagtctatcctaggctgagaaatcatcttgtagggtttccactgaaataccacaggtaatgagggcgggataagagagcagggtgccatctgggcccattacacacaaagttttatctgttttacttatttggtctctggtctctgtaacatttcacttgaaaaaaatggcttgaaaaagtttgcaaacatctaatctaatcatatcaaaacttaaaacccagagaagatgtctcttagccaggttctcatagctaattaattgcaaaaccaaataccaggtctctttctctttctattacatcagatactgctgctgctgctgctgctgctgctatgtcccttttcctcttgttaagtgatagttcaggaataggaggtgctatgatcctatatctaaaagtgtttggcaaacatttggcaaacccattaagatatgccagacacatataaagagatgctaggtgctgaacatggggattaagatgaggttttagttctcaaggagctgatacaggaaaagaaacacaaatagtgtttctgttcctacaaaaaaataccacttatgtctatgacttgttccctccacaatgtgattattcaaagcacctttctttggtcctcaatttaaaaatggtgaggtgagaggacagcactgggttcccagaggcaaccggatggaacctggaatctaacctagattttcattatgaaagttataggaatgaagaatccataatgacaaaagacacaaggatgactgtactttgggctgtgggatgactcacaatggctatatctgtcaggctttttggcaaatggtctcacatggtctccaattaagtgaaccacatagaatttaaaagttgcagggagtaaaagaacgtgtccttccatttttggggaatacatttactcccatccagattaaaatgggtaagcactaatggtgcttctgtgctatagggaaaaatgaaacataaataggcaatgcatggggtggaggtaagacattctccactgagctcccgtccactgtcactttggaaaggtttgtgatgagcaacatcagaggatggctgctccctggcaccactcttggatgccaatgacccagaaatttaaggggactccagcctcttctcgctcctcagggaccagggaagatattttaggtgatcagttggcttagggaaagaggaagaggaagcaagattaacaagccataaacagatcaacttaaaggggcaagagagctccagagatacagttgtctctggacttggagactggagttcccaacattgagggacttattgtatgtttaattatttctaaactccagtttggacttagaatccaaacagcccccaaggctcacacaatgtggagaaaatggcagtttattcacaccattcacagaataattactcatttctaggtcttggtactttctgtttttcttcatcatttcttcttttctaccaccatcatcactcccaatcaaactatctcctccatgccctgaagtttcatgacttcaggttactgtttggctgtgatttccaaacctcccatcactttctcccaggaacctcggggtaggaatctctgacttgcagagtgatttttaggatttataatctgagtctgttatcatttgaggattaaaaagtatttattggctgggcacagtgactcacacctataataccagcactttggtaggctgatgcagaaggatctcttgagggtagaatttggagaccagcctgggcaatatagtgagaccctgtccctacaaaaaaattttaaaaattagccaggtgtaagggtatgtgcctgcagtcctagctacttgggagactcaggtgggaggatcgcttgagcccaggaatttgagattacagtgagctatgatcatactagtacactctagcctagatgacagagtgagaccctgtctctaaaagattaaaaaatttaaaaagtatttaattattactagatgtccaacaaagttgtgaaaaatttaaaaataaatgacatgctcaaatacatatatatccaaacaaacgctcttcttttcaatattgtcatgttgggacatgtaaaagtattctgacaattcatcttggaaattcttttttggaaattattttcagaatcagttcatgagctttattacttcatgttagattttaattttgactgaaagttgtattattgcctggatttactagatttgcttttgaatgacaccggctgattccaaaagccaaattcatccccagtggatgaagatttgctccctttaagggaacatgaatatcataataaacaatgagtcagattttcctctatggtccattgcgatggctgacgttgaagacttggagttgctgttgttattggtgggagtgcacagaggagagcattgagatggcatgaccaacggactgaattactgactgggtcattcattcattcattcattcaacaaacatttataatgcacttattttgtataagtattgtgataggttgtagagattaccaagataaataaaatgtggaaataagctagatgattaagatcctttctagttattttatttatacatatttcataatgtttgaatccctaatagtattctgggcaaatccagcactgctgacatacatggataaccccctggcccttatttgtacatctaagttctgatgtgccagttaaaaaatgtactgagtttaactgaagtcaccccttagtcacatctgaatgacccctgttgaagccatctcttacccttctcctgcccctgaaacccttcccagtgctcttgaaactcaaggccaattagcagaaaagctacctatatcttcaacctcttttctgaaggtgtctttcaccttgtagttctaactgaaatttgatttcccttggggaagtggctttctttggaaccctttcaagtggtggcttttttcttttctatactttttgtatcactgagcccagaggtgaagtaggtatccgtctttcctacttcctgctccaggaatgaatttcatgtcatctgactgccagactgccacctgcctcccctccttgttataaacatcgattgaactcctggtcattcttcctagctctttgacattttagcttgccacatactatcagactctccaatacaactctagccacaaatcttgatgatttcaatgccaacacaggtgaacacctgagctgtgatctctcttctgcacatctcctctgtgcattcccaccaataacaacagcaactccaagtcctcaacttcagacttctcactctccaaagagcacctcctggtttatctgcttattctctctaatacttaaactcaacagtcctttggaatctaccatccattgagtctaccaatgttttatggttcctcatacctttcgtgtccacatttccattcctactcagtttagtctccatggttcattgtaatcatttccctttaaacacccttaactccactgcccctctctctgtgtaccactaacaaaacctaactgtgtgaagtctaacactctacctgctttacattcatgctattgaacatggatgtagataaatacacaactatgctcactggtctcatttaactcacaattactaacttcaagttgataagatcctgataagtttctctagtccattccctctcctcctttcccagactatttcacactttctcttgcttcttgaaaactgcaatgccttctaacttatacttaactctcagttgacaatcttgctttctgtatctctcaggatagaagaaatcagaagagaattctgacaaggttccatccatgtctaacagcatctgcccataagttgtcctcccctctgctcactctggatagacatcatgtttctatgtaagggaagcccttccactgtttctcatctcttacatcatcagtttttctctctctctctgctggattacttccatcagcatacaatgtgtggtaatttctctcatccttaaaaaaaaccctctccagtgaccccatttatctatacccttttatagcaaaaatctttgaaagatttatatatacttaccatctccaattcctctctttttaccctcccttgatccctctccaatcagactacccctatcattctactaataagtctcctgtcaagatctccaatgactccatattacacgaaaggttaattctcagttcttatgtgacttgacctatcagtgtcatttgatatatttgatctcttctttccccttgaaaactctttcataatcataatctacgtttaaaagtctagtcaggtttaaaatgtaagttgctttgcaaagccccagtggtatcaaattctgaatcatgatgtgttcacctccatgtgggaaatattgggagaaaatgaaaaaaaaataatgaaaaacaaaaaaaggacccaagagcatgcctttaaaatacttgatgcccacattttaacttagggattgtgacagctagaaagaaccttagaattcatctagtccaatactcccattttacaacctaaggacgtcaaggcccagagaagattagtgatttctctatgtttttacagaatggcagaattgggattagaatctaggccttttttccagaggatttcattctaatgtccagtttatactgcttttcctctcatatatgtgtatgtctatatgtatgtgtgtattaataaataataagcatatacatggagacatatatatttgcatatgtacacaatatataaatacaacatacatatatatacacatatacaaatatagttatatacattacacacacacacatacacacatacacacatttttttaaaataatttttttcctgaatgaaataagtgttgggatgagctcatgcactccctctctgtcctttcctctgatagagtcaggtatccctattcggttcccctgggatcaagcccatcttccactaagatggatgatactgaagcaaaaggactaagaaagcccttgacttagcagatcactggctgaataaaaaactcactgctctgggccaccatctcagttctgctgatggaaggaggctggatctgggaaaagagagatttaggtttagtactggctaaatcactgggtgaccttgggtgttctcatctgaacaatgagaggctgtattgtataaagtcttaattcttcccttctaaccttctgccttgagctcaggttatttgggctgatcccatgctgtttatgtcatcttcttctatattagcttctcctccatgtcctatcaccatccagtcactgaacttcttgcctagctaggtgtgtgctatctgcttgtctgttttggccctcttagctgacctccctagatgggatatctggactatgtgatctgtgttttttgccaggctcctttctatgtaattatacttttggtcctggctgttagacagctgcttcccagggtctgatatgacatgaaagaatgaataagtaatgtggaaagcaggtctcacaaatgaggagagggagcttgcacaaaaatgtaaacaaaatactggggaagaaggaaaaacaaaaggaatgaaaaaaagaatggcatattatggcgcttaagcataatactctctgagagtgactccggcctaaaaagaacataagaagctggagatgaagcaagatggatgaatagatgcctccacccattgtcctccccgcaggaacaccgaattgaacaataatccacacaaaaagacatctttgtaagaactaaaaatcaggtgagcaatcacagtccctggtttcaacttcatgtaactgaaagaggcactgaagagggtggaaagacagtcttgaatcaccaacaccactcctccccatcccctggcaggtgcgttgtgtggagaatccacactcttgggagggggaaagtgcagtgactgtgggactcttcactggaactcagtgctgcactgtcacagcggaaagtaacacgaggcagaactcagctggtgcccacagagggagcatttagaccggccttagccagagggaaatcacccatcccagtggtcagaatctgagttcctgcaagccttgtgggctaatgtggtctggggttctatataaacttgaaaggcagtctgggcctcaaggactgcaactcttgggcaagtcctgggactgtgctaggcttggagccagtcgactgtaggggcatgtgagctactgagacaccagctggggtggccaatggagtgcgtacatcaccctcccccaaccccaggaccaatgcctttcactcattcaacaaatgtttgttaggtatctcctgtgtgccaggcactgttctaggcactggtgatgtaagcgtgagcaaaaccaaacaccctgtcttcatgttgtttaaatgtccagaaacgtggcagtgttctacaatagtgaacatgagggtgagcccagaagatcctagaatatggatctctcatagctttgcgagggactgtgtttcttccacttgaggagaggagagggaagagtaaagaagactttgtcttgcaacttagatacctgctcagccacagtaggaacaggcagcaggcagagtcctaaggcccccttgctaggccctagctcccagaaaacatttcaagatatacccgggatgatactgaagggaaccccctgtcttaaaggggctaggaacccagtcctggccagattaatcaccttctgactgaagagcctctgggacctgaaaatgcagcagcagtacccaggcagtacttgccataggccttaggtgagactcaaggatgtactagcttcaggtgtgacccagcacattcccagctgtggtggccatggggagggacatctgcttgagaaaaggagacggaagagtaaaggggactttgtcttgcagcctaagtaacaggttggccacagtggggtagagcaccaaatgggcttttagggtcattgattccaggccttgggtctaaaatgccatttctggacctgccctgggccagaggggagccaactgcgctcgagtcctagccctggcagcattcaccacaagctgactaaagagccagtgggccctgagtgaacacctgtggtagccaggcagtacttgtcatgggcctagggcagtggtggtcatgggaagagactccttggtttgtggaaaggggaggtaagagtgggaaggactctgtctagtagcttgggtgccagctcagccacagtagaagagagcaccaggcagattcctaaggcttctgactccaggccctggctcctggatggcatctctggacctgactgaggatgggggaaactcaccatcctgagggaaaggacacaagcccggctggcttcgccacctgctgaccgtagagcgcttcatgtgtttattaccgatatttgttttctattctttagaatgccttcttacgtctttcccctttttctattatattgttgtcttcgtattagtccatagaagattattatatatacatggtgctaatatttgttggctgtatgtaataccaatgtctttttttgggttgtattttggcttttaattttctctagggtgtccattgatgaatagaagctcctaattttcaaggaatgttaatgctttttgcatctgatttaaggatcctttctcttctcttccctcaggtcaagaaggactttttaaaaagtttattattactgttatataaaaatgcaattaacattattatattgatcttatatccagtcaccttgtaaaactttcctattatttctagtaactgtctacacattcttttgggttttctatgaacatatcataatatctacacccccccaccaaaccaaaagcaagtgaatttaaaaaaaagtttttaaacccaacacaaaaattcttgagccccaaaaataaataaaaaagacagaagatagaaaaacagaaacatcaaaaatgaacaagcttagtgtctttctgaaaagtttaaaagaagaataagataacataagttgaaagaagaggatgataaaaataacaaaagttaataaaatggggtggtggtagaggggcacgatacaataggttcagccaagttaaaagttggtttctggaaaagacaaaattggcaaaccactaggaagtcttaaaaaaagagaaatgataaataatattattaataaaaaggacaaataactacagatacaatagagactaaaacgataagcaaacccaatcaggtggtttatgtcaataaacatgaaaacttagacaaaagggatatattcccatataatttataaaatttatcagaattgatagtgcaataaagcctgagagtattataactagtaatgaaataaactagtaataaactattaataaaagtcactaaccatctgcctacaaacaaaacatcaaaccctgatatattaacaaattttctcacaaattcaagggctaaatcattctaacttatacaacttataaagaactgaaaaatagggaatatttcccattcattttatgagatcagtattattttgacatcaaagtacacgacaaagtacaagaaaataatgtcgctgacacatttcaactcatttattaaaatggttaataaaaaataaaatttgttaataaatcaatatagatacagaaatcttaaatatgacattagctgactaaacggatcattatttacaaaaaatatcatagctatatagggtttatctcaaggatgtaagactggtttaatttttaaaatatataagtatctttcatttaaggcattaaaggcaaaaaccatatgatcatcccaaaagatgcatatgtaacttctgataaaattcaacatgactacgtgattctaaaaaaacccttcttagttaaggaggcttaaagacaacttccacaacctgattaagttaatctaccccaaaacaaaactaaaaacaaaacagttacaacaaacgtcatcatcctgaatggagaaacactggaagtattccctttaaatatcaacaacaatcaagaatgtctatcaccaccaatttaactcaacattgattatagattcttttagaagcacatatccctttcatagaatctcacatacaaaccttcctcttaaaggcaactcttaaaacagatgttcttaaacctaaggcactgtgttctgaaaaggtagaacactcttcccaccccaaagccattatccagtttcttttaaaaaatactgctcagaagcatagcacatttgagcagtcaatttaaagaagcgggggaaaaagggaaagtataatttgacatagttagttgtaaatccaggagtattatccaggctaaatatcatctcaccctgggaccaaggaattaagctcattttgctctttcatcttcaacaaatgcagaacttaaagagctgttttagcccataatttcattcatcttatgatccaactggtattatactgaataacatttgtaatttgactgtattatgtgagtgaactttgcactcccaggagaaccaaagagatattttatggcactgaagtgacaatttttttaaaaaaaagatccgtctttttaacatttgagaaaggtactagaaatattgtttcgcttatgctttgttctgaaaatccagctaagtttcgaatgaagagaatgatttatttcaggaccaatgtctttcactcattcgataaatgtttgttaggtacctcctgcgtgccgggcactgttctaggcactagtgacataagcatgagcaaaaacactctgtcctcatgttgtttaaatgtccagaaatatggtagtgttctacaatagtaaatatgagggtgaacccaggaaatcctagaatatggatcccctatccatcccatgtgctttccctttctctccaaaagctttccattactgtcttgaaggtaaaagaaaaatgtctgggttgattgccttccaggctttggtcactgcatcacaccagagctacacctcactgagcctttcttgggaaatttatttataataataacatagccagcatcaaaagggcacctttcaaaaaggcatgtggcatatgctgtctgattaaaatcctgcaattaggtattatcgtcatttggtgggtgagaatccgaggcacagaaaggctcagtgatccaacattatagaaattaattcaagtttctttgactccaaaacctttttgaacattttctagtatatctggttgcctcattcattcattcaccttctcatcaaatactgagttacgtatcaaaggaattctgaatttcatgttattcttctgagtatgagtatagtctttatccataatccataaatatcctattttccccagctgtgtaatactgtgcaacccagacagaccctccttttccctccctcaccacagagaatggtatagaaaaactcaattaggccaaataaggataggataaggggcactcctccttcccttcctccctccctgcctcccttccttccttctccattgagcttacattccactagggggatggtagacaggataaattctaagctcttttccaacataaaggctctagcttattagaaatggggagaataagcagaaataaagaggcaagtattttggtgttgtggttgtatagcgaaggctgcaggacagactcaggtttacaaatctaggcttgttcatcacctgtgctctgggctgctcctctactcacctctcaaattcactggcacacacagatcacacccactgccagttggtaccacatttgtattatcaattaccctcacagaactgtatgacctctgttctgctaaccagctgtagggaaacactggcagtcagaggatgtcaccactctcttctcaccctctcttcattccctgatttgctcacttgcccctcagagaaatcctcttcccctttatgcccacccaaacctgattcttcaagactcacctcaagcccccttcaggaagatactttggctacctcataccttttgcttagaactatgttgggattcaggcctggcggggtggctcactcctgtaatcccagcactttgggaggccaaggggggcggatcatgaggtcaggagattgggaccatcctggctaacacagtgaaaccccgtctttactaaaaatacaaaaaaattagccgggtgtagaggcgggcacctgtagtcccagctactcaggaggctgaggcaggagaatggcgtgaacccggaaggcggagcttgcagtgagcagagattgtgccactgcactccagcctgggcaacagagtgagattctgtctcaaaaaaagaaaggaaaaaaaaagaactatgttgggattcaatctcagcagtcacagtccattcattcacccagcatttcagtagggattcagtaagcacttaccatgtgccaaggattcagtatgaaacaccatgatctctggtgttaagggataagcagcagagaacaagagcaatttgatggtcagggtgaaaccaaggtgttatgggatcacagaggaggggcacacacccagatccagatcaacagtacaactgctgggaattgattccatagatatccacagaagacaagttaagtgaatgatggtacagccacacaatgtagctggaacaaagaacaagggagacagtgcactgacatggaatgatctccaggatatattaagtgggagaaagcaaaacaaaacaagatgcaggatagtgtacacagtgtgctcccttttgcgtaagaaatgtgcattttttgctttgttcaatgaaagactggaaagatgaacaaaaaaaaaaatcaataaaaatggttacctatatggggctagggacacagagatggaggagagaattctatgttcaaaacgacaaagtcaaattttgaaaatgatatctgagaaaaactttgagaagctctccacgtagcagagactgctgaatactgaagcatgaagactcacttcctagtcactacagcatttgttcacagagtgacaaaacatcaagcctggcagtatctggaggaagatatctcttcccaaagaagggagggaagacatgtgctgaagatcaccaagtaagttatggtccaagaagacacatgccttctccaagatgggtatttaggtccttccacacatctcaaagatttcatgggacactgtggtgcaatgaatgctgttggcatagcttccaggttttgcctaaaatatattgatcctgtggccttgccttctgaataatcctaataaaactcaggaagacaccaggagatatccgggaaagaaacattacagaataaaaagggacaaagtgacatattacatcataagacagaaagggccaaacaaaaaaaaaaagagctcttattttaaggtgaaaaagttgagagtagaagaagaaacattctgtatgatgcttgtggggggttcataaatagagaagcaagctgactggggaaagctggaaaccaaccactaacctctctgcctgcacaagatccagagccagcttggccaatggaagggatgctatctccttttctaattaaattccttaaagagtgtgttgatttattcatttataataaaatcctgttctaattaaaattgaaacttctccccacctgatccagcctcaccatatttctggtttccatgtaattgaatttgaaaacaatgatgctgagtgatagcttgggatattgctgcttattgtgaaagtaaataataaaaaaggagaatgctgctaggcttgttttgggaaggcttaatcagtcctttctcccttagactgaattttaaccacagttgaagataatatgatatttcccttaatgaaattgtatatccgtggctaatttatgagggaagtttacctttctggggctttagcttcacattattttagtcaatagtttttaaggtccctgggttcccctctctccctctgacatcctcaaccttcaattccagaaattgttctgcgtatcagtccatttaatacataatactcagatttattagaattcttcagattggaagctttgccacatctaatgtcatatctgaaacacccatgagaaagaggcaaggtgggcattatgtggttgatgcgactaatgctcagaaaggctgacatgatttatctaggatcaaaaagtcacttaatggccaggcacagtggctcatgcctgtaatcccagcactttgggaagccgaggctggcggatcacctgaggttgggagtttgagaccagcctgaccaacatggagaaaccccatctctactaaaaatacaaaattagccgggcatggtggcgcatgcctctaatcccagctgggaggctgaggcaggagaatcgcttgaacccgggaggcagaggttgcagtgagccgagatcatgccactgcactccagtctgggtgacagagtgagaatccatctcaaaaaaaaaaaaaaaaaatcagttaatgacacagccagcgctgaaacccaggtatgtaagctcccagttatgggcatttctaacatacccagccaaagggctcatggctttgggtttctaggttcttggaggttcacagaggagcccactgtgtaattcgctgagtaatacttgacatttgtcctggtttttcccaagctcatctccttggttgtatagtaagtgtatatctctaggtttctgattagttaaggaggagcagttgggatgcaagaaggtttgaaatggtctctctcttgatccttaaaagtcagagaaaaagcaattagaatatatctgttcttcttcccccgatacctgaaaagactgcaccttgctttttcctcttgcacatgataatagttacttctacaaagattcttcctgaataccgagccctttcttttccccacctaccccacttcttcaagaaagttccttctactgaccccagtattttcattctgcagatgattgttaatcttccgtgtctggtgtaaccattcagttggaagagttctggcaaggggctctttctaaatgtctctatgtgctttcgagccaaatataaaactctaaggtctccaaggaaacccaaacacctgttgactacattttttttctccatttttttcatctaattgcaatttacctacttcactagagcaacgtgaggattaactgtccttgggtaactttcaagtctgtaaaggatttctgcctcctcagggcacatgttctctaagagagacagagccgaaatactaataagagacttaatgtgtagcagcctcgaataatctgtgctctgtgttaccacttcagacagtcagtgtctccctaacacagtctgacaaagacaccgtggagggatcaacagccaagtctgaaagtcccagacaggagcatggacttccctttcaaagcccttgggaggaagtgatattaaccaccaaattaggtagctggaccagggcctggtgcacctgctgggcaggcgggggtgtctgcctgctgtcatattttggcacaaacatttgacagcttctccctcccaatgaacatttctaatacccaaaggttaatcttttcttggcttcttcttgtcactactgacattttgtacccattatctccctgtggttgggggctgtcctgtgcattgtaaggtgtttagcctcatcccttgactctgcacagcagattagtatccccttccctctctgagctgtgacaattcaaaatgtctccagacatttgctgaatgtcacctgggggatggagaggcacaattgcactggtgagacgatccattttaaatgcctgatgtattactcagattatgagtaaacctctacaaaaaagccatcctcaaacatgctcatggggctgcagaaatgtcagttgtcttggaaaccactcttctcccatcccctagcaagttagatttaattctgctcccccaacatgaagtggaggagacacacaaattttcacaagtgaagcagcatctgatttggtgtttatttatttagcaccattgcctagttccgttgcctagttttctttcagccctggcggccaaagcctgctaatttgcacagcattaagtatcctttgctcccctcacctattccacttcaaccaaggatttgtcttttgctttgaaattccactgtgcaagctcctttttaaaagtgttgggctgcaacacatttgaacttgaggggggtaacactgggggttcggtggtaatgggagggaatgtccatcaaagggtgacaaactctggggggcatctcttccctcaaaatgtctcattagggtccccaggcttggtctccatctctgctgtagcctgcagtccaatttaattgagcaacggccttgctacggcacactgctctttcgacaggagggtaaactcattctgtccatcatgacatttgctttcttaagggcctcccaatatgcaacttaaataattaaatgcaagtcacatcacagcctcccttttcaagcctgtctgagggcacagtgggttctttctgatagttagcttttgaccatgtgatttttagaagctggctgggttttttgtttgttttgttattgtttatgacacttctcctcactaaaacccccaaaactcagcatagtgcacacccaatgtgcatagctaaaagggctgtggattttctgatgttggatgaatagtgactaagagaaatttgagacccctggttctggcaagggtctcagagcagcctgcttgtcatggtcagtacttttcatttgtcatccaggaaagtgtaatgctgggagacaaatcccttgtgtcccactgcgcatgtccatccacttcgagctgggatgggcctgttaaaaataaagcaaacctttaaaatgatctaaaaagagagaagttccaggaaggactaaagataactcttacctgtagtgtccactttaaacaatagatttctctggggcaacttggagtgattataacgagtttggatttcgttgaacccaatgctgattttgcatattacagagatttgtcatctttaagtaatgtgccagatgaatgctttaaaatagatgcaactttgtgtgaattttctataatatagcaagatctgattgctctattaatagccaaagtccttggccttgagaaggcaggatggcagcgtttttaaaattcatcatctctgcataattagttatgaatctctaaatatccaagctgaggaattaaccaggaactagagctgttatccctcagcgtcccttttaatattgttccatagtcatcatttccttgtgtttttctaattactgcaaaaccaattgtttttaactcaacttccctggctctttgtaatttgttgaatgtaatcaccttcaagtgaagaaaatgcacttcttgtttgggaaattggggcttgatcagctgagtatcatcaagcggctgggggacgccagtgccaaagctttgcatattttacctgaccattgcattttgagggtatgaggctggagagggcatgctggaaactgagccctttgttgtggtgatctatagaccctactgggattttatttggagatgtacataattttataaaaaccaaaaagaactaggaattctggttccttactctgagtggccaacaatacggcactaggcactagaaaacaatggttttgggtactggattaccttctctctcagacttgtttcagtctgtatgtctgattataagcacctagggcagggctgtgccattgaaccttccctactccttagtgtctagcagtgacctggacacagtagaagctgaacaaaccaaataaactagtgtagaagtcaagtctctctcttgctttcactctttcccaatcttctatcctctagcactagaatgtgctacccatctactacccagttctacttgaagatcctcaaagaacagatattggaagagcgaaagttttcaacctttacttctctctttcataacgggtgtgatgcacactcatcagttaagagtggttctctgtgacagtaattcccaatttgggacagagactatgagaatcaagccaggaggcacgggactatttagacaaagcaaaacaaaacaaaacaaaaggattctgatatgcctgcaacagcctccatgaagtttcatcattgaagagtaaactaaaagtctatatccttgagaaaaaattggacaaatggattcatcatttttctctagcagtgtcctcaaagaagaagaaaggtccttattgtatttctccctgcaggtagccatgctgggtctttctttctctggacaaggaaatgtatgcataaggggctacacaagaccatagtcaatgcagtgagatggctgcatttttatttgacacacatttattaaatacctaggatatgccatgtcccctgctaagttcagagcatgaatgaccagcaattttggcactaatgagggagttgaatgtgcaaacaaacaggtaaaatatcaagtggaaatgaaagagatacagggtcttacaggggaacagacaaggagtagtaactggactttgggcgtggctgatgaaggggcatcctgaagacttcctgctgggggtaaagtctgaactgaaccttaaagatgaagcaggggttaaatgaaaggttagagaagaagggtgttagtacaaaagccattccagggaggccagaccatataagcaaaagcatggaagcctccaacagcattgtgtgttcaggacatgcataaacaaggtataaagtacaagccaggaaatgaaaaaaagtgaagctggagaagcaagaccgaggtgggctttgtgagccttgtaagaggaggtgattggatttaaaaaaaaaattttaagtaaaacaaaatttaaaatgtgtcatttaaaatattttaaactttattttgtgcaagaaatattattttaacagcaaaaggacaactgggacctctccttgctcttgaagttgttttcaaaaccactctactgaggtataattgacagacaaaaagctgaacatatttaacgtgtaccttggtgattttggagagatacatgtacctaggagagtggactgtgtgggtgatggacaaccctcgaaaagttcccagcaaaggaacagcatgacaggctttggcatttcagggagggcacttcggtggcagtgaggatgatgcatttaaggggcacgagactggcagcaaattgacagggtctagggacaaagggaggcagcaggctgcgtgagtcagatgggggccaaggccgaggcagtgctggggtgagtgggacagaggcagacctgaaaagcctctaagaggggaggcagcatgccttgggatggccagagcatggacgatgagagcgggagagtccagggcgactccttgcttcatagtttgtactcctacaaggatggcgagacattcagtgaagacagagaacctgggaggcagagcagatttctagaggaaaaaagagaggtttccatttggatgtttcctcttggggtgtctggcagggctggtgattggtgacacacagccaggtagatgaaacagaagcttgggagagctggatttactagaattgttattttactttttaccagcaaggtccattgggtccaggtgagactcccctttctcccttcatccggagattgggaccacactaggtcttccccacttcctacaactggcttgctcgctccttcacctttacactgttgtcccccgcacatgccttctctgaggacttgcctgctggaaaagggcaggaatgtttgtcatgcccaacttggcaaattagagtgggtagctctgtgaacaaaaccacaacattacttctgtctactacttcacccactgggccacctatccagctcctaaatcctgctccccccactgactctgctaacaactagactttctaaacatttttcagagtgaagctaaagaaatcaaccttgaaagaaaagtcgtgtatttatttcagtgtgttatgaacccagaggcagggttttagaaagtagacttctttggccacattcagtgtgttgcaaacaaagcaagtgggcccccaaaaccagggaatgtggggccacagcccactctgttttgaagggtgggttccaagtcatgctgtgaccagcagggtgagcagctagggaaggagccagggccaatgggagtgggtggtgggagggcacaggagacaggcagcagcctctgtaagcttcctagaagctatggaggaccgactgccactatcaaatgtcctctcctgcctaagggaaattccagggaaccggcccggcacagtggctcaccctgtaatcccagcactttgggaggccaaggcaggaggatcacctaaggtcacgagttcgagaccagcctggccaacataatgaaactccatctctaccaaaaaaatacaaaaattagctgagtgtggtgggaggcacctgtaatctcagctactcaggaggctgaagcaggagaactgcttgaacccaggaggtggaagttgcagtgagccaagatcgtgccactgcactccatccagcctaggtacacagtgagactccatctcaaaaaaaaaaaaaatgctgtgcacagtagctcatgcctgtattcccagcactttgggaggctgaggtgggcagatcacgaggtcaggagttcaagaccagcctagccaatatggtgaaaccccgtctctactaaaaatacaaaaattagccagacgtggcggtgggtgcctgtaatcccagctactcgggaggctgaggcaggagaatcgcttcaacccaagagacggaggttgcaatgagctgagatcatgccactgcactccagcctgggtgacagaacaagactccgtcttggaaaacaaaagaaaagaaaaaaagaaatttcagggaaccaaggagaaagggtgtgtttgaaaagggcagctatcttggcaaacatccaataaggcttcacgatctattggtgaattccatcctgcaggttggggacctctattaagagccttgttatttcaaaagggactccaggggtgggacggccaatctccttttcacaggcacgtgcgacgaaagcaaggaaacactgactcacggggaataaaatctccaccagacactcaaggcacgtcctcctgttattgtctttctcctgtttctattttctttttatacaacctttgccaacatttagaaagttaatggtgctgcatccatcctttaatgccccttcctagggttattggaagccagcacacacccacagccatgccagctgtctgcatagaacattttcccttcctggcagcattgccacagctggggctgacctgtggctgtcagggtgtgcgaggacagatctctggcaacacatcctcttttaaaggcaggtcgcagacaccttggtggagggaaagactgtcttgctgtttgtgctgcttctaggacctcaccaccttctcccaagaagctaaagcaatagaataaaatagagatgttccttttcaaagaggggtttgctctggttggaggaaataggatgagcaaagtgagttgacagagaaaaatattcaggctgggactcacttcattttgcagaaggatttaaaaacaacttcaagcagtaaatttactgttcatcatgaggtcatccaaagccacaacctaatgcggattcttgattgccttgcgcaactcatgtagacaggcatatgatgctgaaacatgggccctaaggtaagtgccctcatacccaggtactctctcatgtggagtcagtgaatttgttttaaatcttgtctcctttttcaggacacttagaccatcctccccctccattcctacttctcctgtctacactggaaccccactggcagaggaaggggtaggacagaactgaagattgcttgccactttttagtaacaagcaacagacagaatcatgagtctcctccttgacataccttcctcacttggcttctaagacgccatgctccccagccctcctcttccttcacagggtcttcctcttctctgtgactgagataaggcaggaggacctagtcttctcttgggctacactccctcccttcctcatcacatttggacacacagcttcaaatgcggttgatgtgctgatgacactcaaatttacatgagccccagactctcctagcctcccacctacccaccacttccacttgcaggcttaatgggcccccaaatctagcatgtccacgcagaactcccatttcacttggcagaaggcaagggcaaatccagcctttctaagagccaaagcttggagtcatccttgaccctacgttttttccagtataccagtgaattgtattatgttttttgttgttgttgtttttgttttgagacggcgtcttgctgtgtcacccaggctgtactgcagtggtgcaaccatggctcactgtagcctcaaattccagggctcaagcaagcctcccaccttcctctcccgagtagctggaaccacaggtatgtgccaccacatccactacacctgtcttatttaaaaaaaaaatttgtaaagacaggttctcactatgttgcccatgctggtctccaactcctggcctcaagttattctcttgccttaccgtcccgaagtgctgggattacaggcatgagccaccatgcctggcctgagccaggtggtatttttttttttttttttttttttgagacagagtcttgctctgtcgtccaggctggagtgcagtggcatgatctcggctcactgcaacctccacctcccaggttcatgccattctcctgcctcagagtagctgagactacaggcctcccaagtagctgggactacaggcgcctgtcaccacgccaggctaatttttgtatttttagtagagacggggtttcaccgtgttagcctggttggtctcgaactcctgaccttgtgatctacccggctcggcctcccaaagtgctgggattacaggcgtgagccaccgcgcccggccattaggtggtatttttaattagatttggaatccgactgttctcactccctgtgttgtacgagccacatgtgactatatttacattaaaattaattaaaatttcaaataaaagagaaaagaaggaatggcccaaatgagaactcttaggaaaactggagcacaaattaaattttaaaaattcagtctcttacttgcactggctgcgtttcaggtgcttaacagccatgtgtacagacatagagcatttccatcgttgagggaggtcacttagccagtgctggtcactgtgtggagtgcaaccaccctggtccaagctatcaacatctcttgcctggatgcctgtaacagtctcttagttgatcctgcttcttcagttttctcaatacagcagccagacgcatcctttttaaactttgcacgtcatgccactcctgggctttaagtcatccaaattccctctcagaggagtggttagtcctcagaaaggcatacagggttctagggttctggccccttctcatttggcctcatccatcaggttgctctctctgcagcaacatgcgagcctcctgctactcctgggctccagagcttgctctgcctcaagtctaccacattggccattccctctactgggagtgcccttcctggctcactcactctcctgcttcagctctctctgctcaaaagtcgctttcttggtgaggctccttctgactattccacttcaatttcaacttctcctccaactgccagcactctcactctccccttctctgcctgactttgtcttttctgtagcactcatctcccatgaacgaactatatacatttacttgtttatgatatctattgtttactatctggaagggatctttgtccatttactcactgctggaaaactggctcagaggaagctttcaacaaatacttactcaataatgaatggagaacgttcgagagctgaaaggggccctggaaaccattcttgggtgtgtggctgagggttggtgaggtgaggctattccctgaggactcacaatgagctcaagggaacagcatggattaggagccggcatcatcctaggcatcttcattgggcgagctccatgacaatgaactccccttccccttcatctatcacagtcagagggacaccaatgaaccacaaagagccaacagggacaacaaccaactaaaacatcaggggtattcaccattttcttcttggtaaaccttcgcatgattcaaccaccaatcctacctctctgataacttataagaagcaagggacaaagtggtgattcagattaatgagctcttcttacatgctactctaaccctccctcccccaacgcaaataccaagattctctgaaaactggaaatacacatggctactagattatgttttttccctaaacatatcaaacttgttttaaaaaaataaaattatggtttcattacatagtttataaattagtattttagaaaaaagttgattagtaggaaaagaatagctttccattgcatcattacaatatttctgacaatccagaatgaattagaagaaaagcagagcccagatcacattttgtgttagggatttgtctgttctcttgtatctgaaaggaagtaccatctgaatagacatagttttaaatgtctagagataatgacttttctactgccaattctggctcaaagacaaagatggtgagggagcttcaacctcacaaacagacctgttcataatggcacagctaacaggtccagggctacacagcatgacgttagcagagagcctggaaaactccatccacagctcactggatgatttaacttgccagagtatataattaagaacagttatctttatagtcattccttcattattgagataactcaattggaggctgttttagacatgctggattcagaaataaaatccttacagactgcactgcaatgtcatgaagattacaccagaaaacaaatggatgtgcatagacaatcttctgtatgtaccagaaaattagatctcaggagagacatgaagaaaaaacataaaatcaaagagggtgggggccgagcacagtgaaaggtataatcagcggcttcccagagagaggaacctgcagggccagcaagttcgctggttgttacctggggcagcgctcttcagtgctttcactaactgtccccttccagctccaaaaccattatctccatagtccaggtcactgtcactattactgccaccgctggcagagtacgtacacattctgggtgccttgtcctaaatgagtaatatgagactgttaagataattcatacaaatcaaaatgaggcagagcatcctgtgaggatgcgacacagttcacatctggctgtcaatgtgtgcacagaattccattcccactgcccagcccgccgctcacccgagagcaactctggtttgccggtttttctgcctcctgaggagctgatgctgtctactcaattaccagagctgcagaaataggcctgcaataatgaagctgtcgacggcactctgccgttgtcccaggctcaggaaggtccccacggttacctggtctgcattttgtacacttctttatagggtcttatttttctcaagtgcctattatgagctgctgttccaaacctaatggcttatttatttaactgatctcatcattgccttccaagtatcagaaggtaataaaacaatcaaccttgggaacaaaagaataaatgtttgcctaatttataattttctttcagctcccaaaaggacagtagcttttagaaaagtaagcaattgctgactccatgtaatcctcaaatctgctgacagttcatgggctgaggagcccagtttcccctcttgctcacatgtacacatcacctgaccccatcccctaaggatgtcactggtgtggcaatgatgctgtattcagaaattgctgaggcggttgacgctgtatgaacagtattcccctctgtgcacataagcagaatactggatccaggagcgcaactcctatgtgttgaatcgaggttatttggggcccttttttctgtttgtagaatgtcctgttagagcctattattcctccctaagccagatagttccaatacagatgcattagatgggtctctgaagtttgtttagaagggtgtcatttggttggggaatgtaaaaacacattttaggatgtaaactcgcttatctggggttataaattcaagcactcatttcctttactctttcattcatttacttagtcacccatccattcaacagtgtttactaagtaactactctgtgctaagcagtatgctaggttttaggggtggagagcttaatactggagataccagtagtctagcaaggactaagtccatgaagaaagacaagtctactgactgtagttctgggtaacgtgtgtccagacctccaaaaggacccagtccagtctggacatgatgaggtacatcctttcatagctccattcaacaaatgctaactgaaccaggcatcgtgccaggtactagaaatataaagctaattcctgcttgaaacgttccctatctggcagtcaacaaagcagggttctgagtttcaaggatttccagtgcatggggctagtgcaggacgatgaggaagggaatcctagagaagtgtgtccattggtggatgtatgtcttatgtgaggagtgcaggtcccctctgggtcagcaagagtaactttttttttcctttttacgttcttggaattattcaaactcctttgccatcaacaccaactgttgttcctgaactggttttctgctctccaattctgtgtgtctgtcatgattttctaaattttacagctctcaattttctcaatttgccagtttcccaatcctcccaaagccagcacagagtcctttggaacagtggcagcaatgctctgtgcaaagtgtgttccatggatcagcagcatcagcatcacctggggatttgttagaaatgtgtacaccttactccgtatatgccaaatcagacacaagtctatgtgggcaacaagattgtagcccttcaggtggttctgatgcctgctccggtttgggaggcactgatctggaggagccctaacattctgtgtttgacttaaggcatggcagaacacagcagtttcctcctttgcctctcagacccacgtcttgtggaggcagccatcccaggtgctgccctggacttcagagggcccagttccagtctcggctctacagcaactttccccgggaccctgaacatggtccagcaggactctagtgttccccactggaaattgaggctgtgggcccagaggatctgctcccctacttgtccatggtccccttccatactgaggcagatgctcaaggttgaaaggtggtttggccacactgagtgagggagacctcagatgtgggtgaatctgggtatctcatcatcatagttgggcagaaactttagtaaaaatagcaaccaaggctcttgataccagacctgggaaagccaagggcagcaaaagtgggaagggccaaggaggggccaggaagttctggaaaatgaaccatgtgtcttcctcctcctttctcaccaccaggcaccagggcagatgctgcagtgggccaccccaggacgagtggtgaaatggcaaataggctgaccatggtcagagtaacctgctggaaacggtaaacaggagggggtaccacataacccccactaggaatgagcaaggagtccctgagccagacacccatagccacccatagccacccatcaggagttccgtgtgtgtcatctcagggcagatgaagaacccactgcaaaaatgaaactcagggctcacggattctagcaagtcatttgaccacaccgagcatctgattagccatccttaaaagcaatagaattagatctgctttccctgtttcataagaacaaagtaaaggttaaaataactactgagatactgaaaaaatagaaaaaacatcattccaatggcgcccacatggcttgggagagtgaatgcttgtcccacaatatctaatcaggggagtgcatccatacccaagaatctgggtgcatttcagaagcactttgatttcttcagaataaaagtgtcccaagaacccacagtattccttaataaggcaggggaaagggtgaaccctagaccttggtttatattcagtaaaccaacagcaaatttcatttaaagtgaaatctatcataaaagtgtttttagggtacactttttagaatcaggaccaacaggtggattgcacccttcacctcccccgacccctcacctgggtcccggtggcagcaacttcactcccccagtctggaagcggctggcttgccattgggtcttcagcatatccgaatgatgagcatgtctgaggccttggctctgcttcattctgcttttgggaactgacttttcctaaatgaggacacgtatgtggaatcacatatcacctttcatcaacattttacaagtttagggaaggaggtgggggagacattcagaaataataaaaaaggtccaaatacagtgaaagctgggcttcctgccactctgtcccactgtagtctgtgctgcccaaaacatctgcttaattatgtatacacatctatagaagccccttttcaagaccccgaggcaaactgttcttagactacttttctacaaaatgttgaaagactacaggttaggaagggttcagcaggcaaaccattcaggaaacactaaagttattcttcaaataatgttattcatccaacaacaatcaagtttcttttttggaggacttctcagaggcttcagtgtgccaatgggcattagcgtagtttccgaagagaggatttgaatttgcaggcttcctcaaacatagggaaccccgattttcctaaaatacgtattaaggttattttgaatagtgtggattgggaagctttgcttggagcccttaaacatctctcagggcagtacttttcaagctttaatgtacatatggatcagctgagcttttgttcatgtgcatgctgattcagtaggtatggggtgggctctgagagtctgcagttctgacaagctcccaggtgatgctgatgatgctggcccatggaccacattgagtagcaagggtgtaattagcagagaacaattaaagagagtttccccactacccatgaaagtagattaacctgcatagtgtatgcctttgtcatgccagaatggagaattgctgtcattatcctccaacctcagtgattataagcaagacatgctgtgacagcctctccagagcattttgtttgtgaggggaagctaagaactgtgttttcatcagcactgtgagttttgtatagtgacttccatttttcatatggggataagaaaaataaccaattcaaatgtacacatttgaattggcagtgactgctcaaaaaggagctataatctcattttctttttgttccagctagtcctcattccctaatttttaacatgcataaccgatggacacagaaaagagaagcactggaaagtaggccctgcctctggaccacagatattatgtcaggacaggaaagttcaggatgggtgacaaaaatttcctgcagtgtgttcacctcacactctaccatatactacctttttacaactcttcactgtaatttaattaagatagaacccaaagccaggtgcggtggctcatgactgtaatcccagcactttgggaggccaaggcaggcggatcacctgaggtcaggagttcaagaacagcctggccaacatggcgaaaccccatctctactaaaaatacaaaaaattagccaggtatggtggcacatgactgtaattccagctactcaggaggctgaggcaagagactcagctgaatccaggaagtggaggttgcagagagccaggattgcaccattgcactccagcctgggcgacggagtgagactccatctcaaaacaaaaacaaaaacaaaaaagacagaaccttagatacctggtgcagtggatattagcagcaacatctgaaaaatctccttctgatcccttatgaagcaattcaagacttgcggtttctattcaatttgttataatgacagtgtttaatcacggagtctacagcagccgccgctgaattgaggtcacatatgtgactattcaggcatggagtacacaacctataactaagatttcgcccctgaatctctggaggctgtgtcattaattaacaacacatttatctcaaaaataatatgcattacagtctttaaaaatgtagccttgacttggaatgagcagaagtttgtgacgcaacattcgtggcaatgggtattcctatataaaggaagaactcagccatgggaatagcccaatcacatttattcaaagatttataattaaaagtctccttttctaatttctcagaagcctatagcataatctccacttgcagctcctttctaatcatcaactcatacatgaaagtgttcgatttaaagttttagttcctatatttatgcatgttgtaaaagcaacataagacatacaagttaaaaattatttagtgtcatcctgggctgcaatacacatttttaatcgtgagggaacaatgaaaaactgatgacccttagcccagccctgtctttcatcatgaaatcttgtttcaattgactgccacgaaggatagtacttctcaatgggaagactcactctattctattgcaatcggtgcacgatctactgctgatttatcaaactatgtcttttatagttcaacatataaagatattttaactggataagaatacaccagaacacgtatgtttctggttagaaggcaaacaacattgtagttaaatctatatcttgggctgaaattggtctatattcagagttaagttttataggataaaacctcacaagtgtatgttgcatggcttttttcttaatcagttcatatatccatataccagtatttacatgtctgtttccttatatgtgtgtgtactgcttgatgtaatactatgagtagatattgtcttatacacattgttttgcttgttggtgaaggacatgaaggaattttcacatatctacatttttatcaggcaggtcactgacttactcatctcctggtgaaaagtttcccttttttttgtcagcaaatgtcttattaagggtgggaaattggcattttacctgaggaagctggtttggggaggcggctctgaagaggcctcatccctctggcggtcatgatggggtcggatgtggaatgaacaatggcgctatctgcagggcgctggccgtctgtggaggaaggcacttcacgttcaagggtttgggctctcatggaagaaactgcagaaagggctgactggagaggcaggagaggctcagcgtcctctggggagtctggctggcataggtagcgtcctgtcgagcgatttcccgagtctgggagtggaaaggttccgatcccactgtccaatgttctcatctggcagttggattctgagatagagagacagagagagaagggaatagagaaggctcacataaaaggataaaagaatcatggaaattggggtatgatctggaggaaaggagacacctagaagggtgaatttaagaaaaagaaaaatgtcacaaggacagaaaaccaaacaccgcttgttctcactcataggtgggaattgaacaatgagaacacttggacacagggtggggaacatcacacactggggcctgtcaaggggtggggggagggatagcattaggagatatacctaatgtaaatgtcaagttaaggggtgtagcacaccaacatggcacatgtatacatatgtaacaaacctgcacgttgtgcacatgtaccctagaatttaaagtgtaataaaaaaaaagaaaaatgataagcatttggaaccagtattagtggtgtagtaaatttccagtgaggtgcatgaagtggacctttttgaacctgaaaacatcccccttcatgtaatatgagataagaagaccagcctgttacaagcagcaatagtcgcttgtgcatatatcctggataatcagaaaaggaacagtcattagagaccaaattgtggtcacccttatttcaatctgggaatcatacaacttcaaccaattaggtgaaatttattaactgaaataatgagtaatgagaacacataaattgaagtgacgtcctaacaatggtaattgtgtatctcgtgcatgaatgatcacccattcagcagttgactaaatctctggcctcttaatttgactgtggggacaagtaattcacacgccagaagggtcatcccaaagggtacctttcccatcataacaccacttatcatgtggacttcattcgacccagctgagaagactgcgagccactttctttcactctcactttattcaatgacaaaactcatcaataacgctttggatttcttggcagtcccagggatcccactattctctagaacaaattaagatgatttcaccatgtgtgtgacatagtctgttaattgtgtgtcagctgcaaaacattttatatacggagaaaagtacagtatctgaaaaaattaccacgtcatttctggaatggtggtgtggtttatcaaggccaatgaggcagcttccaagatctggatgtcacccagaaagtctcctgttcatatgataatcctggaaggaaacttcctaggtttcatcttagaagcatcttacaagtctagcactgggtaagcggaacaacttagcactgtgttaggcatggtggggaatgtaatagattacgacataatgtttgtaccaaaagctcaacagctaccacttctttggtgctttaagaacagaggcttgtggtgtgatctccgcctatgactaattgtttcaacccctgtgcaagagctttagcctctcgaggtctaaggttccttttactgctgtgaggattaaagtatgttcatcatttaatccttagaatttagaatggcactaagcacactgtgagacagccaagtaaatgaataaagaatggcaaaatgcacaaagtatttagtatatttattacatattagtagatatctgataggtgaacagcttatccttaagtatcttttctatacaatctcacttcatactaagcaattactatccaaacttcagaatttgcccattcccctaccttcctcctcaaaacctctttgctgagtagcagaagtctgggaatttcctaatactgaggcaaaaataaagggatgggaatgtgtacagagttggcttttctaggctcaaagaggtttggtgcttggtattggaagtactaggaagatgaagtccctactcaagaggcttcaatcttcacagggatatttagtaggaaaatacagatactcttttctccactatggtgtcatttaaccatctcatatgccatgggatgtttggtcatggactccaggatatctgaatcatacagacgcaccaagagaagtgcttttctttcccaggattacaagggttttagcctcattaatttcagggcccccacctggccagctttattctcaaccagacttgcagattattcatgaccttctcttttcattttctcctcaattaagggtatttaattgttatagaatggtgtttttgagaaaggatcatctgtttgcatggggaggcactgccagatgagtcaaagaaaggacactgctattcagacttctgtgtcttttcttaattttagcctacacatacaacacttcagatttacatgtccatgtgttgtaactggggcaattctggaagactgaaatatttcagatttacaggagtaagtagatcttcatcagaaccgactcagtctttgaagatgagaatcaaagattcatgggatgtagcagctgagatgtgtcagaccctatgtaccccaggctgcctgccctaataatttaccccagcatcctcaggaccacctatccctgaatcaaagagggctcagcagggcaggacgttaggggcgctttttcttttgagaagacgcgtcatcaaaagtttggtgcttattacagctattaggagttctgctttctttgtatcatttcttcatcctcacatacctataaggcaagaactattattgccatttagaaatgaggaatcacagctaaaagaggttaagcaacttgtccaaggtcatatgctgtaaatgaaagcctggacttgaatctaggcctaactacaaagacaatgctcttagccaccaagctatactgattccccgcagaagcacaagtaaaccccaaagtgggctctgctcagttcatagccattcaggcagccacgtgagcagaagcctcacagcatggccccatggcttccaggcaaggtgcccagcttttcctctgaaattggtgctggccctggaattctagcttggttcctgggctccccattctgtggctggagtccactgtcaacatgcctggcatctagctggttgtctggtcctttgcaggatgcctatgcaaccatatctatatagttctgagaatcccaaatgcctagcaactcttccttctgccctcttggattgaatccttagacttctcgccaggattttttttagagtttactttgcctcctgatatggtttggatctgcgtccctgctacatctcatgttgaaatgtaatccccagtgttggagctggaggctggtgggaggtgtttgaatcgggggttatatccatcattcatgacttagtgccatccccttagtgacaagtgagttcacatgaaatctggttgtttaaaagtgtgtggcacctcccaccttctctcttgctcctgctcttgcatttgagacacctgctcctccttcaccttccatcatgattggaagcttcctgaggccctcaccagcagctaatgccagcaccatgcttcctatacagcctgcagaaccatgaaccagttacacctcttttcttataaattacctagcgtcaggtatttctttatagcaatgtaacaatggcctaatacacctctagcttggtgataggcagacttccaagggcaatgtttttctggctttgtctccctcttctatgtattataaggcacatagagcacttaatccagtctcctcaaatgatgattcaaaaaccgaagtaagaatcttgacagcctttttcattttggcaataggtgccataaacaaagctcatacacgtttgtctaacctataacacaaagccatcgggtagttgcaggaaataggccagaggaggaatttgggggtagaaaaaatgttgaaggtggtctaagtctggagcctttctgaagacaacaacattttctagcatcagtccccttaaattattttactttcctttcaacacccaatattgttataccagagcctataaaacaggacttttggaattcttgagttctctgattcccagagaattgcatgccctgacattaaactcataaaccattcactattaaggccatttttatttctagaaattacagatgccaaatgtagtgaatgtgaaggattcatttgtaagtacctatgaagtgaggtgtggacagtcaggggctcagacacatgccaagtttccctgcaagaaaatgtcttcagaatacataaacctttggaaatggaagtttatattgaaaatgctgacaccatctttatgtagtttctttaaggcacaattagtttcttgcagttcataaaaatattgtaacccgaattacaagtgttaagatattgtacttctgaagccagttttttttctcagagaattttaagaactcacaaaataatcaaatggttgtagtaggacccaagttcaaaggggcaagcctccctcatcttcaatgagttgatgcagtattgctctcaacaaatgtgagttcacagctgggcgcggtggctcatgcctgtaatcccagcacttggggaggccgaggtgggcgaatcaggatgtcaagagatcgagaccatcctggcccacatggtgaaaccccatctctactaaaaatacaaaaaaaaaaaaatcagttgggcatggtggcatgcacctgtagtcccagctacttgggaggctgaggcaggagaattgcctgaacctgggaggtggaggtggcagtgagccgagatcgcaccactgcactccagcctggtgacagtgagactccgtctcaaaacaaaacaaaacaagaaacaaaatgaaaaacaaaaaaaaccccacaaatgtaagttcacatttctggctgtgagtgtagttgcccacagggccttgctaagaagttcaagggttgggttgttggatgtaccaacgggcttcatccttgcaaggtcaccaattacatctctgattctggtcaaccctctcacctgttcccattgttccatgtgccttctctctgtctctcaaggtattaacaaattctcacagttaccaccaccatcaagacccaggcacctcatgggatgacttaaggcactacttcccagtccttttaaagttgtatcgcacataggaaatatacagttggttgaggaaaacaccagtccccaggacaactggtcaactgagggctgaacaagctccatctcggtacacctggaacccattcagagcagtctacagcagaatggtagagaatctcatagagaatggagtccccattctcttttactgacaccttgaatacattcccttgcatatgtttggtatgcaaggaggagaccttttcagtctcctagaagcaaatacaggactttctacaaggctctccttttgggggaagaatgttaagactgcttggggcagaaatattgtctggcaccagacttcagtaaagaggaaagttactgtgtctcagagggacataagcagccaagatgggtgtggttccttgtgggatggtggcagagaattttgaagaaacatttccactggggattttcaagttgctaccttagggtgtgtggctgaaaatccccactcatctcactaatgagtgttaccctgctgctccctactcccagctgcctccgcttctggccttagtgtcttcatttgcaaattagatcccactatcttcattataggggtgctttgaggactagaaacaaagcatgtgataagcctggcacaatgcttgcaagaggcacactgttataattcagaaaatggcaacagttctcaaaataaatgttattagactgtaagcatcgtgcaggcataactggatttgattcatctcctccattctcccatataagtggctcctgctccatgattgctcttattctacagaatggtaattatacttcccaggcgtctgactctatcaccagtgctcagcatcacacctaacacatagtcagccctcactgatgtggaatgaatgaacaggtgaatgaaaaacaataaacctttagaatggtcttcctcatcgttaatggatgtgaacctcttcttgtgaaatcacaatctgcttcttttttgctctgactttagcaaccaaagcaaacaactgactcccttttctgtagttatttttcacatgaagccagacttcattaatttagatggccacagagataagatcattcagaattcctgaatattttaatgatggatttcttagtactttaaagtccttgggacaagaatggatgaccaagacaaaggacagccaacagtaggctgttctaacatcctcctcagtccctgtgccagtacacagcatcactgggcctgaaggtcccaggtctaggaagctagtgtggcacagtaactctggctctcatcccaaggaattctagatgccaagtggaatgctgccatactgtttaacaccagcatccacagtattgtgagaactaagttcttactaaagagtcacgttcctggggccatttgtagtgaatgaatgagattactcattatatgaacttcttaatgcatttagccagaaaagtgagttgccctcttttaaagcaaatcactctgttaacttcattgactattgccttagtccatgttgcattgctataaatgggtacctaagactgaataacttataaagaaaagagatatatttcataattctgcatgatgctgacatctgctcagcttctggtaaggcctcaggtagcttttactcataatggaaggcaaggggggctggtgtgtgttacatggtgagagaggggggtgagtgccagactcttttaaacaacagctctcgtgtgaaccaatacagtgagatctcacacattacttcaaggagggcaccaagccattcataagggatccactcccatgacccaaacacccccaccaggtcccacttccaacaatgggggtcacaattcaacatgagatttggaggtgacaaatatccaaactatataaactatgcttcttccaaacttgttttataccatattcgttcacatagcaacatcatctttataaatagctgcaaagaaaaaaagttgatttccagcactatttcagttaatataaatttccaagtgagtaggatatgaattagcaatgatctgtggtgtttgggaaatgccactaatttgtttctcagccttttcttctgcagattcaagtgtctccatcttttcttacggatccaatttcacatatctgtaatggtttgaatttgtaacctcaaaactcttggtattattaacgtatctgtcaaaagagattattataggccaggtttaaggaaacctgactttagttctaagttactctgaatattcagataaatgaagtgagaagactatatgcttcagagttggaaagactgagctcaaagacctgcttggctacctgcttgctgtgggacaacaagggctttttagaactattctgacttaaatagtcatagctcattttaaataagcctggcagagtgctcattataaagcagacactcaatatatttctataaccggttgtcagggagaagtgagggcccctgtaggtacataatacatatactatcatggaatccaagggaaaccaaattgtcatttgtgcaggtagtgttacactgcagcatctgggtacactttactcaacaactaccctgcttatttcccaaggagttaccttttggcaatcatttccctgggagtcagttcatcaaaagcattaatgaatgatgaatatgcaccaatgtacttgaggtagctgcaatctgcctcatgtagagaaaacagagagtctgtgtttttgagaaatctatgttggaggcagcaccttaaaaagctttttaaaaagcctatacaaatgatgtctgctgattctcccttgtttacagacttatgacattctcaagtaatagtcccagattactacaccatgattttcagtaacttacagcacatggatcctaaaagcttatacttccttctgtgcaacgatctacccacttacagatccaaacaaattatgctagtaatcacctttttcccctctgcaaccctcattcataaatcccacaaaaatagaaaactttgaaactcaaactttttcactttgaaaacttccacacagccataaaagtttcagccaaacatacaatgaggccccaacataattcagtcagaaagagtgactcatgggtgtttaatattcataccatcttattaattggcatgcattcctataatgcaagtggtcatgtaaataagtctttgtagaaggtctctccaggttcctaaacatctttaagctacatgtggtattggcagcagaaacttaaactacagatgggaaaacagatctctttatttgcacatccttctctttatctgaatggctgaaacaagcttaaaaaaaactaagtctgttgccaaagccacatcaattaaatgttagtgatccattctaagtttaccccatggttttctccaagtagtaaaaagtgattatactggttatttattcacaaccattgggtagcttttggctgtggcattaagatgaccttctggaagggtaaattcactctgatggctttggagttcatgagaatactcagcctctaagttcaaactggattttagcttcctgagatttgaaaaccaagcaggataatataaatgtgctttccaatctcttgtgctgtctttgggataatggaagaccagactttgggagtcttgcatagggaatgagttgcataggggatgaatatttttaaaatgtaggaaattaatatgacaaacaattaaaaaagaaaaaaaaatggaccatgaaattccttagtacaaatgaagaagttatttaaaccaatataaaagaagtggcatctcaggctaagttggtatccagtgactccaatattctttgtctgacagtagcatcatgtaaattactgtggtaggatgtagtttaaggatacaaattggaaatggttagaaatgtattccaaatgcccacacagaccatgcctttatagaagtctttcttgaatttattttcatatacagctgttatagcctctgaaaaaaaactccttcatgtgcttcttcttgtcactaatactgaaatggcctcttctaaagttttgggaatggttattggtctagtattccagaatatgttatgcaattttccaaacacttctagatttttgcaagtttttataattatcgctatactcttgtcactccagactgaaaaatcttgaagtcttcacataactgcttcacgtcttgctatgctaatatgcctctcttgaaaaacaatggctacacttgtacacagtacttactgtgatacgtaagagtgggctaatgtgaccactacagtttaatggccagcatttgtttgacaaggtcatctgacttaggaactcacagttggatcccagactcctaggtcctgttttaagagttatcacttccagttcaaagtccttgtttataagagtaggacacagaactctcccaactcctcacaaagcaatgattaccacttaaccacttctgtatccatacatcaagtcttgtcctccttggtttgacatttttctaactgaaaaaaacaaacttactttaattagcaaaaccttctagagtgccaaataaatgtagaatcacaatggctccagccctgatccttaattgccatttttctaattgaagaaatgccaacttatctatccaccttttcgcactgttatccttgcccattctctaacaaaattactctatgctcaacctttttcccccaatctaattacaatttagctatctgttggtatctccttttaacccacttctgggcttgtgcgtatgcaaggcattttaaacctaaacaaatgctctttacgcattctcctttgttcacagactcattacattcccagatcacatacccaaattagtgagtcatgattttcccttacagaaggtataacatatcaatcctaaaagattatctttgcttctgtacaacaatctactcatgcccataggttcactccatctctagctgtcatgccaaaatgaagtgaaaagttaaacaattatttggtgaatctgatagacacaggtggctattatgggtggttctgtctctttaaatctcttttacttcacatcaggtttggtgaattacatggacaactgcctctattcttaatttcacctgcctggataacatctgccttgataagacacatgagggaagagagtaaagaaaataacttggggtacaatgccgcaggaagagatttaaatcagctttatttgtcaagaaacatataaaaaccaggaagcatggggaaattcagatctatcaatttagcaactgatgaaaattttattaaagatatttacaggagcattggagccagatcaccctattcattattgctctaacttttttaaattaaaaatttgaagttagatactctaagagtataaataattttagcctgcctatattactgtaattacagatatttaatcaaagtcttcagaaagataagaatttaaagttcaaaaatgtttttctccatttgtctccatatttaatcagtattaattactttttcaattatatgcagaaaagaagaaagctcaagacttcacaaccttaagcttttaaaaaatattcattttaacatgttttacttgcttctaaggattttaattattataagataatctattttagctgaatatcaaggatcatttatttttcttttatgtgactgtagttgaaatgttgacgaagggaagactgaagttgagatgagtccatctttccatttcagtggctaccctccattcaccaatatcccatggctgtctctacaggaagataataaaagaagtaatgaaatccaacagaccaggggatatggatatgggtaaaaatatatatagatttttgcttccatccatgaagaattaaattgttacagaaacacatgtgcacatgcacacacacacacacacaattgcagtgttttctgacattgaaagataagcacagaatttgatctctgaatcaaggaaaacaaatgaagtgagccctacagttactccagccaactgcctggagatggtttctagactgaaacatagatggaatacaaacatagcctggaggtaaatataggtgttaaaggggacagatatgaggatcaaggcagctaaaatttgcagggcagatgtatattaaagaatggagaacactagaaatagtaatatatgatctatatatatattttgtttattgtgaggtttctaacatatatagaagtaaaatatataacagcacaaaggatgggagaggttatatgaaaatagcctgtaacatattatgtaaaatagattatgataaagtaacaatgtaataaaattacatttaaatgttaaaccactcactaaaacaggaaaatagagaggtatagctaataagttacaagaggaaataaagcagaatcaataaaaacattcaagtcaaaaaggtagaaaaggaggaaaatagaaagatgagacaatcagaaaataaataattatatggtagatttaaatccaaccatttagataattacataaaattaaaatagtctaaacactccaatgaataggctgagattgtcagattggataaaataaaaattggtatacaaaatatacctatttatatgctgtagataaaacattcattttaaatataaaaaacagataggtgaaaagtgggacagaaaaatatatagcatgcaaactctaataaaaagaaagctagagtcactatgctaatatcagaaaatgtaaactttagaaaggaaatattaccagggatcagaagaaatatgttatagttataacaaggtaaatttatcaagacattataatcctaaatatgtatatctataacaatagaactccaaaattatgaagcagaaaactgacagaacttaaaagagaaaatgtcagatctaaaattaaaatgaaaagtcttctctcagtaattaatacaacaagtagagagactatcacaaggcatagaagatctgaacaatataatttaaaactttgaccaatgtgaattgtgcagcacactctacccatcaagggcagaatgcatattctttttgggtacacatggattaagatagaccatatccttcattataaaagaagtcttagaaaatttaaaatcaccgaagccatggaaaatatgttctctgagcatcagagaattaaaagagaagtcaatagaagaaagatgtctagaaaaatttccaaacatttacaacttatacagtacactactaaatttcctgtgtattaaatggaaaataatattttgaaatgaatgaaaatacaatggaatgcagctaaacagtgccttaacaaaaatgtacagcacaaataagacaggcttaaaataagtgctctgagacttcattttaagaaactagaaaaataagaacatattaaacataaactaagcagaagacataaaaatgagagctgaaattaagaaaattaaaaaaaaaaacaatttaaaaatcaatgaaacaaagagctggttattttacatgactgatccaactgacaaacctccaactagattgaggaaacactgactaaaggagaaaagacaaaaattctcaatattatgaatgaataaggaggcatcactacagatcttccagtgaataacagataatatgtatgtatgaacaaacttaagccaacacattttacaattcagataaaatggaaatattttttgagaaatccaactaccagaactcactcaagaaaaaagataaaccaaatagtcctatatcaatttaggcaattgaatttggaattaaaaatattttcatgaaatattataggcctagatgtcttcactattgaattcttcagaatttataaggatgaaaaaaatgatcatttctttataaactcctttagaaaacaggagaagagcaaacactttccacatcattttataatgaccatattaccttgatatcaaactcaaagacatcatacatagaggaaaaatagagatcaatataactcatgaaaatggatgcaagaatgtttaataattgatttgctattaagcatttttgcataattaagcaaattactcaccaagtggcatttacccaaggaatgtaaaatttgtttagcatttaaaaataaatcaatattaaaagaaaaaccatatgattatctcaaaatacatagaaaaaatcatttaacaaaattcaacatcctttcatgacagacaaaaaaaaaacagacacagcaaactaggaatagaagagaactttctcactctgtacaagtgtaaaagggcatctacagaaaacctacagataacaccatatttgaaaaaaatagactgaatgttcccccactaagactgagagcatgttaagaatgttagctcttaccacttccatttaacattatagtggaggttatagccagtgcaacaaggtaaggaaaagaaataaaaggcatagagattagaaagaataaagtataactgtctttatttgaagacaatataattgtgtatgtagaatactctaagggatctcccaaaacactatgagaactaataagtggtttagcaaggttacatcatacaaggataatttagcaaaatcaattgtattagtatgtattataaataattggtaattaaacaatactatttctaacagcatcaaaatatgaaaaaaacacatcttataaaatggtgaaaccttgtacactaagaagtacaaaacattgtagagataaatttaaagaatactgacataaatggagagatctgccatattcatggatcagaagactcaaaattgttcggatatcaattctcttcaaattgatctacagattcaatgacattttaatcaaaacactatcaggtttttttttaaaaaaagacgttgacacattgattctaaaattatgtgaaaatggaaacattttcataaagtaaaacaaggtcagaggtctgacactgcctgaattctttataaggctacgttcattaagagagtgtggtattgggtaaggatttgcacataggtcagtggaacagaacagacattccggaaatagactcacacatatattttcaattgatttctgacaaagatgacaatgtaatttaacggaagaaagatagtgtttcaacaaaaggtattaaaaacaataaatactcatctgaagaaaagtaaacccttttctcacactgtatataaaaattaacacataaacccaaacacaagatctaataccacaaaacatccagaagaaaatatcggagtatctctgtggccttggattaggcatcaatttcttaaatagagcaagaaaacatgaaccataaaataaaagcatgataaattagatttaatcaaaattaaaaattttgtcttcaaagacacggttaagaaaataaaacgcaagcaacatatacccatcatgcaacacagctataatactcttactgttatatgtccccccaaagacttatacacaaatgtttatagcagctttacacataatagccccaaccggaaactatcaaattgtttatcagccagtggataaacaaattgtggtacattcatacaacaaaatactaatgggcaataaaaacataaacaaactaaaaaaccactgatacaacatggatgaccctcaaaagcattatgcttattaagagaggccaaacccccaatattatgtattttatcattgattccatttacatgaaattctagcaaaggcaaaactacactgatataaagcagaccagtggttccctgggagcagtggtattaggagagggtggggtgtaaaaggcgtgaaggagtattttggggtgatgaaagtgttgtaaatcttgattgtgatagtggttatacaactgtatacatttacaaaaacttactgaactatacacttcaaaaggatgaattttgttatatataaattatacctccatgaacctgcttttaaacattttatactcagcctgccaaaaaaaaaaaacaaaacaaagaaaaccaaaactgaaatcaaacagtgaactctggttgaacacagatgagcaaaggaactgtgctttccccagggtacacgcttgaataatcattagaggcatctgaaagtggtgttggcaagaaagcatcttcaagaatcaccagggaacaagactgatgctattccttaatcccagatctatgcaggtcacaaagggctttgtgaactcctttatcttttcaataatcgtgggaaatagctattattatcttcattttatgggggaggaaagcagaactctgagaagtgaaatggtcacttgaagaagtgccggcctgactctgaagctcaggatcttcttattcatcaacctctttccagtagggtggggatccctggtttccatagctgtgtgccccagacactcctctgcagagagggcatctaaggagcagagcctctgattcaggaccttacaggtagctgatatatgctctgtgcaaatgcatttgaccttcattacacctcacctttctgcagcataacaacatttgttgattatttactactgggcaggtgcttcacttgtattatgtcattatgcaatgtgtaatggacacatttttcctatgaggaaactgaagtttaaggaggtcaataacttgcccgtaggcctatagctataagtaggaaaaccaggatttggattggggcctgtgcaaacctcaaagcttcaggcttgattgctacatggttatagtaccttcttctgtattcagtttaccaagcattctgaatcagtaaggatgctcttggtggaaagtaacatgttaaatggtgaagaatggtattagctcacagtgcagaattagaacaagcttcagggctgccttaatccagggcctccgcctctatttgcctgcagttctcttcactgtgtccctgctatgtatcagttttatcttcaagctgttatcaggaggttttagtagctccatactagtcagccacacactcccatgtctaagggagagagaagttgactctctgtgtgcctttctctatacctccaaccacctgtcccttgaaaattaggcaaataaggtcataaactcattcccagacaaatttgtatctcttggaaaatgctgttcactgactggcccaggcctgaatttctgaaccaatcactggcagggaagattgccatgaccgccttcatcaggcttcactcctggagtggaaatgtctgctacattctttctgagtcattacttcagttgagtttatggcaacactttttctataaatggagtaattatttccattcttcagataaaacaaatgcatagagaacattatctcttagggacatgagcacatatgcagaagccggaattcaaagccaggtcttctaacaccaagtccagagctctttgcgctgctctgcaacaactatacccgtaccctactctccctgtttcaaagaaattccattatgttgctaggatatatttatattctagttccctcctttggtatttatttatttttctaattcaattactactcccttatggactctagtgaaccatttaaaaccaagtcaggatacttttttttttttgagacggattctcactctgtcactcaggctggagtgcaatggcgtgatcttggttcactgcaacctccgtctcctgggttcaagcaattctcctgtctcagcctcccaagtagctgggactacagttgcatgccaccacacccagctaatttttgtatttttagtagagatggggtttcagggtcttgaactcctgacctcaggtgatccacccctacggactcccaaagttgctgggattacaggcatgagccatcatgcccagccgaagtcgagactttttgtcagcacttcctttctaatgaggttttatagctattatttaaaataaatacatagtctgatataatttaaaacctatttggtgtgatatagttttttcttttttttcttcagtttcattttctttcttactttggagacagtgtcttgctctgttgcccaggctggagtgtagtggtactgtatctccactcactacaaccttcacctcccagactcaagccatcctcccacgtcagcctcctcagtagctggggctacaggtgcaagccaccatgcctggctaatttttgtattttttgtagagacaggattttgtcatattgcccaggctggtctcgaactcctgggctcaagccatccacccgccttggcctcccaaagtgctgggattacaggtgctgcacccaaccgaatctcacttcctaaaagaaaatctccagttgaaaaagatggtccttttaaaattatttttccacatttaccatcaacgcactaccaagccgtatccccaggccctttggctcgtcctacctgtattcactctctgtaacagacctaatgagaagaggttctggtctttggtctttgaaagcaagagtgttataaaggtagcatttttttttttacttaaaatacatataagacaaaatacatgggggaaaaaaaaccttcaaatgtctgcttagccacgcaggacagtgtttcaactagagttctgataggaacggaaatggttaactggctggcagatgactgtgacttcagtatctagcagagccctggaggctagtataaaggagtcccttgcactttgggctcactttacatttaaactatgatgccatgagcctcaccaccttttatcctcccaacaatcatgctccgagtaagggaaggcaaaaatcagtatatccagcttacagatacagaaactgacgcaaaggtttgtttagttaataagcggcaaaactataactgaaacttacgtatggttgtttcaggatcatttctgtttagggtgcattatcttgatttctgaaaagctagggaagttgtatgaaagatgtcaaggctcaggagtaagtttagcacctctgaccctgcattttaagtttgaaacatgcaaagttgttgtctttttttgtgttcaggaagcgtaaggaagacttgacagaaaatttgatgagaagatgcaacaatcattttgacataaggccaatatataaaaattcaaaagatggtatcaagaatatgtgttggtatcatcaagggtaactgccataacttggccttccaatagaatgagatcattatatgtcaaataatattgaatgtgcttttgtttctttagaaaatgcgtattttatggagacaagaagaaagagatgaaaaggcattgaagaagcttctcatttttccaaatgtgaagacttgggagtacagtcttgggggtgctcctaaaataaagagctgagttatagcatgggaaaagatcataataggagggtaaccatggtgaggagaaggcatgggagctgaacagaatagtgatgctggaggccacattagaaatatctagtgctaagcatgaacattttgtttgtgagcagagtttctaggaagtagaaaggaaaactacagtgagtaccattgctgaaggtgggattaagcagaaagccagggcagctaagagagcttcaggataaaaggctgaaaatgtctctgcaagctcaagcaagtcacaggacacttagggagcccaagcacacttggaaagaattaaggatagagccaaatgaggaggatgaggcagactgagcaggtctccctgtggggtcctgaggattgcagcagaacagaacatgctagggcttcaaaggtttgtgacagctacatctgcttaaatgtgcaggggaaggagaaacttcactctgaaagacacagctcagcccatttatttgtttcagaagaagtcctcttagcttcttgttatagtctcatgttgaaatttgatccccagtgaaatctgtcttggtgggaggcgtttggatcataggggtggatccctcatgaatagcttggtgccattctcacaggagggagtgggttctcacctttagttcctgagagagatttccctctatcccccaaaagctggttgttaaaaagagcctggcacctcttcctctcttctttcttctcttgccatgtggtgcctgcttccctttgccttccagcatgagtggaggcttcctgaggtctcaacagaagcagacactggcaccatgcttgtacggcctgcagaaccacaagccaaataaacctgttttcttcgataaattacccagcacagcctcaggtattcctttatatccatcacaaatggactgagatacttgtattccatatgcctgcagaactctattccagaagccaagtttattatctatgcttgtaaatataaactcactaatgggtatggtttattgtggagcaatgcacatgcctacagcctgttctcctatttcaaggcctccatcatcctgggacacttcattcaacttagcagggttccattgctggtcccaatatctgtctggattaaaagatccctgtgcaattactgaagtgaaagcaggtccctgcatgtgtctctagggtgttgctttctcaggcaggggttggtgaaaagtggggatttttcacaccgtgcatagtggattgcctttctacctggcagtttcataccaccatccaatacaacttagatgtacaaaggaagacctagtgcaaattcagcacagcagcctgcccactgtggaatctggacacactggttcaagggggaaaagaccatttcatctgagttccctggcagaccagtcttcttgtagaacagggcaatgtgtaaaatgcagtgcattaattgtcatcctctattctgtccagtcagcacaattatctacaagaagagcaactctcactgattttagcaggagcatctgatgcatccctgaagtcatcattttttgcccatagagaaagtttgctctaaaacccaaatttctctaataggtacccataactgcatactgaataaatatgccatttgcaggcatgcaggttttaggggccttgggcccttcccccgtgcacaggcctctggcatctttggttcccttacggtgaggggaacaaacatctctgcagaaggcatactcctctgtgaggaagttcacatcttacagacatcaaaatgagttttgaattcagactcagtctaaaaagtaaaagcattgagctttgttccacatgaactcagagggctaaacggaaaggcttttaataaagcctcttcactagggcccctgtaccactgttttacataaaggatgatgattcaggctggctggtgtctgaatcttggcatctgtagtctctacccaccccctgcccagtttgtagaataagtttattggcttagttttctttggcctggatgaagcaaacatggaaagatgacagcaattcaacttcctctagttgatattctaattatcctgttaaaatctaattatatgccattgcgtaagtcagggttctccagagaaacagaaccaatagaagatgtgtgtataaaataaagaattggctcacatgataccaaagcggacaattcccaagatcttcagggtaagccagcaagctggagacccaggagagccgatttgttattctagtgcaaaggcccagcaagctcaagacccatgaagagctgatgtttcagttcaagcacaaagacaggaaaaagaaatgtcccagttgaaaggtagtcaggcaggaaaaataattccctcttacttgggagaggattagcctttttgttctacttgggccttcaactgattggataaggcccaccacataagaaggcaccatctgatttactcagtttaccaatttaaaagttaatctcatccaaacacacctttatgaaaacacccaggatcatgtttgaccaaatatctgggcacccgatggcccagtcaacatatgaaattaaccatcacagtacttaaggagatagcgtttgtggcacacagcaatgattaaagagccaaaatgaagggagaacattttctaattcaaacacaatttttatacctccttcgaataaacacatgatgaaagatggcttatttaagataaagtcaagaaagccaccttgctactaatcccccacctcaagcttgaagagacattattattacttagaaatgaatctggtgtttcaaaatggctttcccaatatgtttctgatgtaaactcctcaaatcttatggaaatggtctgagaacaattctaaatccatttcccagatgaggcaaaggaggctcagggggtggagagggaaagtagcttgtctagggtcatactctttggaaaacaaatgtgcctgcatttttaagaactcaggagaatgcctttaatgccccctctccccacattcttattatatggtgtaccttccacctgtagaaatgatggacatcctggttgattaaagagttgactcagcagcagggagaaagcaagggttttgagggaatgtttttcaaggggggacttcagcaggtgtgccctcattgaggtagcccatttctagacatttggccctggctctggatcctgggagattccttgatatttgggtggcatgcagggcactgtgggtgacccatccccttccacggggctttactacttgagcatgtccaactgccggcagccatatctctttgcccaaaggtaacagctccagaagcagctcaggaataatcagtgatgggaggtggagatggatacccagctccctcattcctcaggtgagaaaactcttgagactcgcattctatactccagcatttcccacaggctaagctaaagttgtagccaggctgaagacatgtgtctgtggcatgcacagttaaacagggctttgtgacctgctgctgctgtcttgaaattctaacagcttttgagcaagatattctgcattttattttgcaaattatgtatctggtcctggtggtagctggcacgataacatgtttttattggctggtttctcttctctgtctgacttcccctatcgatctttcctgtacttgctgataacttacttgcccttgaatttttgttacagcaagtacttctggaagaccccaaactagactgttgtaaatgtcattataatcctgaataacactgtaaataatcaaacaaagccacctactatttattcaagcaagacaataatgcacatgggttgactagtcacccaaaatagtcatgtttatatcttctgtcattaccatacctcattttaatatccaaggggtttattaggaagtaataaccaactaagcttcccaactcctctgcactgcagaccaaatgctcaggggaatccaacatgcaaatcactccctgaagaagtagggcaataaacagcagcagagttgacatttcaacaatggctctgcatgccatctgttttaaagaaattatttgtctttgccagcatgtcaagaagagtaagttcacataatttgggaactactaaggcacgtaaattcttgattatttacaatgacaggattatctatagacatcaagtctttttggtaatgtccaaagaatgtttttaaaaaacaggccagggaaatatgaactttttgtagagtccaatattgaggcaagatattagagtgattcagtcttcaactaaagtttcagaaaatgatgtaaagaagaattctagttcagaatcagattggataagctcatcaaatggaaagcccatgtattctccatttttatagccctagggttcagcacaatgcctggaatgaagtcaatgcctaataaatatttagtaactgaagtgaacttggtttatggctgtgccttgaggtttgagtaccagaaaatgaaactgactcactcctacctgtggagcagctagcatttttcccattagctccttcttactggctggaacctaactattgggcaaagccccaggccatgaggacaatctgggaggaagaggatgaaggcactgaatgggtagcaagttgaagtgagatattgcatgtgcctggtggttgtggtttaggcacctgtagtaagagggcatcccctgcttgagagttggctggagaaacagaaggtcatcttaggcctttctcatcatgtgtgaggctcatggccaggaacttttaagactaagttcatccatccttaaggcagtctattcgtcaatatgaaccctgttaccaactcatggtgaattacgggcaaggcacaatgcttttttatgccatgacttctgcatcattcagaaagattatatctagctacttttacctcagacaaccctttttaataataactataggccgggcatggtggctcgtgcctgtaatcccagcactttggaaggccaaggcgggcagatcatgaggtcaagagttcaagaccagcctgaccaacatggtgaaaccccgtctcaactaaaaatacaaaaattagctgggcatggtggcgcgcgcctgtaatcccagctactcaggaggctaaggcaggagaatcgcttgaacctgggaggtggagggtgtgcagtgagccgagatcgtgccgctacactccagcctgggtgacagagcgagattctgtctcagaaaaaaaaatgctaaatggcaaaataataataataataataataataataactataataataatgaagatcgatgcttgagttcctgctagcacctggaatggtatcaaacactcagatgcaaaagcacatttaatgctctccataatgctttaactatcattagtagtattatctccatttggcagatgaggaattggggctcaaagaggttcaggaacttgctcagttccttggcaaagggagaactggaggaggcctgtgtgaccatagcacccaggctgtgagactgttgcaggaatcaatgaaaacacactcaaaaatgcaaaacttgaggcaaatacatgctggtaacattaccaacaaggtctaagttctgtccagaaatagctggataagctttgcaaattttctagtgtacttaggtccgatgactgaaacattgtctccccacagagccttaggaaatgggaacttgaaaagggcagacattatgaagttcaggtagtacacctacctccctcaaaaagttgcagaaacttgggccagggaaaagcattagagtgtatctagaataacctctctctgtggttgaggagagttagacacgcagagagacagagatgaagcattttgacagaacccaaaactatgcttttgattcctccctgccccaccaccaacattcattaccatattaccctgtctctccaacagttttaaatctccttagaaaaacctgactcaattaaaacccagaaaataagttcttttaaaaaaaaatttaggttgtataggaaagggactgatttatttaaacatgttttgaagcagaattatagataaatactttgagaccaggaaaacattttgactgggtcaatggtgaggggaaatgacatctttggaaatgcgacacattcatttggaagcagggcggccaatgcccactccaaatatgttcttgtacacttaggattccttccaaatggcctctgaaggtagaactcaggcctgagttttcaaatgggcagaaactcactttaaaatatatttcccctctgtttgggagctgacacaatggagttacaggcagagacggtttatcaccacggcatgaaagtctctcttcaaattcctccagcttttataatcaaacaataacatcgccagagtataggttttagctacataagaaacatattggaaattgattcaatgctcctggcttggctgtaacaatgtttcataacctagtaacctctcagcttgctcttcccccttcctgaaaagctttcagctgcaagaaagtggcaaagcaaagataaagaaaacatcatccttttatctgatcctgtgcaaaatgagtggagcagacactgtaccagcgataagatgattgctaaatgactcttctcacattctatcgatgggctgatgaaagaaattaagactgacattgataagttatttttccagacactaccgttttcaaaaaatgaggatttctctttagaagcagtaagccttggttgcatgtctatgactcattaaaaagtacccagatcagctctaccttgtaacagattaactggaaacatacatagttttcctttccctatatcccattttctatttctctggcacatcctctttgaattcattcaagccaagaacaccctgttctcaagatccctttcctacctacttttctcagtcacacatttcattaaacaactcaattttcatctccacaatttgccacagtcctcacccaatttatcattctagcattttacatctctctcaagctaatgtatttctcaaacatgccagatttaatggacatatcattgggaatccaggtgaaactgtggattaaagaaactggtgactaacaggaattcttgatgttgttttccaggatggcagataaggaaacagcttgttgaaatccccttggcttgctaaatggcaaaacgggctgaaactgtttggaaccaatatagctgactagaatctgcacagaatagacttgcttgctggatgagtgaccttttgacatcatagctggaatttccaccatatgtttcagaccaactccccctgcatttgcacatgtgactcatgaagaggcatgaagagacaactgcatacaccctagggattttacaaacttccccctttcctccaccaaatcactcgccaatcccgaaatcctcctcccaaaatttctcccctcagtatactgcttttaggctggcatgggagatagatttgagttagcctcctgtctcctcattcggttgctttgcagtaaacctttctctgcaagagactggtgctgtgatgttgggctttcctttgtgtgggggcaaatgaaccctatttggtttggtcgcactggtggaatgagtgtgtggatcattttcatggctgcggtttttcattaagtacctgtgactgagttcttacaatagggacagtgacttccaagctagattatagggtttttgtaaatctacaagtcatttgttgccagcctttttaaaaaataaatacatgaatcactgctgcttttcagtcgctgattttttattcccttcaggcataagaaatcctagttttcacagcacctaaaccacagacagttcaacctatctataatgtctagtaaactcggaatcatctgtgggagaacagaggaaaaaagatgagaattcaagggttgcccacaacctctgtttttagctcctcctctgacacctgatatgcttcagaatgataacctgaaactttatagttgtgttagggacatgtccctttctttccctctctctctcctcttggcatctctcttgtgatgccaaagagctgctccaaaggtagacaggaagaggactgggatgggggatgaatggcacagatcagacgagcaaaccaaaggcaggctgatgtggcacatagacgtgttgcgttttgttttggatggtgtttttaacttaaaaaaattacaaaatacacttcaaatacaagaatgcatattatcaaattattaaatttaaatcatcagcataacccatcctaacaactttaaccatgtttttaaattactcatgtgctcctctctgattacatccttcaatcaccactacccgttgataaagtaactatcttgttaatttcatgttattcattaatttgctgtttgttccttcttaccatattgtttagttttgctcactaaacaaatagaatcatcctgtaagtgttctgctacaattggcttttttttttccaatcaacattgcttttcaaatgaatctatcatggtacttgcagctgaagttcattaattttcactgctgtatagtattccatagtataggtatttcaaaatttgtctgtcctttccactgtcaatgaacatttgggttattttctaatttttgctatgatgacaatgttaccacaatcactgtgctatatatttcctgatatacttgttaagggtttttctagggccatgcctttcaaactttttagactactatccacagtaatacattattttttatatcataaaccagtacacctttgtatgtgtaccgatttataaatgtgaccaaaatgtcacaatatttttccttaatacttgtatgacactccaatattttcactgggaaaaaagaaataaaaacaaaacaaaagcaaatgccaaacttaactcccaaatcgatttcatgactcacagatgagtacagttcaaaaagtctttgtttaaaatatatttttttctgttattaatacagctataccaggtttcttttctttaagattgtgtggtatttatttttctgtccttttactttcaattttcctgtgttgatgtttagatttattatatctaaacagctatatagctgcttgataatctttgccttttaactagagattttagtctatgtacatttattacaaatcctctatgttcagatttctaccttttattttatgctttctagttgtccagcttttctgtatttttcttttttttcatgttttcttttggtttgtgtttctcctccttactatttaactttccccctactttttctactagatgggaaattttatattttatttctacccttaaatttgttaacctagaatttttcacatgcaaatataacttaccaaactaatatattaatcattttccttaacaatataaggacattacttgcttaatgcctcttcccactcatttccagttctattattgctcaggatttatttctcctttgacatatttagtaatgtacttttattgttatatagagagtgtttaccactttctctacttaacagttcttgcatttcagatcttcctgagatcattcttctcctgtctgatgtaaactctctagaaattggtttaatgaggatctactggtagaaaatttattattatttttttctagccttggaaaatgtctttgttcttgaagcatagtttcactgagtattcacttctaggccaataattattttgtctcagatacaaattatatcttcaagcacactgaagatataattctaatgttttctggttttcattgttttcagaaagaagttcactgacattttaattgtcagcccttactaggtaatctgtattatattctatattggataattctcagttctgcagtctttggaggactcattctgtgtattattgcttttttctgactctcactaatgagtcattttttccccctcatggtttcattgagtttctattgtgagttaattttacctggaacttcatttgtaagtaaagtttagagtgagtgccttgagagaggatttgagatgggttctgccagattccaaggagtactgttaacctgagtctgcattgttttttaacttttcattatggaaaatgtcaaatgtactcaaacagtgtaatatatcctcatatacctattgcccaaatcttagaaaatactaaccttctgccattcttattacatcagttccctctttcagtttcttctctggagtattagaaacacaactgggacccttttgtaatttgaagctgggggatttatgggacacaaaaagagtgaattaggtccctgagccacatgagtgcaaactaatgattcacaatcttcagaggaaacattttcctcctcttttttccccctcttttttccccagctattgttaagacagcgttaaggctgagtcaggaatttattcccaaaatcttcctctacaggtcagctttgaagttactgccctttggagtccagctttatgccggggaggggcttgtgagtctttgatctaacatttcaccctagtcaggcccttggctttcattatgtcaacaatttagctccttaaaaccaggttctgggtagggtgaatggtggggatttgaggaacgttaaagaacatggtttacaaagtctgaagagtttcccaggatatgagacttccggtgttgaaaccaagaaagtcccagcacactgggaccactggtcaccctagctccaggccactagagactagcgcatgccccatgggcaaatgctggctagggcattctcttgctcctatggattctggctttcttgctgttcctagcctgtgatgaattctttgcctgcagctcagccatacctttaagaaaatacgtataattttatattatatcctatactttagtagatgtggcattctgtgagaggattttgaaattctaatttggcatattgccagataaaagaaagtccctgaagattcattcttttgaactgagcccacatttaaacatatatcatatgtcacataagaaatctaggattttggcttctggtgaaaaatgggaagacttgctacatagggctagcattcttctatgctgacaactggagctgcttccctagaacaggtcatgttccctatatacctcaaatccccatcatcactcatgtaatatatgcatgtacatgtcaagcccagcctgcaccactcattgacctgggagctttttttgagtttgtaactcctggccaagcatctacaaaagggacccttggactctggtgcctgagaggtgatccaagaaacatctggtcatcatttagaattcttggggggttatttaactttatttcacagctacagagtatagtcttggtttggatgatgattccactccatcctcgtcacgctgctgagcaaggcagtagctttgagaacatccatttcctcatcttcaaatagcgaccatcacacttaacttgcagggctgatgtgaggacaaaacaaggcaacttacataaaacacccaggccagtgcccagcatatagagagctcttaataaggagtagatagtaatgtaatatgcatgattgtcttactttattcataattttctgtcacattggacagctttcaggtttttgcgctgaggcatactgctatctgactttgttttgaccctcacctactccttactatgccataagttacaaacacaggcttatacttactttaagtgacttaactgccttttgggaagttgaaggaactgcacaaaatcgggtctctgtatagctagttcagtttccccaactttgtactttagagcaataggccttggaaatgggtggggaaagggcaaaacttacttaatatgtctcactgttgcctgttcagtggggcctttccccttcaggtacctgggttaattcacgccacctcgtagggctgcaggtctgcctctggctctggcagctcagcttcccgatctgtagcacattactcttctctttcttaaacatcaaatccttccttctaccacttctcagttccatggcaagaaaagataccagccccatggctcattcttttagggtctgggggtactaatctgagaaacacacggctgctatcagccagtgatgctcactgtgtgcctttccggagatcacctgtatcataacaaaccactggggactttcactcaaaggaattgccagtgggtgggaaattcagacatattctggtaggctggtatgagagctttttttggtagggagtcctttggcaatccttaaatattcttggttgtctatcctttcatatgaatacatgattctatttatcacagcacaccattgatcagggaagagtgtttcatgaggaggaaggtgactggtgcgtttggttggcttaaagataagtgagagaaaatgaagaagtattttactgtaaaagtctaaatatgagcatcatagtgatcaaaagtgacgtcttaacacataggtcttgttttgaaaatctccatagtctatatattgtctgtagggctaagttcaaatatctaagctcggctttcaaggtctctaccatctggtcccatcctacaaatccaactgtatctgcatcttctcctgtgctctagctaaactggtctttgcagactcccctaccctccagtgtgccatgcgccttccaatctctagacctttgctcatgtggtttctcttgacttcaaggacatctttccttttctgatgagattctatcccttaggacactctgctgcacatcagaatcacctgcggatcttcaagaactacaaatgctgggcttccatccccagacactgtcatttaattaatatggggtgtgattttggtatcagtatttttagaggcttcccaggtgattctgatgtactgcaaagtttgggaaacattggactaaatggcaaatgctcttaaacttcactgtattacttacttgcacttgcctttttccgacagacaaaagccaatgctcccagttccactaaagcggggctctgcactctgctctgtgccatcagatgtatatagaacacacgtttctcttatcagtgatcacaatgcatttgaattgtctatttgcttctctgcatccttgctagactggagttcacagagggcagatactatgtcttattcctctttgtatgccccgaagctgatacagggcatagtttgcagacaatgctcgatataggcttgttgaactaaatagaatttagctccctggtgcaatcgataggagtaaacattttacaggagtgaaaaaaatattttacaggagtgaaaaagccatacttttaacactgtaagtccataattctctctctagtgaaaaaacagaggaaaggagtcatagactaggattcagtatgctcataaatacagaaacatccaccaaagctttatttggtgattgtccctgctggtgagaagaaagcactcacaaggagcaagctgacagtaaaaccagagaaccagccaggagggaatgaaaaacatggagggtgatatgtaattttataagcacagggcttgggttgtagtaggcagtcaatgaataaatatgaatattattattttcagtccttggtcagaagatatcacatggtcctgttttcatgggcctaacttcatgacaaacagagtttacatttcaggttgcctttgctggttgcaatctctcccttttgagtttatcacttatagttagttataagtgggtgaactcagtgcagccacagtggacatttccttgcccaagctactaatctacagtacctcttaaatgttattttgtatgtctgaaaatgcagaagtaaaattatcctggcaagtattactacaggatctgaaccatacaaaatcacaccatcctattccccatccaaccataggcatgattatctaagtagtttggtgccagtctgatagtagccaataaaacagtatctatcaaagttattgagaacatttgcacttcccacccacattttgttttgattatcaatagctcttcctgcctacaattaagcctaaatgtgttagcacactattcaaaatgtgacattcgacttaagcagccttccgctcaaaaagctgtgacaatctggtcaactttctaagatacacttttattttaaatatgaatgccatttcttctacattaaatttctaaattttcttcaaatcttcttggtgaggaaattggtaatattcttgaaatgagacagataattatcgggactttaattgattggcagctacagtactagaagacctaatgtcctatttaattttagggaaaagataattctagatgcattgtattccacaaaatatttatttgaacatctacgtagcttgttggtgaccaattacgtatttattcatacatatggtagtggcaaattaatccaagttcaacatattttctcaaaaagttactcaaggttaactgcacatagagcagtgatcgttcaaattatgcaaaataggaactatgcataaatcactgaaatcaattacatcttttctaacaactcttcaaatttgttttcctatggatttctttctttctttttttttttttttttttttgagacggagtttcgctctgtccctaggctggaatgcagtgagtggcatgatctcggcttactgcaatctctgcctccggggttgaagtgattctcctgtctcagcctgccaagtagctgtgactacaggcgcgtggcaccacgcgcagctaatttttgtatttttggtagagatggggtttcatcatgttggccaggatggtctccatctcttgaccttgtgacctgcccgcctcagcacaggcatgagccaccgtgcccggcctttcctatgcatttcttaaatgatagtaagaatttgcatgtgttctcttagcacagatcaactgaagttagaaggagataaccttggtagggggctggctgcaggctgagatgctagatgtccctaatacccattaactccttctttcagagttaagagaacctctattttttgctggacatatggctaccttcctcaaataatgtttcctatcctatgtgaccaagcactggccaatgggatgttagcagaaaggatggggcaactgctaggaagtgttcttaaaacgataagccatgtccttcatcatcctcccactttttggaaagtggacataaggggtggtttttcaacaatcatcctagaccatgaggtaacttcgggaatgaaaatcatgaggaatgtaggctgggcacggtggcttacgcctgtaatcccggcactttgggaggccaaagtgggtggatcacgaggtaaggagatcaaaaccatcctagccaacatggtgaaaccccgtctctactaaaaatataaaaattagctgggcatggtggtgcgtgtctgcaatcccagctactcgggaggctgaggcaggagaattgcttgaaccagggtgttggaggttgcagtgagctgagatcgcaccactaccctccagcctggcgaaacagtgagattctgtctcaaaaaaaaaaaaaaaaaaaaaaaaaaagagaaaatcataaggaatgtaaaccatatgaggcagaaggacaagataggagagtctggcactgctctattagcttggaccacctccctctgggctttcatgtgtgacagcaagaaatttctattcttatttaaaccatggcactttacagtttcttctagtcccatctgaaccttattctactggtagtaatggttagaaaaatccagtcgtggatttaaaaatcaatgtggtttggagaattcagatggttggatccacatatggataactaccactagacatgttctattagggctttgatacaatgaagcaggtcccagagttcctttcattttgataagcacctagatcttgggtcttgttctctatagaagtgaagcacttgattcaagagcctttgagatcttcccctctttcctgaccaaagaaacaaccacagccatcaacattctggcattgggccaggcattctctcctctgctgggtgaagaagctgctctatttgctgactttcatttgactgtggtgtagagattccttgataataacaactgtacatcatatgactattttattctttctgtctctacctaactgcagatgggcacattaccactgtggattagatactttatggttggatgataaacgcttataagaacaacgtctgtgttaccagaatggccattatacatgatgctccaaacctcctctgtttggcttaacatagctttgtctcaattcctagccttaatgcaggctacttttcaaaagtagggttctaccacaaaacaactcttttttccccggcaatgattcttgtgcagttcactgaagtaggcttgatcctgtcttttcttccgcaacccaaatttgctcaaaccagtaccaagtgtcccaaacttatagatcccaagagttcttattcttctttttttctttttttttcttttttgagacagagctttgctcttgttgcccaggctggagtgcaatggtgcaatctcggctcaccgcaacctccgcctcccagattcaagcgactctcctgcctcagcttccagagtacctggaattacaggcatgcaccaccacgcctggctaattttgtatttttagtagagatggggtttctccctgttggtcaggctggtctcgaactcctgaccttaggttatccacccgccttggcctcctagtgctgggattacaggcgtgagccaccgcgcctggcctgagtttttcttaactatgaataaaactttgcctgagttcttgttacaatacaaatatgtggccgaaaaaggtacctgtataatccgtaactacacagatgtgagttggtttaccacattagctagctaaagtctaggagaggataaggaataaagaaatgaaacaccctggaaaaatggaaatatactggtttatggtgttaagttactcaaaggtatttactgagcacctattgtccctctgcatgatacattagctgcagacaggagagccccctccggggaagaatggaggaaggacaatagattggggtggcaggatgctttggaggcagtatcagtttctcaagtagggagaagagcacctcacagacaacttctcagagctatccaaggaaagttagagcatcagggttagaccatgtcctctgtcatgctacagtctggcagtaggaacacttctggctcctgcagaagagactaggagtacacccagacaatgggggagggtaattagctctcattgaaccagggggcactgtggcctatgccctttagactactgggaagatcgttgttttcaactcttttaagttggtggtaaataacatgtatctttcacttcatgaacacctaccacacaatcctaataggattcaattttttgtgtgaatcctattgggttctgcttcaataatattcttccccaaattcctcgaaggacattttctcctctttataagattttacaaatcccctgtttccttgtagggaattaatttttattatcactggctgatgtttccagtacaagacaatgaatggtatttgaattcctactaattgttaactctagtagacaattagtacaatacatagggtaaatgcattatagttagatagcaggaaagaataattagaaatacagcatttgtgatcgttggtgttaatacttctattaagctaggctagccatttgctttgtttagtctgacatttatgggggcaattttaaagaaaaaaatgcagttgctttattttacttaagcatgaatcttcaatttcaatatagagcaggtttagttaataatatcttttttttttttttttttttgagacggagtctcgctctgtcacccaggctggagtgcagtggcgcgatctcggctcaccacaagctccgcctcccaggttcacgccattctcctgcctcagcctcccgagtagctgggactacaggcgcccgccaccacgcccggctaattttttgtatttttagtagagacggggtttcactgtgttagccaggatggtctggatctcctgacctcgtgatctgcctgcctcaacctcccaaagtgctgggattacaggtgtgagccaccacacctggccctttttttttttttttttttttatgaggcagggtcttgctctgtcgcctgggctggagtgcagtggtgtgatcatggcttactgcaccctggacctcctaagctcaagcaattctactgcttcagcatcccgagtagctgggactatagacacatgccaccatgcctgactaattttttaaaaatttttagtggagatgggatctcactatgttgctcaggctggtcttgaactcctgggttcaagcaattctgctgcctcagcctcccaaagtgctgggattacagagatcagccactacgccgggccaagttaacaatgtcttctcttgtaatcaactcataacattttgattaaactaacatgattacccttaaccacagaaatgcaaacattcagattcacaactttcttgattgttctctgtcaaagacattagttaatattggttaaaagaacaatacatttagatttgcacagttgctgttattggaaacatattatggttataaaatattgcaagaatatgtgacaacacttaggttagacaacatgaagaacagtggtattatcagggtgaaaatatatatattctcagccattcttgtggaattaagataaacaaccatttgactttgttgagtctcattcagtcttaaaatggagggactttttagaaggtctgtggagaacctattgactggctagcctgggagacatgctcagtcctcttttcccagctacttcatgcaatggaggctggaaagcaacatgctaactttcccagcatcctttgcagctaggattggctgtatgattcatttctcatcaatgttgcataagatgtagtctatgggggaactctagtgatgtttttagccttccttatacttttgtcttaaaggtaaatgactagagtgctgggagtcaatttgcaaccagaggccacaagcatgaggacaaaaagctagcatggtaatcacggccaagtaaatagatacaatgagccaatattggctcctctatttggcttaacatagctttgtctcaattcttagccttaatgcaggctacttttcaaaagtagggttctaccacaaaacaacctttttgcccctggcaatgattcttgtgcagtttactgaagtaggcttgatcctgtcctttcttctccaacccaaatttgctcaaaccagtattgagtgccccaaacttatagatcccaagagttcttcttaactatggataaaactttgcctgagttcttgttacaatacaaatatgtggccgaaaaaggtacctgtatataaagggcttttgatgacattgttgatctgctacacatctctttcatgtttgccttcctccagtcttttaattctataagatgattttattaataattaatatgaatacaacatatattatatattgtatatattatatattataaattgtatatattataacatatataataatatagtatatatataatatatggtatatatactatatataatattataacataataactttattatttatgtaatggattgtcaggcttttttgttgtcatttacttgtggccagcagtagcttattcatatggttctccaccactttgaagagatacatctgcaatgatctgaacaccaagtcaattatctatcaaaaacatggttcaaatgtacttccattggagtaatctaatgcagcaccatccaacagaacactgatgagggaaacattcataaagaacacatatgtttgtgtgatgaaggaatatatgtgatctatttacgatatagaacatacagtcatgtacaacaaaatgaagtgttggccaatgacgaactgcatacacaatggtgatcccttaagattataatgaagctgaaaaattcctattgcctagtgacgtcgtagttaaaccattgtaatgtcatagtgtaacccactactcatgtgttgtggtgatgctggtgtataaaaagctatgtgcttccagtcagagaaaaatctagcacatataatgatgtatagtacagaatatttgataatgataataagtgactattactagtttatgtatgtactactatactatactttttactgttattttagactgtaccccttccatttaataaaaaaagttaacagcctcagggaaattcttcaggaggtatccagaagaagacactgttatcacaggaaatgacagtcctaggtgtgttattgcttctgaagatcttccagtgggagaagatgtggaagtggaagacagtgatattgatgattctgaccctgcggaggcctagctaatatgtgtgtttgtgtcttcgtttttaacaaaaaatttaaaatgggaaaaaaaatttttaatagaaaaatcttacagaataaggatataaaaattatatttttgtgcagctctacaatgtgtttgttttaagctaagtattatcacaaagtcaaaacgttaaaaattaattgaaaagtttataaagtaaaaaagtgacagtaagctgaagttaatttattattgaagaaattttttccaataaatttagtgtagcctaagtgtacagtgtttatgaattctacagtagtgtaaggtgatgtcctgggccctccattcactcaccactcactaactaacccacccagagcaacctccagttctataagtgccctatacaggtatattgttgtttatctttgatgctaattgttttttttttttgagacagagtctcgctctgtcacccaggctagagtgcattggcatgatctcggctcactgcaatctctgcctcccgggttcacaccgttctcctgcctcagcctcctgagtagctgggactacaggcacccacaaccacgcccggctaatttttttttttttttttttttttttgtatttttagtagagacagggtttcaccgtgttagccagaatggtctcaatctcctgacctcgtgatccacctgccttggcctcccaaagtgctgggattacaggtgtgagccactgcaccaggccgatactcgtattttttttaaccttaccttttctatgtttagctctgggtagatagacaaatacttaccattgtgttttaattgcctgcaatattcagtacagtaacatgctgtacaggctcgtagcctaggaccaacaggctatatcatatagcctaggtatgtagtaggctataccatctaggtttgtgtaagtacactctttgatacttgcacaaccttgaaattgccgaatgacacatttctcaggacatattcctgtcaccaagcaacccatgactgtacagaagacagggccactgaaaattcaaaatgtggctactgttattgaggaagtaaatttttaattttatcttgcttcattaatttaaattgaaacagccaacatgtggctggtggttatggcatcaagcagcacagatacaaagaattgctacctactaaaaaatatttgaagagattcctgtagttctcttaggaaaaattcagcttgtaactttatatatattatttcacaggcccaagaacacctcgttatagaaaaatgatgactcagcagggctttgcacaatgtcatgtttgaaggctgttaaacaatatttaactcgaatattagctaactaggcagaactgataccaatttaagcattttacattgacaactataataaaggatgtccttttggaataataatcttattcagactacactctttcagctgtttgttaagacttttgtgttcccaattacgaatgaaaagaataataatggcatgccagtctcattaagccacgggggtaaaacaactctctcagacaaactataaattatcatttgcacaagaccgctgagtatgctagaaaatcagccacaaagtgtgccaacatggcgccgaatagtgggagactgagagtaggcagctaaagatgctcccagtgaaaggagaggagaaatggatactgattatactggacactggggatctgtggggccgtcatatactggagcatggtattcagtactgtctcctacacccaaatgtgacttgcggaagtgattccatgatgcctcagtgtcttgtgtcgagctaaatagtcagcacactcacattcatggctatatttagagcctgaggaacaaccacttcttcaagtgtccagggtggcctggaggagctaaaggtgccacttcttctatctcttgacaaggaatgcagtcacaggcaagttctccatcactggttacctccaagctgctgtaaagaggtcagcaaagttcctgcgtgctgggaacttgagttccttcaaggttatgtacaattttaagacgtggctgacaagctgaacttatttcagagacaggactatctatattctgagttttaacagaaatgatgtaaaaagagagttgagagttttggcaaaccgtattttcttattctatatttgctactacgtgtaaaacattcaatttataaaatatttcatttaagaaagccaccacctacacttctaaccactaggtgttcttgagataattatagaaactggattactcagtatcactttcatttcatattgacaaatacttctcatcagtttgctttgcattcttttggaaatacctgttttcctcataggtgctgctttgacccacttattttatggtaacgtccaatgtctaaggagataatggcaaccatgtgtgaatagttaacactcagtcttgatagagggacatggtctctaggaatgtaccatatctggaagaaggatacatttagaataagtctccataaaagacatatgaatatgtgaatttttacctatgatgtggctctgaaatacagaatctgcaactgcatcgtcttcatcctcttgcaagttttcatttgcctcttttacctgcaggaagaagaaaatgatgcaagttcttatttgttttattaaaaagatccttttgcaatcctcagagtaatggtacattctataacaaatatgtgggcataggtgtgagtgtttgcatgtatatacatgtgtgagtatgtatgtatacatataaaatacatttttttcgttctacttttccgcactccatcatttggctttattacaagttttaattataagagcttattttcagacatataacctcatttctgaaggagagaatttacagggtatctaattctacacaaaattttagagataacagcttagcttgttaataattaatgaaatcagtaacacagggctgttaggaaacgttaaagtctaacgaggtataattcctccagagtcagtgacttccactgcaagttattttaataggaataaaaatatatactttaaatatacttaggtctgctggctctttcctggaatgtaacttaagaagataattttttttcattctttccataatcaaaggagatgacaatgatgtatgtatgatcagtgaaccagagcagtgagtcatttatctagatatttttttttgagccaaaaacattccctcttatatttcagttggaaggcccaggcactagattgggcagcatcagatggaactctacacagaatttaatgaagttccagtattttacagatgagaattctgaggtctaggaagtctccttaaagttggcacaaatgcagtaagtggcaacactggcatgaaagcccaggccccctacttcccaatccagtagcaggagaagtaatagcatcatcagcaataccaaccacaatagaaacagtgaacacttacatactgggcaggtgctgtttgcacgtaagatctcaaaatccttacaacagtgctatgaagcaggtgctatggttagctttattttagagatgaagacccatcccaaagcaatagagaaggtaattgtcaaaatggtggcactgggatttaaacgcaacaaatctgactccggatttgtgtttactggggggacctttggtattctcaaattttccacttgaatatgcctgtgtagacttggactcagtatcaagacaacttagggttctagaggtaatggcgctacatagctcttttaaaatacattccagacagccacctaggcagccaatgataataacgtgcaatgcaatgggtgtcccgcttaggcacgtacgttagaggttgccagtggatttgctacagggcttgagttgaatgccaagaaattattattttatactgtcaatgtgaaagtcatatggctgaatactgaccttgagctggatttagctttctactttttgcctcctatttttcatacttaatggaataagaccaattatttacattttatgactgcagtttcaatattagaatgtaattggtgcttaatctgtaccatgctgatagccagagatggcaaactcaagagagtatgtaaatggctaactcaacactggcaaggacagatcgttaagcgttcagtatcaagaggccatgcttcatcactttctttccccttcagctgtctaatctgtgggcatttccctgtttgttagcagctccacagaaagaaagtcagagaatgaaagaaagcaggaaaaaagggtttcattaactgaccgtgttctagcagcacatatttacagatggcagggaggaaacacactgtgagtatgagaaagaccaaagtactacttatttgccttccaaggttctctttgctcagggatctgtttgtaacaaggtgacccaaaggcccccaaacacctcagtttccattaataatccactgggagccttttatcctcttttatagaacaacaaggaaatcatattttcagtttcatatcagctcttatggcaatatgtcccatatttcttgcacctgttaatgtaaaatagtatttcctttgggtttttccaaatttatacattttaaactcgcaggggtgccctcgaaacctgttggactgtcagtaaatcatcatctctgctggcctgtgaaattctagatgaaagaatcaaataattagaacaaagttttcatcttacagataaagaaaaaggagcttcagagagggttaataatttattcaaagtcatacagaatttcagttatagaacaggcactcctgattcctattcattgctataattcaatttttcagagtgccctgtcctgttacagctatcctttccagaccttccaaagaactactctttcttagtgtctaccatttagatatgaaggcaatattccaagtatccataaactatattttaagagtagtaaacatttttcatgcatgtgtgtgtgtataattctctgcttcccttccctactgttccttacctgttccgtgccccttctccacctcctttctctaattatcatatttaagaaagaaaacaaaagcgactgcacagtcctacctgtcagctccttgccagaggcattccagggccttatgtgcttaaccgcaaacactaaatgtggcctctggggacttatgagaagaactgagatggtgaacaagccccctggctctttcagctctcctgggctggatgacccatgaggggcagatgactcactgggggaaattgtgaacttgatgggaatggatgaagaagcagcaagaaaatggaaagtgggagagtgctttagagtgccatacttgtcaattctaattatccatacaaatagatttcaatgcaaagtggtgagtaattaaaaaaaatccatttgcctatggaaatgaggggcataatttattttggcagcagattccccttgctaattatatttttcataggatgaaatttaaattaattttcattcttgatcccataggagctggatgttggtgggaagttgtgggagttttcccgggagtaagagggctgccaggtcaagcatttgccaaaaataggcacaagtgggacagtctccatgtgggaaagcactgcaaagaatgggagagtgaacacaaaaccaagaagtctgccaaacgtttggttcagaaaagatgtagaaatgtagaaatgtcccagtcactgttgccatcccaggaacagaaacaagtccatgtcagttatgtcctatttggtaaaaagtagaaggtgactcacaagcaacaaccatgggccatttttggtttaagttacttgtcagtgctttgggtgtcttctaatgatttatctctaactcttgtccatcttttggggctctgcagttctagttaggaactactccaaacaccagtctgcaacaggcaacaattaaatatcactgcacttctattttattcacccctgtttctaggaagggcaggaagaaatgtgcctacaagagacacagggggaaaaggggagaaaataattcaccattgacataattgatataatttcataattaaacccaattttatatcaattcaccattgatataatttcataattaaacccaaatttgagaacatccttcatttggagttctatatatatttcttccctgaatcatcctaacactaacggcttcccaagaaaccaacattttgatgtcaaagctcatttgaaaaggaaaagaacataagtgagacaggaaataatcctgggagagaaagttcctggaaagcataacctttggaaaagttactaatttagaaaactttgcaggcggagggcaaaatatgcatgtttcttattagcaccaaaataccatttagaatagaatttttcaattaaggatgttaaaattgtaacatttcgcagaacttaataagatgataacaatttgtgtaattattgtactattttctgccattttatcaccgtggtaccattttaatgggatagtatttgatgcttttttattagcagacatgattttttttttagactatgtgacactgggtaaagagaatacccataatttaaattaaaatacccatactaaaatggtcatattaaaatggttcacgatgaaggtatatgatctcattaattttgttaatgatttttatttttgtccagtgatagttaaataggagcctagagctgtctttctttgagacttttcatttcagaaaattatctaaatctacaggaaagaagaacttgaaacatgtagcaagtatagtgtacctctttctgacttactgacttaataccaaagcagtctttctaggagatgccttttccctattttataatgattttatataatttaaataaaagtaccaagtaacatggcccttgtctaaattacacaaaaattagagctaagtggtctataaacaatggcagaaatggggatataagcttctaattaaggctctgaaataagaaaaaatttaattcagacaaacattaataggactttgaaacatattttagaatgtttctagcaatactaaaaatgaatatgcagttactagtgaactaagcggaggtttgctacacatgtggatttgttatatgtatggaaataatctattattattatatattagaatactaaaaatgccttaggactctcataactatatataatcttagtttgtaaagaacaaaagatggtggtatagtacgtcataaggtttcaaacagtggttttatttagaaaaagagtgtgatacgtagtgcattgcatatatacattgttttcatccaaaataacttctatgaaaacaattctttgcaacacagtttaaaataagcagacagtgaatttaccttgagccctagtggggggaaattctcttcaactctgaattttaaaaggttcatgggtattcacatcaatgtgctgtggtgttaaaatacatctcattttgcatctaatctccttcctatataggctgataacatataataaatgagttttccctcctattcttgtaccagtcacaaaggagtctatagcaacgtcctttgtgaaattagtaattttagcccaatccatgctgatgattatggagatgaaacaaaaagcactgcattttacatttaaaaaaatgactagctggtcaactacccaggttaataacatttctctgtatggaaaagcttctcagcatgactaatttgtctttcagctaactggaaaaatcatcatatggattatgtatatgtggggtcgttagggaatctttgtacttcacagaaaataattagagtgtttcttgcagatattctggaaagaccaaaggaccctgtgaaagactgcagatgagagaggaaaagcatggcaaataaccttagcattaggaagtaataagaaaataaaaatgaaattgtgaaagccaaacataaagtctttttgtttttttggtacttctgtacagtgaagatataccctaggctgtcaggaccatattaaatgggtcatagttaaattgagtgcctctgataaggggctctgccaggctatcaaagttttccatcagctggattgaatttccagcatattgcacattttcacacattcattctctcttcctcctttcagtgacaccacaagggcagccttagatatgcttacaatttgtggttttataatgcaggggacatctgtgttttcaaagaagggatgataccatggaagccaagagcagaaatgggatgagggaaagaaaaaaaaaaaaaaaacttttgcaacgaacataatctgcatataattttggagagtttgtaaaaaagaccttatggctctgtagagtcaagagctatttgaataaaaaaatttaaacatccatttctctcaaattaaagtctgtgaaacttgaaggaaatctaaacatcaataagtatttatagctaataattaataactaataatgtcaaccatggtcactttaaaatctcctctactcttgaatgaccccagaaaataatgcagggaaatatttcaagttttccctcagaaaattgtagtatgtcctatattttaataatctctttattagagtacaaaaagatatggatatagtaattccataaagagaatattttgtgtttaagtgctctggaacttgccaaaagcaacaatgaatactattaaattatttacacaagtacatgaagaatgtacagagagtaagtgcaatttaaggtaattttaaaacaaaaatattaactgaaactagtacaccccaggaaaatataaaaaatactctttcatttattttttatttatttttttgagaaggagtttcgctctgtcgcccaggctggagtgcagtggcacaatctcggctcgctgcaagctctgcctcctgggttcatgccattctcctgcctcagcctcccaagtcgctgggactgcaggcgcccaccaccatgcctggctaattttttgtattttaatagagacggggtttcaccgtgttagccaggatggtctcgatctcctgaccttgtgatccgcccgcctcagcctcccaaagtgctgggattacaggcgtgagccaccgcacccggccttattttttaatttttaaaaagaaggctactccctgagttctggacctcacaatagactaaatgatagggagccaagttccaaaaaagatttcttagtcttaatagcctctgtctaagttgcatgaattggacatacaactttcataaaacatgaacaatgcttaaatcaaatcatcaaaataggcaatactctcttaaattgtttagcacttttatttttaaaatcatgttcattcctttttggtggcaggtgatgttagaaataatcatcaaaacaaatttccagcccagtggtgtaatttgaagatgataccagtagcatcatttgcctggactcactgcgattatactcaacgttctgaaaacagctgggaaaagcagcatttcctgagagccaggcccactcgaggtccagctgccagctctctgctgcagttgtcaccaggatttcgctctctttttacaaatcctttttcactgaccttttctttcccccagttgcaatctcttacccatacattttcattagcaaacggtagaaagaccccagccagaacatctcagattgtagcacttgataccaggatggtggagcacttaccagggagtcttttggtacttccatatcggctttgattttcatgtttttcttgtggtttccttgagtactgatagagctgccgatgagacaggagccctgagaactgccctttaacacattcctgcaggaagcattacttgatccactttctgtctgtggagctgctttcttatcaactctgcaggtagaaagtgattcctctgataagttaccttgctccttcttcaatcactctccttttcccaatctttttaatatttaaagtaacctctttgtagctctttgtctttaaacctttgacggataagggtttctcatgggccttgatcaaatcttcaaatattctagtagcatgtcaatttagatttgacaatatcataatgtattttttatttttgtgatttcttgtggagaggggcaaaataaaaaccactgaagagtgattattaactacatttttagcttaagagcagcaagaaatataattatttctggaaagtttccaagtatatgtttgctaggtataatcaacgaaatcggcatgctttaaaacgtatgtgtaattttcttccatttcacgccatctgggtacattcatagctcctagtgtaggtggaattgctatcaaccctgataaaacttaccattctttaatttcaaaggccattggtttggttaacaaagtaacatggactaaatgatcattttattgctaacttttatttcattgcttaaattctggctaatgtataaaagactgctactattcatttctgcctgtatgaaaaaacatgcttgactggcctttaatgcacaggaagcaaacaactcttttaaaggtggtggagggacccctctacattgctacctgcttttccagtgagttacctgttcaagagttccgtcatgaaggtgtctttcgttgaacatgcaacagggctgtgtctattccttggttcaatcttcagttggttgtaaatgtcttgtggtgttctccgattatttttgctttgtaaaccgccatctggattatctgctgacttggtgtccttgataagctcattttctgtctcacactgtagttcaggcttctttttctctttttttctttctgattttagttgtctgtttccaaaccccaagacttttgcatctttcttttctactttggttttggagatgtccattttcctgctactcagagctggaagtctactcttccgaaaaccaaaccagctggcaaaagaaggcccaggcttctgctttgcttccacagaggtgggctttgtttgcacttggcccttttccacattttcctgaatgcacaacatgaccttttcttcgattgtgggtgagaggggggcttctgaactcacagcatcagtcgcggttgcagaggcatctggatgccttccagaagtttctagcttggatgtactgcttgtttcaaaagtgcttggatgctgagtcctccctgggctctgcagggcttcagggcagtctgttggggtgggtgggcaactgcggcggtcactgcctggttccccaagtacagccacattggcactggggcactctccctgggtgaaggcctgctggtcttcctttccaggtgggatgaggagtccctcagactttggagggatcctcaaaggcaacttacttgggctcccatgctgactgctgaagctgcctgagctccccagggagcccttcccggaggaggggtgccccgagggcctcccaacactggggagactctccaacatgggagcagaaggggccttgttgggagagctttccgtggaagagttctgccgggtaagagaattgcctctctcggcggtattggtaatgatctgagtgcggactttgcctgacccttcgatggggggcgtagaaggcttgtctcctgagtgtgtactgaagctgtggctgcgggctttggcgccattcatacccagagctggttttaggtgtggtttgctggaggaaagggatcttctcatggatctattatctaccccatcccttccatcactcccagggatgctactttccaatggctcttgtagtgctgtttccaggggaagcccatcagctaaactgccctgtgcttgtgaatccggtagggtcacatttctttcacccgctgtgatctccatgcttgctggattcttggagtcctctggcttagacttgttcacagccacggaacttttggaggcttcatttaaactgtctttttcatgtttccctggcacggtggaacttttcctgagcagctggggagacttcatgagcactttgagtcccactggaaggcgagttttcagtcctttctcatgagcactttgacaaccatgagggctgttatggcttttggcgggtgatgaggatgatgaggaactgctgacctgagatgatggtgactcatttacccctaagaaggaaggcttggggggtgtggaggcgctatcattcaattgtccttttctccctggagatacacttttggaggacgtcatttccagtggctcatgggttgaaggagagatcctgggagtctgtaatcctatgtccctttgtggggtcccaagtgtttggcgaggagaggttttggggacacctctcttcggagagacctttggaggccccagagccattacggtgaaggagctggagggggcatgagcagggcatcgggtttgaatgactgcttctggggagggcatagggtgagtgaagataggctttttgaaggccacagaaggtttcttcctctgcacttctgtcgtggccggattagaagaaataactggagcagaaattcctttcagcagcggggatttgaatggggtccttgctgtttcactggggaccctggtttcggacttggtggatgaaggtgctggtgaatagtcatagctgggcctggccagcagggagacggacctgcctggagggggcggaggggaaggggatttcacccctgcctccggcccagagccacagtgttcatccctcgtggggggctctccactgtcactagactcaatggcaggccttgaccgtgaccctggagtctgactcttggggcactggacccagtccctcctgctgggcatcctggagctgtgcggaagttgggcggaatgttttggaatgtgtggatctgatcgtaattcaaagaggggccctgagctctcagtcttcatgaatcgtgagagtttcccaggagctaaggctggtgatttttcaagagtcaccaggccagatgaagggagtagtgtggtggcttcgggctccattagttttgatttctgaggtgaagacttgcccctgggaggtatttttgtcagattttgcttttgatagatgcccatgggtgccgaagacctggaattactctggcatgatatattgtgtgttggtttgaccagcttttgctgctgaggattttgtgtcactgtcctggagctgaaagattcagtggacaccctgggaacattatctacattatcttttggaatgtttttctcagtgtcctcttcagaccttttaaagaaagtatagtctcttgcagcagctcttggctgtaaacaagcaattccctgaggtaaaagctcagtatgttctgccttgggtccagcaggagttgaattgatggaaatctcatttctggtaacagtgacaaccccagtctggtgagagctgaattcaatgggctcaccgtcttccgcatcaaatatcacagtcacacattcttctgaagaagtcctttttacaactctttgctgcttaatgaaactaaaagtctttggcctagtctctgaagggatgggcacttgtttttcctcctcttcaggagacccacatagagattttccaaaccccacaaggacatccaggttctccacggacttatcggtgtcggcagccaatgacacgtctgaaggacttttctcatcactgctctctatgtgcagctcatcaaacgtttcattgtcatcagtgtctgaaagctggaggttgagagccatgcggccatggccttggccctgtgggcccctctccctctgtacctgaggcgtctgcacacttgggcacagcttcatctctaagggacagctgctggcgcaacttgtcagcttttcaggcctttccttgggataaactgaggatgtgccttccagaaagtgttttctgtttgtctcccagccaaacagactgtcggaaacactgtgggttaatttactgccatgtggcctgcagctctggtttggaactgcttggagcaatgctaaggtggaagggtcatcgtccgcatcaacgtgggaatctagatcataaacaaatgtcttgtggggttccttgcaggggctccccaggtcagctgttttgcaggggggatactccttgaggctgctacttttaattccaggagaatatattccttcattcgagttcatgcaatctttataaccccatttggttatcactgatgggggttcaagtaacacttttcgcttctgtagctttcttagcccttccaaaatgtggctttccttgatacgagttggaggtagttcatttgtaggactagcaaagccacttgggagcgaagaatcaatacttagccttttatcccagttttgtgatgattgctaggaaagaaaagtagacatcagaaatgattgaaccatgtagatcacaaagatataaaaggaaaagtacatcatgggacttaatttgtgctagtggttggtaactattcacatataaatgcctacattaattagctaattaatttattcacaaactatgcagcaaacattgattttgccaggtcctgtgctaagaagcacagcgatctaaagaaacagaaggtaaaggccctgtcttcatgggaggaatcccagtggggagaggagaattggccacaactaactgtatgtcaagggagaaaatgggaagtgcaaatgttgtaagtactctggagattcagaggagggaggccacagacaggtctatttggagaaaggcatataggaaaggtatatatatttttttcttttaaacttacctagctcttgaaagacacataggtttgccgtaggttaaaagtgggggaaatgttttccaggtgggagaaatggggtgggcaaagacctaagtcagaaagtacattcaaggtacattgagggaatgactagaagatgatatggccttattgcagagtgtctacgagaggtgcagagggtaaagctggaaaagtaagttggttgatatctttatgctcacatttgatagttctgtgacttcataactttatttggtagacaatagatatctatgaaaattttcttaagttactacactcatacatatacacatacacacatacacagcagctgggcattcgctgttagaacctgacagtaattattcacctaccaaatttagaaaggtcaatttcctgcccatcacccttcccaaatgccagcctcagctttggaaaagtgtatgggaaatgacatagagaaaaggctgtgctctacatattcatatttttttcatagtattgctaataagaaatggaagggggaaaaaaaaaagctaacatttactgagcctctgctgtacaccagccatttacagggtgctttcactccatcttcagaacagacaactgagactcattgttgggtctgttggagatcacatagaaagagctggagcaaaggtatgacctctggtttctcaggctctttctatagtacgtcggttttgactcagttcaaaagtggcagtgaggggacatgaacccaggcagtctggccccagagcttgcagtcctaactgatgctatatataaagccaagcttagcccctcttctcccctttaccttagtcagtgtcataatagagatcacaggttaccccacactatttcttaaatggtacttgcagagtttagggggctgacctaatgatttcttaagaaggctatatgggccaggcgcagtggctcacacctgtaatcccaggactttgggagaccaaggcaggtggatcaaaaggtcaggagttcgagactagtctgacccatatggtaaaacgccatctctactaaaaatacaagaattagctgtgcatgttggcgggtgcctgtaatcccagctactcaggaggctaaggcaggagaatcgcttgaacctgggaggcggacattgcagtgagctgagattgcaccattgcactccctcccaggtgacagagcgagactccgtttcaaaaaaaaaaaaaaaaaagggctatatgattaatggtaaagagcttcaagagaaggctctgggtttcagaaatgcactctataccagttttggctacatcagtctcctccctgccccacacgcttatgtgcagtggttgaaaaacatgtcagaaacttccatttgaatctgggcttcttagtacactgtaaacatttgctcacatctatggcattttcatgaaaattactcttgctatcaacaacgcacacatttatttgtttttaaatcaaattataaattttctttaggaaattctccaccgtcagaagttgctggcagtagatgctattcagtgatgctgccccacttcctcttccctgtaccattacaaactcctttagaaatcagaagaaatcccattagtgaatctgggtattatagctccaccagaaaggagctgccacagtgtaagtttctaagaatttccatgatcctgatagtcatgttgacaataaataagagaaaccaagccaaagtaccccacaagagcttgaaaaatgtggatctgtttgacccccaagaagacatgctcaacctctgtcttgcctcctttctgccattctggagcctgccaggtgctgcactgcgacttgccccagagccagtggctgcaaacctcccagggcccaggctctctgcctggtgagattagccacattcctccttcagtcctctataggaggttatagtatctaacaactggagaaaagtctaggccaatcttgaagcttgggggtaggagacacacgaatgccccgtgggagtgatggtggggaggagctggcatttctcacaggcagatccatcctttgctgcgaaagttggaagagagttgctcttgggaagcagtgtggttgactaaaagatgctgttgctgaggtgcaggcctgtgtttaatgtccacagtcctcttccatttcttgactggacaagaatcttatatatatatatttttctaaagggtcttaatgggagcaaactgatctcaataattgaagcaacctcaccacgtttcaggctgattcaacaaggccagtataaaagaacaattaagaatgtgggttctggagccttctggcgcctggctctgccatgtactgcctgtggcatcttggttcagttatttaacttcttagcacctcagtgtcctcttctgtgaaatggggagaataggagagcctacttaataggcgactgggagcattacatgatctaaggcttctgaagtccttaaaaggctgtgctgcatatggtaatttctcatcgactagagccacattcctctgtagggcaggctagtgcatttcatgcaggcttcctttctgtttgtacacaagtaaaacatacttgtgagctcaaaaagcacaatcaataatatattaattgttatataattaatattcaaattcaaattcatatgatacaagtttattatgtaagttaatactacatgagtacccagcacaaagtaagaaactgcagaaagtttcttaagtaatacacatttcaaatgtcttcatgaatctgggtctggcttgttaggtccctgagaaacaagacagttcactgtgagatatgacaggtgtactggtactccatgaccatgacagagccctattaaggatccagagaagagccacctgagtgtccatgaagtgccttaagaaccttctttctcctcattcaggggagagattgccttagaacatcaaaagctactgtaattggaagaattccagccaaaaattaaaagaaagtgaaaagcctttgagaaggagagagacaaagaggtgtgaaagtgaaaagagcagagcgaggggctctgggagccagggatattcacaaagcgaggaaacatccctgaccatctgtccagtctgttccaaaccaggctcagagcagtcattattcagagcacctaacaactccttagagggagcaattttgataatgcagcaggctctgtactttgcattggaagtctgagtcccagggaataagccctaaatgcaaccttgagatcttctgagttcttgttcagaggatgacaaagctactccctcatcaatatctcctgggagttctggatttttcttggtttctacactgctaaaaccatgaactaaatttatacaaatggtagaaaaatgacctccaaatactctgatccggggtttctattcttgtgtgctctttccttttctccaacattagggaatggataaaacagctatttcaaatatttcccttacatcagtgtacaaagacgtctgctcaaagcacaaaggtatctccagctttgcgagtccactgtgcagatgggagtcattctagtagtagtaattattaaaaatcctggtaaaggaaatcttggcatgtatataagtagaaatatgcctacctacactgaagttgtggtctctgtcatctcaccacgctgccctccaatttatagtcaaatagtgttttatgaggctatagcattgatgaaaggatgtcagtataatacatgagcaggtgctcagcaaatggtggcttccttcttacccctcccacctgcccttcatctccatgaccaaatcctaccagaagaggattcttttctggttcattccgatgccacagtgccttacccttttcctgaggttcttcccatcgtgccacgtgtaggaggagccactggagtactcgctgcaggtgcttgaaagagacagttcactgctgctactgtagctgtttcgaggacagagatgaccagggatgacagcccccaagccagggcatttcaaggccgattttgtatttagttggtgttcctgaaaaagcaggacagctctgagcaagggctttgctcagaggagagtaaatatcaacacaaccttatggtgaggtagatgggaatacagatgctcctcaacttatggcaggagtacatcctgataaacccatggtaactggaaaatcagctgaaaatgtactcagtacacctaacgcacagaacatcacagctcagcccagcctacacttacattagcctacggttgggcaaagtcatctaacacaaagcctattttataataaactgttgaatatctcatgtaatttattgaatactgtgctgaaaatgaacatcagaatggttgtatgggtgctcacagtacagtatctactgaatgtgtattttggctccatcacaaagttaaaaaatcctgtcgaactaccctaagctgcagattgtctgtatggtatggtatgataattacgggcagactttggagtcaaatttgggctcagatcctggctctgcctcttcctgtgtggctatggggaaactatttactctctttcttcaaaggaaatcatgatactattgcttatcttatagggttattgcaagcactaaacgagggtctagttgtgaagcacatcacagcatctggcctctagtaggtgctcaattattataagctgccatcattattaggcaaaagtaccacaagggtggtcttattttatctagccatactggtgagaatatcaaatcagtatcaaaacatgactcgaatgctacaaaaggacgaagatagagtcacatctttgactacaggcttcaaaagcatgtaaactggctgtgagtctagtggtctggatcccgggctacccactgccactaagcatgcactcttgagcaaggaagacttctaacttctgtggtctttaatgtcctctttatagagggtgccgctgtctgagatttctgctacactttcctctggttctgatggcatcatactaagtccacaaccagatgcccattgcctatctgtgctacctcacaggaagccaagcacagcagacacgaaactcaggtataatgagcctccactgtaaatataatagtgcttttcatatccagtccttgttaccatttggctatccacatggtaataaccctcacatcaggtaggtctgggtttttagtggaaggttcaagctgttagaattctagtggttcttcataaggcaagggtgacaaataaagctgtaaacctccaaacacatcttgacagccacattataggcccctcgtgtaacagatgaagctctacaaactggacaggctaaattaatttacatcccaaccactgagaacagaatctctctattgccgtctaattccagtctcctttttatataaagctttgtctcagaaactctttgatggtaagccatctgtctttgtgtcacttgcagagtggcaaagccttttacttatacaatttattgacactttgtgggtgcctttcagtacctgagtacttatcaccattctccaaatgcaattccaactgacggtgactaaacaccagcttgggaaaggaaggtaatgatgatcctacagtacttgtggtaaatattaaactcctacatcagtacacagggcatgtttaatttactctctaatcaatacctataatgctcaattcccagttctcttttaatgaataagcagccctgcccactcatgtccatgtgtatacctcctgtatagatgttggggtaagatgacaggaaagtaggactcagaagatgggctggagtgagaaggaattgctgcttctcccttggccttgaacttgagatgctctgttttgttttgttttgttttgttttgtttttcagatggagtttcactcttgttgcccaggctggagtgcaatggcatgatctcagctcttaataacattagattttcagtattaggcatctgccttactatcaatacttcatttttgctgcatagcaatctctttaagtgatctaaaaatgccaagaaattttactatcctatttcttccccctgaaatttggctctacatattattgaaaggagaaacttgtcttaaaatcaggctttcagcaatatctactgatttatgaacttgtttattgccggacgtaacttagttaaggggagttcatatttgtatctccacagatgcctacaacaaatggttgtgtcgcagagcagcaactgccatttcagcctcagccactgttggcacctggaatgtgcactgaacaaactttcagaaatatctcatcaggcttcacttctactgtgtgctttctgttttctcctgtctgtcctctcatattttgttgtttaaatacgcagtgtggtggttgttatttaggactgcctctgctctgacagatgtgtctactctacagagagagagagagactgtgtctattgtcccaccaggctgtccagatccaaactccaatgacctttctgcactctgcctggctattggttacagtttacattctaccttctcccaaggtattgagggaggcttgcatgcaattctctgtccttcccgcctgttcttcctactacttctattaaaattatacctatttttacaactcaattcccaggtctcttttaatgaataagcagccctgcccactcatgtccatgtgtttacctcctgtatagatgttgggttaagatgacaggaaagtaggactcagaagatgggctggagtgagaaggaattgctgcttctcccttggccttgaacttgagatgctctgttttgttttgttttgttttgtttttcagacggagtttcactcttgttgcccaggctggagtgcaatggcatgatctcagctcactgcaacctctgccttgcctcccaggttcaagtgattctcctgcctcagccttccaagtagctggcattacaggcatgtgccaccacacctggctaattttgtatttttagtagagatggggtttctccatgttggtcaggctggtctcaaaccctcaactgaggcaggtgatccaccttagtttcccaaagtgctgggattacaggtgtgagccaccgtgcccagccgagatgccctgatgtgatggcagatacttgagggaggtggagaaggcctgtgaatgtcatgtgggagcaggcaggggcaaagatggttaagcagagaggtgtcctctaagacaggcttttcacactttaacgtgaactgaatcaccaagggatcttgttaaaatgcagattctgattcggtaattctgaggtaggacctgagatgtatgtagtatttttaacaagttcccaggtgcttcaatgctgctattctgtgacccatgctttgcgcagcaagcctctaggagaagctattaaagaagtcagtctcttatgtgagttccctagcagcacgttgtggtacctcactgtctgacatgggctgtgctaagccaggcaaagggaatggctgagcctgcctgccagcaggcacgtaagttaaggagagtgtctgtgtaggtgtacgtgtagcggtagttacagagtaattccttgcaaagaagaggaggcggccactcttttctactgggaaattctcccacttcccccaccttggaaaatcaatgtttgaatttaataagggatgcggaatccctgacatcctggctgcaaagtgagctttttttcccctacagtttccttcgtcagcatgtgattatcacataggattatctactgcagtaaataactgttctgtggttgagcacttgaactccaaggccatttatgaggtttaaactctggctttcacttgctagctctgtgagcttgggaaaattactgaacccctctgtgactcagtttctttctttgtaaatggagatcatgaaagtagttactatgtgggatcattgtgaagactgaacagcccctgacaaacgctggtgcttagggacttttacctgggtgttgctactattattaaaaatgtttatacatatatatatatatatatatatatatatatatatatatatagagagagagagagagagagagagagagagagagagagagagagggtggcgggaagagagagagaaagagagagagacagagacagaggccaggcacagtggctcacacctgtaatcccagcactttgggaggccaaggtgggtggattgactgaggtcaggagtttgagaccagtcaggccaacatggtgaaaccccgtctctactaaaaaatacaaaaaatttagccaggcatggtggtgtgcacctgtaatcccagctacctgggaggctgaggcaggggaattgcttgaatcagggaggtggaggttgcagtgagccgagatcatgccactgtactccagcctgggcaacagagtgagacttcatctcaacaacaacaaatacacacacacacacacacacacacacacacacacatacacatgtgtcttggctcttcaactaagccatcagttagttcatggtctccctacgggaccctgttttacacttcctgatatcctataattccctgatgcctggtacctaagtagtaactacattaggcaatagccaaaagtggatggactttgttaccagggatcactgatgtgagcttctggcttctggagagacatattagtagagccctttctcagtgatcatttctacctttgctgtggtttgctgtgggtgcagcatggtaccacatattaagagaactgaagggggccaaaggaacagagatcttatgattgttccaatattgttagcaggcactgtgtatgcacatttcctgtgttatctcatttaatcctcaccacaactctctgaaatagaaaagaaatatcattatcctcattttctaaaagggaagactgaggcattgaggttttaataccttgcccaagttgccctatcaatataacattctgatgcccggcccaagtccaagccactatgccataatgccaagtcagccctgtgacaatgagcagagctcccagagatacacagaaccccatgaatcccagtgagttgtcattggtaataatgattattcttaaaattcttcatcaaaaatgtgtattagcttctattgcaacattatcttaattatgttgatttaacagggaaaaatacaacctgtcttctgcactatccaaagtatattttcctcattgtttattttagattactaccctgaatgattcatatactttaaacattcttactgtgagaaatgcagtataaaatctacaattttagttaaaaaatagagataatgaagctggcccagtgcagtggctcatgcctgtaatcccaacactttgggaggccgaggcaggcagatcacaaggtcaggagttcgagaccagcctgactaacatggtgaaaccccttttgtaataaaaatataaaaattagctgggtgtggcggcgggcgcctataatcccagctacttgggaggctgaggcaggagagtcatttgaacccaggaggtggaggttgcagtgagctgagatcgcgccattgcactccagccagggcaacaggatgagaccccgtatcagaaaaaaaaaaaaaaaaaacaaaaaaaacaaaagagaatgaagcccagagtttcattcttcccatttttaaataaaaactccatacttaaaaaaaaaaaactcctgactttacggctatattatagattggatgccattaggtctttatgaatgtttaaagtgacaatattccactgaaattcaattcaaatctaacttgagaatatttacatttaatggtctatctacactgatggaattattcagtaaaataaaaaaacagttatccacaaatgttcatgtcattgttttaagcctcacgtttttcattatatatttatttggcaattgtgttttttcaagttactctttttatgtcaacgagagttaaaaagccatgctggttaaagttttgccagataagcacaaagctaaccccagctagagaaaaaaaatgcagagcccatgaatttttaaaagttcatacataatatatcataaaagtaggatgaataatatgggacgtgggttttaataaaaagctccttgaccatttctcagagactctgagatgtaatcaatatccaaaaaaggtatcttggggacaaagccaagatttatgatatttttgccaagaatgacactttctgcttactatatcagctgggggacatgatattgaatttcagagaacacaagaaaggaaggtatttttatctgcctgacaatgcttcaaggatgcactttatggttcgcttgtgacatcatatttgatggaaggaaaataaccaccaaaacaagtgttctgaaggcaactgggaaactcacgtgcacctcagcatcagttcgtgactgtgtcagacttcggtttctttccacctctgaaagcaaatctccagatgaaagatccaagagacgtgagtgaagtttctaggtaaaaccaagcagaaacattgaatagcgataatttaattatttgtctcaaaatcctgccttggacagttaaatctcaaaagacttgacatttccagattagataatacatgtcctaattaaaaaaagtttattctagtttatcagtgttcccatacatgtatatgtacgtgtatgtgcaaattacattttgtaaacaatagtgatgcttttacagtctgtcagtctgccttggaagatatgtagtagaaaaatataagtagtagttaaaaaaataagcagtaggaaaagtatgaatactctgatatatttattgggtagtatgaaaattaacatttgatattcacattaagaaaaccaatcaccaagttcaccttactatgttgagcagtggttaaaatctgagcagataattataaaagtgaccttatttctaaacagcattgatcttgtgaaatcttcccttggacacgttttaactcaaagtcattaatgtcatctgttaggaacaattaatgtgaatagaaaataattgctttggggacctggggactctgaggattttgtacattaatattcacgtgctgttcaattatatactgaattctttatttcagttttgtttgggaggactgctaagccagagacatttcactgtattaatcttgatactaattactaaggcttttctgtggacattaaatttgatctgtttaattgcaaatacaataaaagtcgtgatttatgcttaatgtttctgctaggctgatgacattttgaaaatggcacttatagcctggtttgtcttggttacaacttttgtggctccagatgctaaaaaaaaatctaattgagtaagtaaataatgcagctaagcgtgcctctctcgcttccgaaaagttttttctactcctttttctccctggagaggccctgctgcacactgatgctgatctaagaaatgcctttgcttctttgccactgagcaatgttagaatcatcttagagggcagggctatcccactggtcactctgtcccagcatatctaccatgaagtcagcagggactacaaactccactaaaatgagtcacattctctgtgttccccattcaactctctttaggctgaacttctgtgagagccctgagtacttggttaggtgattattcaacaaacatttatacagcacctcctgaaggatggcactgtggcagggctgtattctatcctcctgcaagggtaaaggtatttttttgctgttgtgggttggccagttctccttctcagtggaccttcaaattgtgtgtctgtggaagtcctttcacaaaaaagaaaataatttctaaactgattgcctgttgctttgaaaatccaaatttctccagcagagctaagacctccataggtaaccagaaccaatgcattgtttctggacagtttttataatcctaattctataatcctaattcaagattcaagctctagaatctgactttcctgggggcaaagatacaatttatctcatcttgcaatctccggaacccgacaaaatacatcatacttagtaagcagcccattagtgcttgttgtagtctttaaacaaaaagatgtctttatattttactcacccatatgtaagttttaaagattgagagagtgccaaaagaattacaatgttgtgagacctaagaatacatttatcaatatgcaaacaggacaagaagttatgggaaatgacattcaacaaaagaaatgattttgagtggtatatcatctgatttgagagaagaggcctcaatggattagctatctaaatgactcagttcatgaatgcacttcattattatttctcagatatatgatgtcacactttcacctactgcatgaatatatgcatctaaaaacctgccctcctcaaggctgtttcagtggcttttatccaaatgggtcccttcccttcattgaaatagggaaggtctgcatgggagaaaggagaggtcctggggcaagggccaggagacctgagttctagccctgttgaaggtacacgttctacaggatctcaggaatgtaactgaacctcttagtctcaaatccctcatctgcaaaaagaaagatggaaaaacttaaaccagagctaccatttgacccatcagtccattactaggtgtgtacccaaaggaaaatccatcattctaccaaaaagatacaagcacacacatgttcattgccaggctatttacagtagcaaagacacggaatcaacctaggtgcaaataagtagtggaatggataaagaaatatggtacatatataccatagaatacagccataaaaaagaatgaaatcatgtcctttgcagcaacacgaatccagctagaggaggccataatcctatgtgaattaattcagaaatagaaaaccaaatactgcatgttctcacttataagtggaagctagatactgagcacacatggacataaacatgggaacaacagaccctgcagactactagatggggaaaaagaaaggggggaatgggttgaaaaactacttagtgggtactatgctcactacctcggtgatgggacctgcatccaaaacccagcatcatgcgatatacccacggaacaaaactgcagaagtaccccctgaatctaaaataaaaggtgaagttaaataaaattcctaacaaagtcacaacatccaatgacagaattataggcatcagtaagtgtaaattttcagaaaaaagaaagacagaagtggctatttaatctactaccacaggtatagagaggcactatcatattaagaagggaaaacaaacaggataatatgctgaaattcacataggccaatttattgttatacctgacagttggtggtaggtaacttcttagataataaggcacgaatgaatcattcattgttatagctttcatacatataaggcaaataaaaattgacttagaataaaataaaatctgtttagttttaaaaaaataatttaaacatttattattatttttcaaaatttttaattattatgggtacataatagttgtttatatttatgggggtgcatgtgatgttttgatacaggtatacaatgtataatgatccaatcagggtaactggattacctatcatctcaagcacaataaaatctacttttgtgttaaggctataggcaaggaaatgataggttaatatcacacaacttcccttaaataactgtgaaagcacacaaccccaaagaaactacatttcttatgacaagaatttttataataggctcatattttcatcatatacataatatacaggcatgtgtgtgtatagcatcactttttatactgatactatattacctgtgcttcagtgaaaaataggtagaatgtatacattagaaatttaagtcactgtcaaaaagagcataactgacttaagaaggccatgacctcttaagaggagccccccagcttagggggcaaattctctatcatatacccatgtatagttcatatttactgttagtgttcatctgaataaaatctcatctgaaatactttaaacttcctgtctttaacctgcaaatcccaatgaattctggagttagacatacttgttttattttagacatgaaaagtagcaggactactcagtataggtttgaaataggccttgtgtcatctgtcacactgtctcagtaactgagattcaactgggtttcagaaatagagactcctaatttcacacattttcaaaccagaggtaagtgagggatctttttactcatatgcttcctttgacggtgacagtctaaccctccctgtcaggctggcttcgctgtctctggaatgtgcccctctcctgtctgagttgatcttttgtccatttttccatggcacactttcctcctcctgcccctagatcctgttcagtattcaggatgacactgaaaccctccctgtaaagtcatctatcctctctaacccacagtggattccctgccttgaggaattggactgcctctcattttggtcctttatccaaagtgtactcttactgagttgttctctgtgtaggttctatcttcctaacaggacaatcaactccatgaaaatgcaggtcaatcccttaatttctacattgtcccagtggcagggactagctgggtgtcacgaaacctcgggaaccttggccctcttctttctgggggcacggctggcctgcatttcccagcctcctttacagtcaggtgtgcccacatgacacgtttagttctagtcatggagcctgagcaaaagtgacatctgccctttcttgcctggcccaggaatacctccctcatatagtcttccatgctctttatccttccactggcttcatgcagacaactcagcacagcaaccttggaagccacttgttgaagatgaagccaaccaggtataaggagtttggcttctttaattctcaattggaagaaagccactctgggaaaagaaacgacttttctggatttgacacaaggaagataccaacttatactgaatttgggccatgattcgtttggagtttgttattattgctgacattgacctggctgacacagttctcttggcagcctacagggtagccactcaagaaacatgcatgtttctatgtatatatgtcatatgtgtacataggtgcacacacatgttcatatatacgggtatttacacatgtatatgtagtggctatgtcaacagcgcaaggtgacaaccccactgaagattctagcttcataggaaagagacctgctttctgtcactatacacaagggcaggggttaggggattgtgtgaagagctaagatgtatcacaatttataacagaacgcatgcctcatacaggtgtaaaataccaagctaagctttggggacctggcaatgccagggtagtcagtgcctggactatacattgggtcggtaatatttggtgggttcacttgccttcattcagtcagttttatgttctctgtgcagttctgcatctgtaattcaaggcagagaaatgtccccctcaacagactgtgccagggactgactgtcctttatctggcaggatgaaggtggagtggacccttcagggtggtagtgactgactctgcagctctctagttaatgatggcagcagagactggagactgaggtgcatttgagcctttggctatttagtagagacggggtttcaccatgttggccaggctggtctcaaactgctgacttcaggttatccacctgccgtagactcccgaagtgctaggattacaggcatgagccactgcacccagcccctccaactattaaaagccaaatatcggcacaaaagagaagttttaaccgttcagcacctgatctgagagaagggatgccaacagctgccctggctgctccccgtcttggtgagtcctagtctgctctagcccactgtctctctgggttctgccacactctgtcaccttggctagctgcttatttggacctggccatgtttagggatcaccctccctcaaatctagtggactggatgttgggctgatttctcagaaaaagaacttactgctttttcagctttagttttgttttcaaatcatctccactttggagagctgttctcacctcacagcttctagaaagcttcctagagccccatttctgctccctcaactctgtcttaggcgggccctgggcccagggtttgattccctttgagcccaacacaagggaagcaaacctggagtgagttattatgaaatctcctgagtatcttttgatattgctcacttcctctgattgcctgtaagttcacctttctagaggatttggtgcatgtttaagagaagcattttaaatatgaccctgaatagacataatcaggtgaataagctttgttccttctgttgggtaacaaggcaatttcacaggtacgcataaggatctccaaaaggaaggtgcaggaaattttctaaaacagcttggagcctgatgaaaacaatttttctgtagaagccaaatgatcttccataaaaaccccaaagttttgccttattcacatactagaattacatttttgccacactgagaagtgtgatttttcatcagcccctccagaatcccatcaagagagattgtggcagatccctgggttcacatttcacaagtttcattctattccattaagaatttattataaaactgaatattatataactgcatattacataactgagtattatatggtcatttcttagattcacaaaaatttgagaccaggacaaaatctttttggataaaagctgatgtttaattgattatgccattatttccattttgggctacaaagataaaacataatatctgcattcagccttcctgctgatgtgacagtgtgccttccaaatgttctcctagagaccctttaaaaaaatatgtccatcataatttgatctcacttcagtgtctgaaatttttacagctaattttttaagccatctgcaacagtccttgttgcaattattattttccctgacaacttttagacttgccttgcacatcaatgtttagctgccctgagtgcattctgttttgctctggatggtgccttggcaaatgacatggctctgtctcttttctacttctccaggacccaaggttataaaatacttttgaaacaattattccacagctatattcaaaaccttcttcaagggtccccacttccatgacagcctgattatccagtggctacctaagggagcagcatttggtttggtgattagaaagtttattcgtggtctctgcagcttagactgatgaccagagcacctcttacctgtccttatctgctgcaattccattaacagtgccccaaggcccacagggtgagcaccagtgggtagatggatgaggatgaaaacagcagaccttgccctaaagagcctcagctctaattagtctaacactgatttacgctttatgctttatgaagcatctactatgtgcagaatcatgactatgagctatgagagactcaaggaagctcattaacagagctgacaatatccctgagcagaccaagcacacaaaggagaaaaaaatacaagaattcttaaggcagaacatgcaaacaagatcacagtagagtaagggtgccatgtagctagagatggtggaggccagtgtattaaccacacagttaaatgtatgtaagagaatattctgtgcaaagggaacttagctcttcctgcagagctcccaaatctcttgaagtctttacaaaacaaacaaacaaacaaacaaacaaacaaaattcggaaatatttcagacctaacagcaaagtgacagaatgttgagaaaaaggacagaaggttaaggctcccatggcaggccagtcagacgtgtgggcaggaggacagctgaagagtgactcgcatttgcttgccaagcctgactctctgaagcttcccttttgtcttcttctgtaaatatgatctaagggaggaagtgattcagcacagcctgagcctattctgggatctaagagacacagaagtgccctgaaatttccattttcatcactaattactttaacaggtactttaataagtgctttccaattgcccccgctgttttgtaaaattatctacactgcattttacatttttaatcaagctttatttttgaaaagttctgactttctgaagattttgccttttacatgtgggggaacacattttttccctctgatttcaccaaactaaaaggattagttagtggagaaaaaaaaacccaaaacttgacctatttttaccagacctattggaagctccattgatggtcactagaattcaatgtaccacttattaggaagaaatgaattaccacttgctctgtggggggaagagacactctgtgaagtcctttccctaatcttatctcatgaatcttcatactactgtgtggaagaagctgtcatcttagtttttagagatgaagaacccaagatgacagaagcgaaggaaggcatctgaagtcacaatgctacatatatttcaggaagcaggagagccaggattctgtcccagacctgcttccttctaagtccaagctcttcctaccatattctgcttgctttttctatgaagggagggacgtgataacatcattgctatcttttacaaggcaaatcctatggaagtagcttatttctgcctaaatgttaagcccacaatttgagcagctcccatcaaattaattatgttgccttggtgattttccttcccaggttctgctttagaggcagataattgggaaggaaataataataataacagcaacaataatagctgtgaacacttatcgagctctttttagcactaagtgtgtgtttcacatatgttatccttttaaatcctcattacaacctacagtaagaactatcatacctgtcttgcaagtgaaaaaactgacatacagagctaaaaaaatcttgcctaatgtcacataaatagtatctgaaccctggacagtctgactgcagagttcatgctcttaattctacccaattaaatctggttaatgatgatttgttatagacaacttattaaaataacaataaaaattaatcagtaaaatgaactgcatagaattaaaaaataattacctctaaatacaatgtgatatctgtttgctagacacaaacatcattcattcatttacttaaaatcatgctttccttattattattccatggttatcactattggtatttgattggtattgttaatttcatttgctttttagatcactacattctttccatggaagcataattccatatgtaaatttggacctaactgaaaaaataaaactatgcaaaaaaaaaaaaatgaacatttatagagtgctcacttgcaggctaggtcttgtgctaagtgtttacattattattatttttaaaaaatttaatttaatttaattcaatattttattttatttttatttttccagaagttattgaggtacaggcggtatttggttacaagagtacattctttagtggtgatttctgagaatttggtggactcatcacccgagcagtatacactgcaccatatttgtcatcttttatccctcgcccccttcccactcttcctgccaggtcttcaaactccattctatcatttttatgactttgcgtcctcatagcttagctctcacatatcagtgagaacataggatatttggttttccatttgtgagttacttcatttataataacagtctccaatctcatccaggtcactgcaaatgctgttaattcgttcctttttatggctgtgtagtattccattgtgtatatataccacagtttctttctccactcattgactgatgggcatgtgggttggttacacaattttgcaattgcgaactgtgctgctataaatgtgtgtgcaagtatctttttcgaataatgatttgttttcctctgggtagatacccagtagtggcattgctggatcaaatggtagttatatttttagttctttaaggaatcttcacactgttttccatagtggttgtactagtttacattcccagcggcagtgtagaagtgttccctgttcaccatatccactctgacatctcctgtttttttttcattatggccattcttgcaggagtaaggtggtattgcattgtggttttgatttgcatttccctgatcattagagatattgagcattttttcatatgtttggtagccatttgtatattttcttttgagaattgtctattcacgtccttagcccactttttgatgggattgtttgtttttttcttactgatttatttgagttcattgtagattcaggatattagtcctctgtcagatgtacagattgtgaagatttcctcccactctgtgggctgtctgtttactgtgctgactgttccttttgctgtgcaaatttctttagtttaattaggtcccagctatttatctttgttgttattgcatttgcttttgggttcttggtcatgaaatccttgcctaagccaatgtctagaagggtttttccaatgttatcttctagaaattttatagtttcaggtccttaatccatcttgagttgatttttgtatgaggcgagaggtaaggatctagtttcattctcctacatgcggctagccaattatcctagcaccatttgttgaaaagggtgtcttctccccactttatgtttttgtttgctttgtctaagatcagttggctgttaagtatttgggtttatttctgggttctctgttctgttcctttggtctatgtgcctatttttataccagtgccatgctgttttggtgactatggccttatagtatagtttgaaattggttagtgtgatgcctccagatttgttatttttgtttagtcttgctttggctatgtggctcttttatggttccatatgaattttagaattgtttttttctaattctgtgaagaatgatggtggtatttttatggggattgcattgaatttgtagattgtttttggtagtatggtcattttcacaatattgattctactcatccatgagcatgggatgtgtttccatttgtttgtgtcatctatgatttctttcaacagtgttttgtagttttccttgtagaggccttttgaccccttggttaggtatattcctaagtatttaatttttttgcagctattgtaaaaggggttgagctcttggtttgattctccacttggttgctgttggtatataaaagaacaactgatttgtgtacattaatcttgtatccggaaactttgctgaattcttttatcagttctaggagctttctagaggagtccttagggttttcaatgtaaatgatcatattgtcagccaacagtgacagtttgacttcattttaaccaatttggatgccctttatttctttctcttgtctgattgctctggctaggatttccagtactatgctgaaggagtggtgagagtgggcatccttgtcttgtgtcagttcttagagggaatgatttcaacttttccccatttagtattatgttggctgtgggatggtcatagatggcttttataacataaaggtatgtcccttatatgctgattttgctaagagttttaatcataaagggatgctggattttgttgaatgttttttctgcatctattgagatgatcatgtgatttttgtttttaattctgtttatgtgctgtatcacatttattgacttgtgtaggttaaaccatccctgcactcctggtatgaaacccacttgatcatggtggtttatcttttctatatgttgttggattcggttagctagtattttgttaaaaattttagcatatctatgttcatcaaggatattggtctgtagttttcttttttggttgtatcctttcctggttttggtattagggtgatgctggcttcatataatgaattagggaaggttccttctttctgtttcttgtggaatagtgtcaaaaggattggcaacaattcttctttgaatgtcaggtagaattctgctatgaatccatctggtcctgaactttttttgttgttggtaatttttaaattaccagttcaatctcactgcttgttaatggtctgttcagggtatctaattctttctggtttaagctaagagggatgtatttttccaagaatttatccatctcttctaggttttctagtttatgtgcgtaaatgtgtttacagcagccttaattgatcttttgtatttcagtggcgtcagttgtaatatctcctgtttcgtttcttagtgaggttgtttggattttctctcttcttttcttggttaatcttgctaatggtcaatcaattttatttatcttttcaatgaaccagttttttgtttcatttatcttttcatcttttgtattttttttggtttcaatttcatttagttctgctgtgatcttggttatttcctttctactgctgggtttgagtttggcttgttcttgtttctctagttccttgaggtgtgaccttagagtatcagtttgtgccctttcagtctttttgatataggcatttagggctctgaaatttcctcttagcactgcctttgctgtatcccagaggttttgatagattgtgtcattattgtcattctgttcaaagaattttttatttccatcttgatttggtttttgacccagtgctcattcaggagcaggctatatcatttccacgtatttgcatggttttgaaggttccttttggagttgatttccagttttattccactgtggtctgagagagtgcttgatataatttcaattttcttaaatttattgagactcgttttatggcctatcatatggtctatcttggagaaagttccacatactattgaatagaatgtgtattctgcggttgttgaatgaaatattctgtataaatctgttaagtccatttgttccaaggtatagtttacatccattgtttctttgttgactttctgtcttgatgacctgtctagtgctgtcagtggagtattgaagtccctcactattattgggttgccgtccatctcatttcttaggtctattagtaattgttttatgaatttgggagttccagggttatgcatatatttttaggattgtgatattttcctgtcggacaaggcctttaccattatataatgtctctctttgtctcttttaactgccgatgctttaaagcttgttttgcctgatctaagaatagctactcctgctggcttttggtgtccatttgtacgaaatgcccttttccatccctttaagtttatgtgagttcttatgtgttaggtgagtctcctgaaggcagcagatggttggttcatgagttcttatccattctgtggttctgtatcttttaagtggagcatttaggccatttacattgaatgttagtattgagatgtgacgtaccattgcatttattgggctcgttgttgcctgtgtacttcagtttttggtttgttgtttttgctttttaacttgtatttttgtgttataggtcctgtgtgatttatgctttcaagaggttctgttttgatgagtttccaggatttgtttcaagatttagagctctttttagcagctcttgtagtggtggcttactgatggcaaattatctcagcatttgtttgtctgaaaaagactgtatctttccttcatatacgattcttagtttcactgtatacaaaattcttggctgataattgttttgtttgaagaggctgaagatagggccccaatcccttctagcttgtagggtttctgctgagaaatctgctgttaatcttataggctttcctttctaggttacctggtgcctcttaggattcttaccttcatcttaagaatggatagcctgatgacaatgtgcctaggcaaagatcattttgtgatgaatttcacaggtgttctttgtgcttcttgtatttggatgtttaggtctctagtgaggccaggaaagttttcctggattattcccccaaatatgttttccaagcttttagaattctcttcttcctcaggaacaccgattattcttatgtttggttgtttaacataatcccagacttcttggaggctttgttcatattttcttattctttttttcattgtctttgttggattgggttaatttgaagacattgtctttgagctctgaatttctttcttctacttgttcaattctattgctgagacttccagagcattttatatttctaaaagtgtgtccaaagtttcctgaatttttcgttgttttttaagctatctatttccttgaatatttctccattcacttcttgtattaatttttggatttccttgcagtggacttcgccttctctgatccctccctgattagcttggtaactaacctcctaaattctttttcacataaatcaaggatttcttcttggtttggatccattgctggtgaactaatgtgatttttttggagagtgttaaagagccttgttttgtcatattaccagggttggttttctggttccttttcatttgggtgggctctgtcagagggaaggtacagggttgaaggctgttgttcagatctttttgtcctatgggtattcccttgatgtagtactctcccccttttcctatggatgtggcttcctgtaagccaaaagtgattgttgtctcttttccagatctagccacccagtgagtctactcgactccagacaggtactgggggttgtctgcacagagtcctgtgagatgaaacgtctatgggtctctcagccatggataccagcaactgttctggtggaggcgacaggggaatgcagtggactccatgagggtccttggctttggtggcttaatgttctatttttgtgttggttggcctcctgctaggaggtggcgctttccagaaagcatcagctgtattagtgtggaaagggaccagctgtgggcggggccctagagctcccaggattacatgccctttgtcttctgctacaggggtggatagggaaagaccatcaagtgggggtggggctaggcatgtctgagctcaggctctccttgggtacatcttgctgctgctgctgtaggagatgggggtgagattcccaggtcactggagttgtgtgcctaggcttagtcatgcaggttgtcagggaagtgggggaaagccggcagtcacaggcctcacccagctcccatgcaaacctaagggccggtctcactactaccatgctccccccaaccctgccccctgccccctcaacagccctgagtctgtttccaggcggaaggtgagataggcttgaaaacttgccccaggctacccaccacccagctgagaaagaaaaaaggcttggttcttcccctgcctgtggagtctgcaaaccagatttgtgccctcctctgagttctggctaggaagcgtctggccctgttcaaattgttacaaagttcagcgggagatttccttcttcctgtggagttttaccccccgctcctctggccaccttcctgatggatccctgtggtgccaggcaggaaggggctgctaggggacacagcaagctcccagggcctttctgctgcttcttctacccatgtatttcactcagctctctaaattgactcagctccaggtaaagtcagaaacttctcccacaaacagaacttcagcttctccagtggtggtgtgtgtttgggagaggaaggtctccctttcccacttccgcagttggggcactcacagtatttggggcatctcctgggtcctgcaggagcggtcgcttcctttgcagggtctgtgagtcctctcgggattgctggtttgttcttgcagttgatctggagctaaaattcataatgcaagcctccgcatgctgccttgtctggagctgcaatctagtcctgcctccggtcctccgtgatgaaggtgatatgcattatttttccttatttaatccttatggtcactttatgaggtagaaactattatcaactccatttttcaaatgagaaaactgagggacaagagaggctaagtaactgttaagtcaaggatttgaacctggacataaacttaaggactgcccctatggcacctcattctctgccactatattgtcttatccgtgcttgaatgttggggtacaatgatgaacaagcacactccctgcatcaaggtgctcatcagacaggcggagcaggcacctgcaacatagtatgctgtgggaactctcggcagaggggttctgggggctttcctagggaagctgtagctaagttttagcacagctaagagatgttactgagaaacgattactcaggagaggggggctgtcttagtcttttcaattgctaaaacaaaataccacaatattgtggctcataaacaatagaaatgtatttctcgcagttttggaggctgtgaagtccaagatcaaggtgccagcagatccagtgtctgcggagggcctattttctggttcatagatggtgccttctcactgtatcctcaagtggtagaaaggacaaggcagctttctgaggactcttttataagggcactgtcccattcataagagctctcatgctcgtgatctaatcacttcccaacgttcctgccttctaatgccatcaccttgggggttaagacttcaacatatgaatttgggggaagagacaaacattcaggccaaagcaggggtcaaaaaagaaagaaaggtctttctgagaagagcatatgaaaatgtccagagacgagagagaatgtgccattttctgcaaaaagttcagcaagaccacagaggcaagttcaagaggggaatggtgagagagatgtgtcagcaatcaggaacttgggtcaagtcacacagtgagcaagtaagtagctgagttaggatctcattccatcactttctgcaaaatacatgctttcctctactcctttgtctaccttattcttttcccagtgctggacttggctgtgggcctccattactcttacctatgcacagaaaggaaaggtctagaggaagggactgcagatgggtctctgggaagaaatgtagacacagtggacattcacacagcttttatgccttctcagtatgcttcttcctaaaaggggtggctggggaagtagggggtcagtctagggccctcaattatgctgcatgctagaaaagagccaccagcactccagtgatccgtaattgctaatcctgaagacatgcagtgactcctcctgtgacaccaaagggttccatatgttatccagatggtcagcaagaaaccatacgtgggccctgctcttgcaactacaatgaggagacattaaaatcaaactattatcacttaactttggaagataacctccaaagaagggaaaatgcaatgtcagtgttttggagaaccaaaaaaaattatgtagaattatttataagatgggtgcttccttacattattaaaggaaagattagaacaaatgaaattcagagtttgagagattacataaccactgggaccttcacagcctgcaatattgactctcacagtattccactgcatgggggctgggataagaaagagatcagagtgttgatgaaaatgactttcgtgatgtgcactcatctgcattttacagctcaatgtcctggttttactaggacaagttgctggagtcccattcattttacaacatttgtgaagatgtattacataaatgcaatctctggctgaatgttcaatgaaagcccactgtctcacttcccttgatagttaatactaagttgtgcattatcagggtttcagacttattacttcagtttgccttatgggctttgttgctacagatctgcatcacggtttccctgtagctttatccccaaagcagttttttaaatccactgttactttaccccatggtaagaaatgcctcatggtattataaacaagcagttgaaaattgttatttatgtggcttcctaatagcaatttgaaatatagggcataaaattactagcttacaacattgttcaatattaacagtgggaagggtaatatgtaaaacagacattaaaggattagctgcaaaatacatttcactaagctaaatcatttcttggcaaatggcagtttccagctaatacacaggattcatcaagtcaagtggatttatttttatttttctattagtttgttaaatatattctatatttaaacttcaattttgcaggtttctgtttcaggcatattagaggaagcttctggaaacagaatccgagatagaagtgatctcaagactttcaactcaaagctgctcgtcgatttccccagcaaatcttctgagttgactaaagatgagactgtaacatctcagagaaaagtgcatggctatgacattgcaaacatttgtatgacagattaggaagttacaagtgcatcagaaatttcactaaaaaggcatatcttccccaagacataaaacaatgtttccattgtttttgcttcagactctacagacacacaacactctgttctaatcaagcatgtctggagttccgtaaacaatgtgaatctgtgaagcaggcacccagaaggaaggtaaagagaaattcctaatctcctagggtggaaattgtgaagtattaagcagatattcaatgcataaatataaataccataatctctctgagacagtctgtagttaccataatcctaaaattattccgtcttctcaaatccctaaagatttatcaattttcataaagtactttgatggaaacttttttcaagatgcaaagttatctttctctgagctttcctttcatattataccatgtgcagtatttgcaacctcggagaataccaaaaatgagttcttatttttcagagaaattggttatggatctataaataactattacaaagaaatgagcattatagagagaagaagctgctcttagactcatttgagaaactatggggaagttcagattcccaagactaattattattgtaaaattaagggtttgctttgaacacttgttagtattcagccgattttaaagacaacaatttttttcttagactgtgggttggagactacaaatattgctcctcaaataccccatgttaataattccaggggtttaaaaacatttattacatataaatctatagtgttttatttagctatttggtgtgggatggtaaatttatttcataaaccctttcctaatggtagaaaactaaggaaataagatgccctttaacttgaatgtacaaaaatttagtcattgtgtaacatgtgaattacttattcaaaaagccaatggttgagtcacagaagacgtcaccaagcccagtgcatcatcaagctctacattggagcaaagcccaggtccacacgctgtggttaatgttaactgccttatcaaaatagctcaattgattggaatccaatagaccaaaattctccattacagccaacatatttgaaacaaagaggataataactatacaactagcttttcaacatgcaggagaaatcctgggctcagcctcaccaatgagcttccctctccatggctacatccataaccagggaggcaggaaagcaggtggccaaaggtgtcatcataatcttgggtttaaatcctggctttgtgtgactagggcaagccacttcatcttttgagtcttcatttcctttagggataataataccaatactagctcacaggggcttaccggaaatttcaaattcaagagatggagctcttggattcgtaaggttgtggtgaggatttaattaaatgcttgaagactgctagctgtttttaggatctggggcacaatttgtggggcccagagaatcacctccactgaagaatcaccctttcggcagcaagctaaaaaaagtgcaaagtcaatagcagagtgttcagctgaggtagaacaaacacaagtagcaagcggaagaggggataggtaaatgcttcagtaggttcgttttgccaatgctgagtcacagttgctttacagtcagaatgtcgggagcggcttgctggaagcccctgcttgtttcaatggatttcctttcctttctccacaggagggctgtccatgccctgaaaggcactcctcccttgacaggaagtacgggaggacttccctgctgaggcggaacactggctccctcacaagatggcctcctgtgatggtgagcagagctagtgtcttcatattcttccctctctgctcacccacctgacatttctgccttgtctcacttgcctgaacactcctcagttttcctgatctggaagctaactggatgacacttgtcctgttactacccatggtccctaatatgacacggagctatggaccagctcttagcaaaacccctgagcagacaatcaatgaaggtatataaaatggcaaatgaagacttgagaattctactccatataatccttcctgacgaatctccaggaactgacagtttcctttgccatagcactatctagacatgacctctcaaagatacaaataaataagagcattccatttctcctattcccttccttgaactgcaaatgtctatctataattactaagtataattacaactgttattatactgtcaccacgtggtactggtaacacatatcttacaatatgaaaatccttaaacaacttctttcttactgattttaccgaggaccaagatagactatgccacatggcaccaaagtaccatgtagcctgctgctggtccactgagtgactgtgagagttttaaattccttttcacatttacttcttgaatctgtcactagactccagaatcatctgaaggaatcaggcagttctcaataccatctcattattgacatttatgttgatcgatgttggctcttacagaattggaatctacagatgaatttccttattagattctttctcacggctgccataatcattttatcacacaggctgatgctatcaaatgctggtttatcactacgtaatgggacaagctaaattagttcctctaatatgttacaagaaataaaaaaaaaaattcctggttttaaatctcatttttctcaaatcttaagaaattccctgatgtttttgtgtataaagaggttaatttgaacttattctcccttaaaactgtgctccatgggagaccaatggtgaattctaagagcaactcacaattctcctggaaaccatttttcctttcctttcagagagcttcagatgtcagattaaccttggccaactggataagcaggggttcatgtcagtgcctctggtagggttcccagcgcctggccaggtagctctacataaaggaggagtaacaaagcctccaacactgcttcacccacaactgaccatacaatggccaagaaaataccagtgtggtttgtgtccacagaacccagccctactcttaggaagacaactcagagtgtatgcttcactaagaaatggtcgggaatgacatcaaatataaatcaaatttatccaaatattttctaaaggttaatgttaaattctttatttatttatttattttttaagacagggtctcaccccattgcccaggctgcagtgccgcggcatgatcatggctcactgcggcctccacctctcgagctcaaacaatccccatgcctcagccttctgagtagttgggactacaggcacacgccagcatgcctggctaatttttgtgttttttgtagagatgcggtttcgccatgttgcccaggctggtttccaactactgggctcaagctatccacctgcctcggcagagtggatatcttgaatcccaaagtgctaggattaccggtgtgacaccatacccagccctaatgctaaattctgtataggaagaataatctaagcaattgtcctgtctctacagacttataatttttaggatatggataatgcagattctcaggagtttctgaaatgagacctcaggaatccatgaatagggccgggtgcactggctcatgcctgtaattccagcactttgggaggccaaggcaggcagatcaactgaggtcaggggtttgagaccaacctggccaacatggtgaaatcccatctccaccaaaaacacaaaaacaaaaacaaaaattagctgggcatggtggcgtgcgcctgtagtcccagctactggggagtgtgaggtgggaggatcacttgaacccgggaggtggtggttgcagtgagccgagattgtgccactgcactccagcctgggtgacagagtgtgacctagaattcaagatatttataaatttggatggaaaaaaaatgcatctttagtttcattaaacttgaaccaaaattcagtatttccttcagttatgaatggaggcatcaaactacagtgctataaacttgtgactttgtctccaacagaaattacagacattttatcatattatagctgttgaaaatatctctaaatattgtgtatgtgtatcactatttaaaaatcaagttgaacttgcctcttgcgcttgctatttcatgctttagaaaggaagcacacgtattaccatctcatatatgtttttccaatattttggcaactgtatttcaatgtaattgcctttctttataatcttatgtcttttatgcattaaaagcattattctgagaaagaaccataggcttccttgatctgaaaaaaaaatggtctatggttaaaaattggttatgaacctcactgctccccaaccctctgtcttatgttgcatatggcatggagcccttctgttgtggctctgacttcccacatgtgtgaacaggaatgggtgaatttcagggattctgagtcctgccatttacctctagaacctggagtcactggtcctggttgggggaggaacttacgttaattcaaatctccactaaaataaattagctttcttctcattgccaagcagagcgctacagctatgactgttatgtattgttgcaatctagaccttaatggcattttagccctgtggtgagctcaagagaaactattttcaaacttcaaaaggccattaaaacatgtgcagatgtctggaaaattaatactattatctaactctcaccctttgcctgtaggaggcaaagaagaaacaaggctcaagaaagatactagagatcaatacacggtcataaagcaaagagctgtccttctagggagcacggatgaggatgagtgagaaatcccacagtgcttctgaagaggctttttcattagatttttttttttttggttgaagtcattcacttaatctgttaaaaatttaaagagggaatgaggatgggatggaaagtggaaggagagagaaaaagataaagataattttctgccaccctacttcaatttggatgttcaaggtccagaattctcaagagtggaagtattcattcattcacacgacaaaacctgaatttgtcaaggttaatgttgaacaagctccagtctgttttaaagcaaaagcgttttgcatcttgaaagatttgagctgcattctgtaaaattctcagtgtagggaggtattctcataggtagtttcaaggcttttataaagttttcagaaccacaggatattctcttcccttccttcattttattcccaacaaatgttatgctataggtgtcctaggtattcccaaaaacctagaaaaccagacttaattttttaaaatcagaggatgaaagctttatattttattaaaacatggagaaagtttttcaattttgaaagaggacagagaaatgggatagcaggtatttttagtaagttttttgttttgttttgtttttgttttttttttaagagacagagtctcactctgtggcccaggctggagtgtggtggtgcaatctcagctcactgcaaactctgccttccgggttcacgccattctcctgcctcagccacccgagtagctgggactacaggtgcccgccaccacgcccagctaatttttgtatttttagtagagacggggtttcattgtgttagccaggatggtctcgatctcctgaacttgtgatctgcccgccttggcctcccaaagtgctgggattacaggcgtgagccaccgagcccagccagtgttttttttgttttttgttttttgttttttttaaatataggtaaagctgaacattggaaatacattgagaatcctttacagaatattacatggattttcctctctgcatagccctttgtaagaaaacctgaaaacattcacagactgtgggtaacacatccttttaaatgggaagttttccttttaaattcaagaataagcaagatgggctgtgttaatcaggattacacctagctttcagggacagaagaaaagattttggtggcataaacatacaagggtttattttccttaagctagaaatccagagataggttgtcataaagattttggaggttgttactgcataattatttgggcttatcctgcgtgataagtgaggcaacataaaatgtgccagcaggaccaagtggcaaatatagtctgaaacagggtcatctatcagaaatctctggaccacattttaattttattgaggtgagtgagatggtggagaggagacagggtgaatgtggagcttcaaaatggatggatataacagtgtgtggactcacaccatgatcttttgctccaagaaccaccatgaaacataccggaaaaaccaaaagaattcacagatcctttgaaaggagtactccactgcaaattccatgaaacaggtgaaaaactgtgagttcccaaagcgtgagggggagaaactacctctgaacacacatccccactggggaatctgaaaactccagatcacccacgggagaaggatttaaccttacctagggatgaaacaggtttagggagttgtgagaaatatagaagtacaagtagcagtgagaagtgccttgaacgcactcccagcttctagcttaagccccaggaagccatccctgattatacctcatgggggccctctgggaagacagccagaggaattgtggaggggttgctgggtaaaggaaactctcaactgaaattggtagtggtttcaactgggcacaaattctcttgagtggagtccaggggaccagcaggagctgttgtggataggagtgagctagcgaaggagctactgcggacagagtggacagacaggaaggggagaggtctgaaagccatgcttgctttctcagctgggtagctcacagtctggggcaaagtgtgagtggggaactgcaggagtgagacccacctcaccaactgcctgggagctgggtgaggctatcccccacttccctggtgaactatataacacagcagagacagccaacatcccctctggaacataaccccattggcctgagaatcactcccccatgccccacagtggccgtggcaagctccacccaaggagagtctgagcccacacctgcctaaccctgccctgactgggtagtacttccttacctgccctggtagctgaacacaaaacatagaaactcttgggagctttatggccccacccattacctgaaaaaccaaaatactctggccatcttagggcaagcttagagtcccctactagcatcttggctgctgctctcttgaaagtgccacctcctggctggaggccaacaaactcaggccattacagcaactcaggacagaatcaccttgatcccaggaagaagacaaaacttgattccactgcctgcaacaccttggctaaccagaggtcctgagggtgtccatgtgacaacttcactgctagcataaccagtattcaagaaagccagcacattgaacatacgtataaccatggacacttacagagtccacttcactcccctgccacctctaccagggcaggtactggtttccatggctgagagacctgaagatggaccgcatcacaggactttttggagacattccacagcaccagcctggagcctgatagccctgctgcatggatagacccagaagagcaacaacagtcactgcagtccagctctcaggaagccccattcccaggggtaaggggagagcacatcaagggagcaccccgtgggacaagagaatctgaacagcaggcttggccagtaggtctggcctctccattgaattagtctacccaaatgagaaagaaccagaaaagtaattctggtaatatgacaaaacagggttctataacaagcccaaaagatcacaccagctccccagcaatggatccaaactaagaagaaatctctgaattgccagataaagaattcagaaggttgattattaagctactcaaggagatacaagagaaaggtgaaaatcaacttcaagaaataaaaaaaatgggaaatggatacaaaattatccagagaaatagatatcataaagaaaaacaatcacaacttctggaaatgaaagacatgcttagagaaatgcaacatgcagggagagtttcaacaatagactaggataagtagaagaaagagcttcagaacttgaagtcaaggcttttgaattaacccaatcagacaaagacaatgaaaaaataatttaaaaaaatgaacaaaacctctaagaaatttgtgattttgttaaatggccaaacctaagaataattgatgtccctgaggaagagaaatctaaaagtttggaaaacttatttgtgggaataattgaggaagacttggccttgctatagagatctagacattcaaatagaagaagctcaaataacacctagggaattcattgcaaaaagatcatcacctaggcacatagtcatcagattatctaaagtcaaaacaagggaaagtatcttaagagctgtgagacaaaaccataagataatctatacatgaaaacctatcaaattaacagcagacttctcagcagaaatcttataagccagaagggattggggtccaatcttcagcctcctgaaacaaaataattgtcagccaaggaatgtgtattcagtgaaactaagcttcataaatgaaggagagataaagtctttttcagataaataaataccgagagaattcatcacaactcagtcagcactatataaaatgctaaaaggagtttaaaatcttcaaagaaaacctcagaatacaccacaatagaactcccttaaagcataaatctcacagggcctataaaacaataacacaatggaaaaaaaacccaaggtattaaggcgacaactaacatgatgaatagaacaatacctcacatctcaatactaatgttgaatgtaaatagcctaaatgctctacttaaaagatacagaatggcagaatggataaaaatccatcaaccatgtatctgctgtctttaagagactcacctaacacataaggactcacataaacctaagggatggggtggaaaaatatactccatgcagatggaaaccaaaagcaagctgacaaaacatactttaaagcaacaacagtaaaaaagacaaaagagggacattatataatgataaaaggaataatccaacaggaaaatatcagaatcctaaatatatatgcacctaacactggagctcccaaatgtattggggtgactgtgggtaatacatctttttggatgtgaatgttttcctcttgaagttcagaataaataaggaatatctcaggatttcattcagctgcaaaaacaaacaaacaaaaaacagaaagcctcacttaacagttacttcagcttatagggatttatatttcttacatagccaaatgtccagaggtaggcagtccagggcttgtgtaacagttcattgatcttgtcaaggaactaaactcttcccatctttctgctctgctctgccctcttttactaggggctcatgccaagatgactgctgcacatcctggcattgcttccaccttccagatagagagaagggttaagaggggatgaagaacatctagagccatatctgtccctcctttatcaggtaacataagttttgtcataaatctctatggcagatttccttttaggtctcataggccagaactaggagaaaaggaggctgagaaatagcatatttggctttctaatctctgaagtagaagaaagaagggagaagaatattgattgtgtatggtggtcacaagtgctgcctatcacataaatctagctctctttccttttgggagtatgttcatcagttgtgcttcctgacccctctgtggttgggtggggccctgtgactagttctggctaatgaattgtggatggaatgcttcaagcaagagcattttaaatacagatgtgaaaccccctcagagctttcatcttgctggcctagtgactggcaatgtttgagatggtggctggtccatcagcaaggtctcctgagtgtttaacatgtgcacagcaagactgatgactcataaaagacatgtggcatgagaaagaaatagacttttgtatttgaagccatggagattttatggttgtttgttaccacagcatgacctatcctattctaactgattcagtgagtcaacttgaaatgtcagcagccataagaacaagttggagaggcaaaaatagtttcagtttcagacaaggcccatgtattagagatccctgaaaaccaacatagatctcagtgggacaatatcctgaagccaactttctctacttcaagagcagttaagtggactttaattcataatgttacacagctatcctcgtactgcccacaggacaccgacaaataatctccctctccggtgtctctacataggtgagtggctaatgaaacatagcatgttcaaggtaagccaccacatttaatatgaacttccaggatgaccatccacaaaaatttaatgcatgataatgagggatggcacagtttatgaccagccttgttaacgatatagttcacatctccacccctaagaggaagacaaaaatctggagggggaagggaggtgactaagagttaaaacgttaatggcctcttcagttacactgagtgtctgatttttatctctaaatacagtatttcacatcctcagcaaaatcaataggaatgtattcaataggacaggacttttccataaggactgaaagctaccaatatcaagccattttaacagagggcaagtcatattatgggagaggaaagagaacattagcagaattcagtacaaaggaggtgattgcttgactagtgatttcatgtttcactgttgctcacgctccattttaactactatccctggtcttactgtgagatgggaggagctagccatatggatttatgctggcaaaactgttgtttccacagcagatggtaacaaaaaatcttacacaacatacttatgtgctaaaaatcacttaacgtaattgtagttaggttaatctggcttgaaatgcatagtgtaatgtatgcagcaaagagaacattaaatggtgacaagtgtaattactgatgtagtcccttccaggcagtcatgctacagtgctcacttgcaaagggcaaaggctagtttggaaacagcaagggaagaacagaaagccgttgttgcacgatgctttacttctgtggagttttcaattgcttatttaaaaggaggtaagagataactaatcctttgcttttgtaaaatctatgtatgaactgctttgctctccatgaatgtgtacacaccttgtttctgtggttgtcatctttggagtgtaaatttttaaagccaaaataaacattacatatttaggtacattaataattattatactaaatagttatggtcccttttaaagatttcagtggattcccactctatcacaaaggcataaaccctttaaatctttgaatcatttaattttatgtattcttttggtattccatttgggagttatggggtgtgaaatatgcatcatgatgagaaaacaattaaacagcacacctgttgtttatgcatattgtactcaggaagggccttctggaaccattatttaattccccagtatggtgtcaaccaaggggctattagaggtgacctgacaacaccaaattatacttttatttgtattatgtgacttgtgctttgccctcctgttagaatgatatttacttctcaagtcaaaatcatgtttgtgacccataataacaattagtgagactttcatgtttaatagaaaaatattagctcacatttgctacagaaggagtgagtagtgatagaattataagagcagcagaggcagtcaccatttaatgagtgcctcccatgcctaggtaaatcaagcagtttatagatagattaaggagaaaaataggacatcctgggtttattcacaatacaggagaagaaatgttctttttgctacattttcattaacagaccattgatagtagaagttcactgtaagtttaacaaaccctctgcaagcatctgcagtgcgatgggtgctgggcaaggcatgaaagacaaggcgagagcagaggtgggggaagagaaagtattggtacttagaggcaaactgacactctaggtatcgacagaggcactgatacgtgaaaagggaagaaaagaggctgcttttcatggggagcagaagactgcatggtggtaaatgtcatgagtgtctgtcattcagatggagatggagtgtatagatatagtcatggaaaaaattacaactgcaacagttaaaatgactgagcatttactgtatgacaggcctgacctcactccttagatgtgatatatatttttttaatttaaaaaagagcattatttttttcttgtgacaaaatatatgtacaacacaaaatttaccatttccatcccttttaaatggataatccagtggcattaagcatctttttatgtgtttgttggccatttgtagatcctttttggagaaatgtctattcaagtctttgcccacttttaattgtattttttagttaagaaataataattgtacatattcatggggtacatagtgatgctgttacacatataatgtacagtgatcatatcagggtaattagcatatccatcatctcaaacatttatctttccttatgtgatactttaatcctcgcaacttccctatggggtggatagcattattagccacattttacagatgaggaaatggtagtagagggataaaataccttgtccaagttaaaaacctagacagtctggctccagagtgtgtgtgcttttcatctatgtgctataaaaaaattactcaacaagacattgttgtgatcacactaaaaagttcataggattctcggtctgtgctttctcatggccttgatttcctttatactgattcttatttttgaataagggcctctaagatagacaggtttaaatgtatttcagctgagttgctgagatttaatggagctgccacttgggtttttcaaagcccttacaaggccaatggttgaccctatacctgctggtagtccttaggggaagcagtacgatataataggtaaaactttggctttgaagtcagattgaagcacaaacccaagctgaggtcacaccagatgtgtgatcttgtttattcatctgtaaaagagagagattatttccttattgtattttcatgaaaaatggagacacttcaggtaaggtactgcagtaagaacagtcctcgccagactgaatctgctggtgccttgatcttgaactgtccagcctctagaactgtgagaaaatacagttctattgttcataaatggtccaatctgtgctattttgttatagcaacaggaacagactaaggcactgatatggtttggatttgtgtccctgcccaaacctcatgttgaagtgtaatccctagtgttggaggaggggcctggtgggaggtgattggatcaagggggtggattttccccttgctgttctcatgatagtgagtagttacagcgagatctggttgtttaaaaatgtgtagcacctcccccttctctctcttgctcctgctccagccatgtaggacatgcctgcttcccttttaccttttgccatgattggaagcttcctgaggcctccccagaaacagatgccactatacttcctgtacagcctgtggaactgtgagccaattaaacctcttttctttataaattacccagtctcaggtatttctttatagcagtgcaagaacagactaatacaggcacttaatgtaatgtgtggaccacaaggagtgtacaacaaatagtctttattatcatgggtcacttcagagtgcgtgtgcttggtctaatcccagaaggcaattatctctctcaagcttccacaggtagctcagcacacaacactgagaagcaggtgtttcctgctggcattttcctatccaaccttcctcaggagtcctgccctagatgcccaatacacccattgccttcctagagcccaagcctgaggcctgtggaggcttgctctggttgttagtatcctctcaccttggtttccagcaatatggtgatgtcagctcaactgtcggctaggagactcagcatcttacaaagaaaatggggatgggagactgacataaccagtaacgggagaaaggtgctcatgaatattcttttacaataataaaaacaacgacaatgtcagctcatcagatgaagaaaatgtcagtcgtgttgtatttattgaatattagtaataatgagtataatacaataagtttaaatatttatttaagcatcaaagtaaacagcatggcttttacagtaaactaagggttgatttataggcttattaagtgtatgctttgtggaaagtttgaagctcatttcgttatctgtaagatgggagcagcaacgcctaccttatggaatgctgggggaaatgaatgagatgattcctaaaaagccccacaggagatactcaataagtggtagctgttgttattatctagaacacggatttgcacaccacaacctatggacaaaatccctgcttttgtaaatataattttattgaaatacagtcacactcattcatttacatattatctacatgagcttttgcctaccactgcagagtgagcatgcctgacaagaggccttacagccagctctttgctaaaatatttactatatgaccctttacagaaataaatgcttcccgacccctgatctggaataggggttctcaagctgtagcgtgcatcaggattacctggagggcttgaaaaagtcagattactggacacctacacccagatgttctgaatcaggaggtgtagggtgggcccgagaacttgcatttctaaaaggttcccaggtgatgctgctgctgttggtggtggtgcagggacctcagttgagaaccactgattctgagaaacttttcaaatttctcttttctatgacttcaataggatacatacacatcattaggtttgtttgtggctgttgaaatacacataagaggcatttatttactctgtctggtgctctggtaaattttcagggcctttccagatttcgtctagtgatgttgactttccccctcttagatcctgccacagtctgaaacacaactgataaaacacaagctttctgctcctcttacacaaacttattctgggtcccatctaccaaccgaagcagaggaacatttctaaagtctgggcattactttctttctacttcctttctccatcctctaaggccttattgaaaacaaatcattctcatgctagtctttccagctcctttccaattttcaaaaattattttcaacaggatacagagcagtaaaagttatccaaaaagttcttgtaaataggactctcaattattttagtttttaatgtggagggggatgggagggggctggagtagtaaactggctcactggtgtttctggtgattatgctcagagtctaaggacagactgttgcttgcaacagtctaaggacagtctgtttccccccttgcagtgctgagagaaagtcaggagggtaaacagtatctcactcccgaagaacaaagggctgaggtggaatgggagctccgtgaccaccagcagaagaggtattttgggcctataaggcacttcccaaatcacaccacagagataagagcacagatgagcctgttcttcccatctattgcatacttgcatatcctgaatattgcttccagcagaatggtaaataatgcatagctgctttctctcactgggagtgacaagggtcccttctgaccgatcacttcctgcagttgttaaatgttagaacaacaaaaggcagtaattttcaaaagaatatgacaaggatcagtagcatttcatggtcttttaatttttaaaaactatacaatatgtgaaactattcttataataaaatatcagataatgtaaaagtgtatatagtaaaagtggaagtcttttttacaatgcttccctccccatctcaccccccttcagtcctgttgtctcctgccagaagtaaccattgtttatatttgatgtggatccttccagaacacttccaatgtatgcaaatttgctaacacatatttaggttttaaaaaacataaataaatggcacagtatgatgcacattgttccgcaacttcttttatgtaatagaatattttgggattctttctgtcagtacacggagatcagttttactcacttttcccaccgcatggtgctccatcacacggaagaaccattcttggcttaaccttttccccactaaactttattttggttatttctgattctttgttgttatgaacaatggggcaataaccattctaaaacttaaatatctacttgtgtacaagcatttctgcagaagagatatcaagaactggcatttctggggctgatatgcatacttaaatttttgttataaagagccaaattacctttcaacaaaagtgtagcacccacttatcacactctaaatactggatatcaatttttaaaatatttgtcaaccaacaatgttgtttgattgctgttttatttttatttctctgttcattgcaactgtacttgaatgtttattggatatctgctattttctctgtgaattgcttctacatagtttttgatcatttttcttttggtttgtttgtccttattgactggtaggggctctttatatattaatagtatggatattaatattggaatttttccctctctgtttcttgtcttttaactttatttacgatgtcttttgcaatagggtttttgtttatttggttaattggcttggttttgtatttaaatatatcatttttttcctttgtagcttctggattttgtatcttgcttaggaataccttacctaccaaaaaattataaacatactctgatattttatatgtaatatattaatccatcagggaatttacttgtgcttatcttgttacagctataatgaattttttagaaatacattgatgaatccctattgtttcatctattgatttaaaataatatctctatcataaacaaaactcccatttaaacattgtgaagatattttccttctttcatttattgttctactattgagccatatcatactgtgttggttgtagctttataatttgttttgaaatttggtaggcaagtcccccttcatgctttcttttgcaaaaattttcttccagttcttgtcaaaatctgtaaaatagcatgatgggattttgatttaatatttttaatttttggaatattatctttaaattattgagtcttcccatgcatggacattgtatcattctatagtaaagctctcaagtagatttgttaataggcatttcatagagtgcttgttactattaatgtctttcactaattacattttctaattaatcattgctggcatgtagaaatgctgtggtttggttttatatatgttttgcatgtatatatggggtacaagtgcaactttgttacatggatagattgcataatggtcccattagagcttttaaggtattcatcagccaaataatgtaccttgtacccattaattaatttctcatcatccaccccccagccacaccccatccaagtctctactgtctataattccattctctacaaccatgtgtacatatattttaacacccacttatgagtgacaatgtgtgatttgactttctgtgtctggcttgcttcacttaagaaaatgacctccagttccattcctgttgctggagaagacatgatttcattcttttttatgtctgaacagtgttacattatgtatatataccacatttctttatccaataatctgttgttggacacttaggttgattacttatctttgctattgtgaacagtgctgtgataaacatatgagtgcaggtttcttttttgtatacggatttattttcctttgggtagatagccagtagtgggattgctggatcaaatgatagctttatggtagctttatttttagtttttagagtgatctccattctattttccataaaggttgcactaatttacattctcaccaacagtatacaagcattcctttttctctgcatccttcacaacatccattcttttgccttattaataatagtaactagggtaagatgatatctcattgtagttttaatttgcacttctctgatgatgtgtgatgtttagcttttttcatatacctgttggtcatttgtatgccctcttttgaaaaatgtctattcatgtcctttaccccatttttaatgggattatttcattgttgttgctgaattgtttgagtttcttgtatattcgggatgttagtcccttgtcagatcaatagtttgcaaatgtattctcccattctgcaggttctgttcactctgtcgattatttcatttgctgtgcagaagctttttagctttatatggtttctttgtctattttttgttgttgttgcctgtgcttttgaagtcttatccataaaaatctttgcctagatcagtgtcctgaaatgtttcccctatgttttcttctagtagttttgggtcttatgtttaagactttaatccatcctgagttgatttttgtacatggtgagcgatgtggcttcagcttaattcttctgcaaatggcaatccaattttcccagaatcatttattcaaaagagtgttctttatccaatgcatgctcttgtcagctttgtcaaagatctgttggctgtaaataatgtgtgtttatttctgagttctctattctgttccattgaacagaatattttaataccaataccatgccattttgattactataggcttgtaatataatttgaagtcaggtaatgtgatgcttccagctttgttctttttgcttaggattactttgactatttggggtcttttttcattccatatgaatgttaggaatgtttctctaattctgcgaaacagtgacattggcattttgatagggattgcattgaatctctagattagggtagtatggttattttaatgatattaattctgcttatccctgagaattagatgattttctacttgtttgtgtcattttcaatttctttcatcaatgtttgattttggatattgcttttatatcctgaaactttactgaattcatttaacaaatctaagagctttttgtagagtctttttgtttttctaggtataagatcatatcatcaacaaacagagataatttgacttcctttttttccaattttgttgccctttatttcattttttagatacagggtctgacttctgtcaccaaaactgaagtgcagtggtgtaatcatagctcactgtagccttgaactcttaggctcaagcaatcctcctacctcagcctcccgagtaatttttctttatttatctctttgtttgtttgtttttgagatggagtcttgctctgtcgcccaggctggagagcagtggcgcgatctcggctcactgcaagctccgcctcccgggttcatgccattctcctgcctcagcctcccgagtacctgggactacaggcacccaccaccatgcctggctattttttttgtatttttagtagagacggggtttcactgtgttagccaggatggtcttgatctcctgaccttgtgatctaccgacctcggcctcccaaagtgctgggattacaggcgtgagccaccgcacccagccaactttttttaaattttaaatttttgtagagacaaggtcttgctatgttgcccaggctagtcttgaactgctggcctcaagtgacccttctgcctcagcttcccaaaggctgggattactatagatgtgaactaccacacccggtctgaatgtcttttgtttctttctcttgtctaattgctctggttaggacttccagtactatgttgaataggagttatgaaagtgggtatctttgtctcattccagttcttagagaaaacgcttttaactttcccctgttcagtaggatgctggctgtgtgtttgttgtatatggcctttattatgttgaggtatgttcctttaatgcctactttgttgagggtttttatcataaagaaatgctgaattttatccattttttttctgcatctattgagatgaccatatgttttttgtccttaactctgtgtatgtgatatatcacatttattgttatgtgtatgttgaaccatccttgcatccctggtataaaacctatttaattgtggtatatcatccctttgatgtgctgttggattctgtttgcttgtattttgttgaggatttttgcatctatattcatcaggaatgttggtctatagttctctctttttttgttgttgtcttctcgtctggttttggtatcaggatgatacaagcctcatagaatgagttagaattcagccgctttgtttaggggttgatctttgccctctcagcgtcttctgtgatccctggttggctaaggtttcctgccttctcctgagatgatttttgtcttttatcttccttagaacactaagcattcaatttcattagtataaagctttcgccatttgtaattcacaccattttgtaatttctaatgtcatttatctgaatttttactttttttttttcctttacatcaggcttgttcaatttgctttctttgttggggaggtgtgttgatttttttcactttcctgcctttaatgaactaacttttcttttttccagttttcattcaaattttacccatcatagcactattctcaattttcctccaaatcttttactgccagttaattttatgtcaattaattttattttatccaagtaaaatatataaaattttaaaagttagatatgactaagcagcttgaaacaaaaaatagaagtgtctcacccacccttctctaccttgggggcctaccttctacccccaggcttctccctgatacttggctccaacttttgaaataataatcatagctaaggcttgcaaagtgattactgcatattaggtactcttctaaaaatatacttggattatttcattcttgctatcctgttttattgatgggacaactgaggtatagaaatattgtgaaacttcctcaaggtcacatagcaagtgagtagcagaaccaggatttaaatctaggtagttgtactcttaaccatttttacaattttctgctgctcaaaaatgctcttgtaacatgtttcactgttatttcttgatttatcaattgcagacatcttccactgacttcccaacatggtaaatacagactaagctctcccatcacatgcctttatttcttgtttccctttcctaactttaacacagtaatttataattcattgatgtttaaactcatagcaactacagcattatcatgaccactgattgcacggctgactaaatggcgcactccatgacctctttcatgaacaatctcttattttcctaggagtattttttttttgtttgttattgttattggtgttttttttttctgaaaatgtgatttttttccttgaaaacctgtatgtttccctcaactctccaactgctcatcagtaacacgttccatattctcagatataaagtttattattttattttccataagttattggggtacaggtggtatttggttacgtaagttctttagcggtgatttgtgagatcctggtgcacccatcacccaagcagtatacactgcaccatatatattgtcttttattcttcactcccctactactcttccccccaagtccccaaagtccattgtatcattcttatgccatactataaagcttattttccaccccctagagccttgcctgggctattgctcttaaggctgctgtacagctgtttattttgttcatgagactgcctagtcatcattctgagtcttattttgctgctttcttgtatcaaatcctgtattaggccaaatacgtcttcccactccgtttcttaaagcacactctgtggtagcttcctaagaaaagggacatgggtgattcttttgttggttatgagtgcttgtaagctggaacatatctttagtctatccccatgcttaattaacatttggttggtcgtagtaggttgagcatttcattccactgtgatcgtgacagtgatgctactgagaaatcagacatcgttcagtttgtagttcctatttcatgacctgtaattgtccctggctgtcctgtagctgtccccacccttgggtagcttctctttcccccatgtgttctaaagcttcataatatacctgctgtggatgtgtcctcaggggctcacaggctttttcaacctgaatgcttccttgcttggaaattgtcttacttatttcgcaattatcttccctctatttttttcctattgtttctttctggtattactattattcttatggctacactgatcctttaatttctttagttttgaactcaaattttttatctctaaacttttttaacttactgggaaattacctatactttaccttccagcccttctactgcgtctttttcattgtggttatcatatttttaattcctaagaactctaaagttttctctgatctctttgtatagtacaattttttttttgcatttttcttatgttttttcaattttcttctgttcactgagttgtttcagatgacctctgggttccttttctccatttgttggttttgatgtcttcctttttaaaatttatcctcaagtgtctggtaacttttgactatccattaacacaggagaatgcatttcaaaaaactgatgattagaaggcctccgtgcatggacagggcttgttcctggctggacttcattgagaatgtggggagctgacttcccactggggagacctccaaatgccaggaactggaggctgtttagctcctgctgagacgagtgatccaatccccacaggctgagagcagggtggtgtacatctgggtggtggtgttctggcagctggacagaagaggtggaggtggggaggggccccctacagggcagcatgaatacttaagcttaactccctcttgtgatccctgttactctggccttcagctgtactggcatctctgagcatggagccctcctctttcaacttattcacaagtcaaaccctttgtttctttgtatactgctgtgagtagtggaagaagtgaatctacatggtcatagactttccaccctcctgctctctccgtggcacctggggtctcccagtggaacccctcatgggttctacagggagatttccttccctttgctatttgctcaatgccaatacttaggttgtagcttcttctgtttaattaattcagttcccactactccatctgctccccctcttctaaaaacttaatgaaatcggggccgggcgcggtggttcacgcctgtaatcagagcactttgggaggccgaggtgggtggatcacgaggtcaggagattgagaccatcctggctaacgtggtgaaaccccgtctctactaaaaacacaaaaaaattagccgggcgtggtggcaggcacctgtagtcccagctactcgggaggctgaggaaggagaatggtgtgaacccagcaagcagagcttgcagtgagctgagattacaccactgcactccaggctgggcgacagagagagactctgtctctaaaaacaacaacaacaacaaaaataaataaaatcactcatctgcttttgctttttctcctgtactgtttctctcttgtgggctaattagcttttatttctatggcacaaagtcccggaagtggggttgctgtgggaagagagtaagtacttttaatttgaatagctattgccagctgccatttcaaaaagtctaacatttacatatatgggagtaccctctccttggtatccgtaacagtaataagcattatttctctccttgattattgctaatataattaaggagatatttagttgttacataaacttgccttttcctgaatactagtgacatggagaaccttttgacatgtttgtgggccatttggatttgcacttctatcaactgccttctcatatatttgttccattttctagcgccttacatgtctttttcttgtccatttgtaagagctctttgtatattatagatgtttgtcctcttaattcaaatactgccccgtaaaatctattgtttgtctactgcttatgttaggattttcaaaaatcatacaaagttttaatttttatagaatcaaataagttcacctttcttttatagcttctggattttatttgattttatgtatggtctctcatattattttgtaatatctactatttcttctacattaaaatcttatatatatctacatttgtttttcatgtggtacaagataaccagttatacctgttttctgtatatgtattttttccaggtagatagctagtagtataagtaccgttgactcttggtgtcaacaacgtgagggttaggagtttttagcagtcaaaaatgtgcaaatggtggagtgcaacagctcatgcctgtaatcccaacacttcaggaggctgaggcgggcagattgcttaagcgcaggagttcaagaccagcctgggcaacatggtgaaaacccatctctacaaacaatacaaaaatcagctgggcatgttggcatttgcctgtcccagatactcaggaggctgaggtaggaggattgcttgggcccaagaggttgaggctatagtgaactttgatcatggcactgctctccagcctgcgtgatggagtgagaccttgtctcaaaaaaaaaaaaaaaaaaaaaaaggcgcaaataactactaatagcctactgttgaccaaaagccttatcaataacataaagactgaacacatattttgtatattatacattttctatactgtattcttacaataaagtaagctaaagaaaatattactaagaaaatcataaggaaaagaaaatatatttacagtagcgtactgtatttatctatactatgactctataccatctgtttacaagatgaattgtttgtctgacatgtggcagttgcagctggagacctcaaactatggtccatatgtagcagttcaatggtttcttataatgtcttgacttttctctggttcttagagcacttccagaatcactagttgacatggggttttggtattgcactaaatacaatgacaaatacatgagaaccaagagagatcactttttgccatgatatgcaattgcagtaaaaagattggagagatgaaatgctcacacagagatgattggcattgcacagcatttttttttttttttttgagatagagtctcgctctgttgaccaggttggagtgcattggtgtgatctcagctcactgcaacctccacctcccgggttcaagcaatgctcctgcctcattctcccaagtagctgagattacagttgcccaccaccatgcccgactaattttttgtatttttagtagaaatgggatttcgtcatgttggtcagactggtctcaaactcctgacctcaggtgatccacctgccttggcatcccaaagtgctgggattacaggtgtaagccactgtgcatggcttcatacagcattttaagtggatactaggaatacttgagctcaccacaatagcagcaggaagtggctgtttaattattacaatagtacagtatgtatacagttaattttacagttaatactgcatctttacacttgtttgcatttttcttgactgccaatggcaccatgtatggtctgtgtttgtgtgcgtatgttttgatacattttacctttttataataggtttgtgtatatttattttaaaaaatatttctaggctttgtggttcacctgtgagttttttcaaattgtcacaaatctccaaaaaatttcactgtatatttattgaaaaaaaatctgtgtataattggacccatgcatttcaagcccatattgttcaaggttatctgtataatctttcaaataatccatctctcttctgcagaactgaaatactgactttgtcatatattagattttcatacatagtaagatctatttctgtacttggttctcttgatattttttctattgccattccaacaccatattgattttaaatataatagctttatagttcagtctgatatctagcaaagcagattctcctgacttttcttctcagacatgtattcttccaaaaccatgttaaaataatttaatacaattccatttttttgtgtgtgagttttaccatgtggctaaatttatttctaaatatattataattttagtccttaccttgaaaggaaataatttgctatttccatttctaggtgcttattgaataaagagattacagctattaatttttattatatttactttcaatccaatgagttaaccatatttaaactagcagattttttattagagattatttctaagaatgtagctatgaaatgtgtaaaggaatacagttttcattctacttttccagtatttatagttgccatttcattttcacgtcttattacctttactagaaccttcaacatattgtaggataataatagtggcattattatttccagaatttaattgcaaggatttctgtgttttgtttgccagcacatttgctgtttttttctgttgttatatatactctattatacttaattggtttccatctattctgttgtacatagagtttttattgaaaatgagtattgaacttttcaagcacaaatgcaagatcttttgctttggccatgtgacttttctactttaatttgaagttatgtcacactgtattatgttgatatatttcctgatattgaactactctggcacttcagaaattgcctcatttagtataatgtatctttaaagacatttctttattctatttgttaatattttctttagaatgtatcttaactcataaatgatatttgtctatagttttcctaggtctagtatttttataagattttggtattaaagttatgctggcttaaccttttgtatggtatgacataatctaaataatattggcattacacacattttttaggattacataaagcttagctgtattcttgtctgtttttaggacctttttcaatggtaggtctttaattgtctttccaatctcttacatcatacacttcattttacagtttacattttgctaggcaataatttatttccaatttgttaggacagacatgatgattattttcttataaacttttattcactgacatctatggctatgatttttctccctcattcttatatagcttagctctcttttattagtcaaatgagagatttgactatttttattggtattttaataaactttttgggaatatacatacatatatatacacacacatataaatctctggttaattttagccttcattgttacttatttccttttgtattttccttttcccaatttctaaaataaattttgctactttattatatttattttctaatactaaagatatttgaggatatccaacttccattttttcttttcttttttttaaatcctttctgagacagggtctcaccctgtcacccaggctggagtacaatggcaccatcatggctcactgcctcaacctcctgggctccaatcctcccacttcagcctcccaagtagcttggattacaagtgtgtgccaccatgcccggatgatttttctttttcatttttttttcactttgttgcctaggttgatcttgaactcctgggatcaagcaatccttctgcctcggcctcccaagtgctaagattataggcgtgagctaccatgccccacccaatttccattttttctgtctcatgtaaattttctatttttgctgtgtcccacaggttttgatatgaagtatatttctctacatagttttcaagatggtttataatgtcacatttgctatcttctttgatacaagaattttctggagtgtattttataatttccaagcagtaaacattttcatttttgtatttataattttattagcttattatcagatagttggcctgtataatctacatgtttttaaattttgctagggtttcctatggagctaaggcataatttatctttctaaatgtttcacagatatataagtacaatgaatataccttattgaagcaaagcagtggtttgtatatggctattatatcaagattagtgattgtattctttatatctttacgttcctattatttatcagaattgctcaattctgaaagaatctttgtgttctgaggtctttttctataatagtattgttttattaagttcaccttacatttaagtttttgctttgtatgtttaactgctttggtttttggtgtatacaattttatgacttaaatttttatttatgacttgtaaattttttttattacccaatgtccctcttcatctgtttaaggcttctaaacttaaattccactgtatctgttgtaatttctccacagttgttttctttatattagcatttttcaagtatctttactcatccattcatttttcccttttttgtcactgtaagtttttctttttttttaataaaaaaactcctattctctaacccaatatggcaatctccaatggcttttgactactttctaatcctatttctctttttaccatacattttagtgtcaagttggtatacttaattttatttcttatatcttactttagatctcttattttatattgttatttcatcactatcctatttagtatttttactaatttaagttgctattctttcccttgttaatttaaaagttctccagtgctttggccctaaataatacacatatccctcacacattttgagaaaatgtgataccaactatttcccctgctgagacatactttttcctttatctctgcctttccccaatctggtaggttgtgaccttaagaatactttcatcttctttcctcttcctcctttccccttccagaaatctctggaacacttttacccttctcctccactcctcccagcttcagggttttactgaggatagtttggcagtttaggatttagactaacagaatctaccatgaaattatctgcaaaacaaaaataagaatatgtaatacgttttctttaaagagcctatcattataaaggtacatgtgttctcacatgtatgcatatattttttctcaatatttataaacttttcctacccttgatattatcttgatttgcttttaatttaaataatactttttaactgtgtaagtaacatctgaataaattcttactgtaaagaattcaaataagaattctacaagaaagataaactcttacttggccacccctcatcctattcccttccttaaagatactcccttaaagccactgtattagtatgacatacattttttccagactattttccatgtgcttacgtatacaggtatatttataaattattcattgttttgcttttctgtgtgagtgtgtatttactataaattgtatcacataacctgtattgctttgcaactttactttttcacttaatatatttttaagatatgtttctaggtcatgaaatatggtttaacttgatacttttaaacttctaacttgataatactggatagcacggatacagcataggttttttgatggccatttaggctgtttctattaatttgctacttgaaaacagtgcacagtgtctcacatgtcaccctctgcacatgaatgacggtttctataaatatggatatgtggaattgctaagtcaaagagtagatgcttttactactaaactgccacccaagaattgctgtacttatttataaccttgccagaaacgcatgcggtttacattttcaacatttgtgtatgagattgtttttctccacctttgagtagagggtacttcaaaatgtattataaagtcttatatattatcatcacacttttatttatgccagtctatttggtgaaaaaaggttatcttgtgttttaatatgctaactggctggtagtgaggtgagtgtctttcataagttcatcagccatttgtgtttcctctcctgttaactgttaactgttaactgtttctactcttgtcttacttcattttaactcataagaaattctaattcatggaattacatgcttcctgtttcagtcctttatttgtatgtcaaaaaccttttctcctagtctattgcctattttgcctaggtatatagaatatttgatcaaccaaaattttaaaattttgatttagtcaaacagtcctttcctgtatgacttcttggttttatgccttgcttgagaaaatatccaatacactaaaattaaaacaaaaagtcttcagtgttttcttcagtatttacataatttcttgtacatttagggtattaacccatgtaaaatttatatttccttatgtgagatagggctccaattattatcattttcaaatgaattatcaaatgcaccacaaccatttatgcatatgtcatcattccttactgctactattattgtaaaataaattctcatataaaaatgggccttttagacttctcctccctcaatctatttatttcttcttggtccaaacccatactgttctaatagctacaactttatagaatattttgaagtaccacagggtaatttttccaccccatacttctgtgtagttctttattttcaacgcttacttggctactggagaacatttctaacttcccaggtgtattttacaatcagcttgacaagtcccataaaaaattgtgttgtattttgattgaaaatgcatttaattttggattggctctggggaattaacatttttataacattgacttttctcatctcgtggagatatatttccacttattcatttcttccattcttttcttattatgttttcctgtttcattcatttagatcttacatatttcttattaggtttattgctatgtagttcatattttttatttatattatgaatgaaatcttttctcaattacattttccaattggttgttactgatatataagaaatatatcggctcttgcgtgtttttctaatatcagcgtaccttggtgaacttactagctttcaaattttcagaaattcttcacggtttctttcttgctgatgaaaaccttcttattcatcagtaataagtatttaatttgatataatgaatttagaggtaaagtttcagaactgggacataaatctaggtgaacagtataacttcctttcttcatattatttcatggtgactctttttttttgagatacagtctcactctgtcaccttggcatgatttcggctcattgcagcctccgtctcctgggttcaaacgattcttgtgcctcagcttcccgagtagctggggtcacaggcatgacccaccacgcccggctaatttttgtatttttagtagagatggggtcttgcgatgttggccaggttggtctcaaactcctaacctcaggtgatccacctgcctcggcctcccaaagtgctggcattacaggtgtgactcactatgcctggcctttcatggtgacttttaacattcaatgacttcttcctccatccctccatccattatcctttttcctcagcacaaatcaagctataatagaaaaaaggatccctggttcttgccaaatccttcattttacctactgagacctaaagaatttaaatgacttgtttaaagtcacacaacttagcactcagaaagtggcagaattggattagcttcaggaatggctttagagtctctaacatgtaagcagaaataacagtggcttaactaaggctcttttataaattgcatatgcttgtatacactacccattttattattccagagaatgatttgtgtatttcattaattaagtaaattcaattataaattaaatattcgtgtattttatgaatgtgaatgaaataggcaaattttcatgccatgcaaatattgtatgctttcaactgtatacttttaaaaagtaggaaatgggccatatttatattataaaaatctacaagtacatacaaagtggctaaaggaaattatcaaaatacttcagactatagggcaatgaaaagtaaaccccaaaagtgcattcagcattgtgacagattaaagagatgtgggaaatatggggtaaaataatgataaaggaataatataattaaatagttattattggtagtgcaatacattgtactaagtaccttacatatgctaactcacttaactctaaaatatacacacacaacaaccaagaagttagtattgtttttctcctttcaaagaggagataactgaaatttacagagatgaaattacttggcaaggtcatgatattaatgatcagcaaagactgaatttgatcccaggttatttcactccaaagcccttgttctgccttttctatatatattgttttccttagaatccaactagacagatatacacatatcatcgcttttggcaatgctgcattagtacgccaaatcccaggataatatttttaagtattaactgagccacaaatgaatctactgccaaaaagctggtcatgtaacttactgaacattttccgtgaacaccttcaaggacatattatcatcaccagtcaaaaaatcaaaagtcattgtggaagaactcctgatacaagcagctacatggctgatatcaaacatatgtgaagcaaaatgagccagatacaaaagagtatatcttacatgattttgtttaaactcttgaaaagataaagctaacccacggtgacagaaagcagatctgtggttgcctggggctgaggactgagaaggattgattgggaagagaaattagagaatccttttggggtggataaaggaggatgtaaatattcttcagaaacaggtcacaactatatgtagaatgtgtttaatggttcctcttaaccagggtaaagactcagattcattaggaacctgctttggagaagttaatttaatatatgttatgtggatcttcagtgtttcagcagtctggtcagagaccagaagcaaaatttagctactgaaaagaacagtatgatagcttagtgaacaatcaattgtggtaatccacccagatgcaaaaagggtacccaagaacatctcacatgtcctgtcctgatatagaattaagtcagcgagttatttttttccttttagaagtggacataacattgtaatgagaagacagttttccatctgaggcatcagcttgcagattacctctttcatttcagcttttcttgtttttatggcaaattctgctgcaacattaatgataacggctttttgcactcatatcattatgagatctttacgttaattcaaggatctcaatgcctgtcttgaacaatgtcaaatgtaacaatgaaatatgagcaaggcttattggaacacatctgtatgcatctcatgtccgaaagtgtataatgtgttctattttgaaattctgatttcttcacaacataaatatatctattataaaatatgattttgaagacatgattcttatcctcttccattcactagttagctatttgggagggaaaagcaatcataaaaaggaaaagcctgctgtgcgtggtgtgcatgtctgtagtcccagctactcaggaagctgaggcagaagggtcacttgagcctaggagtttgagtctgtggtgtggtatgatcacacctttgaatagttgctgcactccagcctgggcaacatagtgagaccttgtctccaaaagatacaataaaataaaacttaaaaagtgaacagaaaaagctaaaaacaactgttttttttaaagatttgcactttgaatttacaaagatgggtattcaggatctgtcatacttggtaaagatttaaaaacaggcctgaagcaaagaaacaatatgaaatagaaagtgtccgatgcaatgtgaatgaataaagggtaaaagggcagttatgatgcagatgatcatcgtggattaaattttaatttgggattttgtaattaagggattaatttcttaattaatagacaggcttcgcagggtccctgaatatcttgaagttacaagctaatttctctctgtatatagggagaaaacctactgtctttctcagatactcaaaggattctgtgatccagccatggctccccctctttttgaaagttaaccacaagattaaatagatagcttaatccagggcatttccaactcctgcttatctcagacactattcttgctgaaacattcactctgagtcacttggttaaaagcccataaggatctacttagagctaaatatccctagagaatccccagaaatacaaattcccaggaaaatccaacaagtcaataatagaaaatagaaactgatttaatacagtatatttttgggccaatatctcattcactcagaccacagtttctcagaaatcagtgctgagcaaacagatcatttgttgcacctccctgttcccctgccacagagatgcaggtcacaaatctcacaagacgagaaaggaaagaacttctgcatttgttagcttctaacattaaggtactagacatttcaagaatggcccgaggtcacctagtcagcatgtggtgcagaggggatgtgaatctcagcctgcgtggatcttagtggcctttcacttctctcctacctctttggtccacccgacatgcctccttggagttcaatgatttagtcagtccactccatctgaaccatttcccaaagctgctcgttagactgagggcacatttctcatgccaagctctttctattccttaattcgggtacatttccaatttattacccccatggcgtagtagaaagggtacaatgctgataatcaggactcctggaatcgagccgctactcttctctaaacagaatgtgcaaccttgcaaaaggcaagtatcaatctgagtgtccaataaccagggaggggggtagattatatgatcttgaaagttgagatataataatatatgattctattattccttggcataaacatgtttctagggcaaatgatttgatcatgttactaggttattagatccatgtccttattcagggaaatatctattatgcccacaacagtgttgtctataactctgattatttggacaccacccaaatgtattgaatttgatttttccaaggtgtagcacattgtcaagtccaaacagaccattaaatgtcttttaattggctgattcattgaacaccactgcaatatcctttccttatgtaggcctgggaaaagtcatgaagtgacatttggaagtgagggcctaagcgggcagtgggtaatttaaggcaggaagctttggaccggagagaaccctggctaagaagaagccgcagcctctaggggctcatctccctgtttgtaaaacagcactaataccctgggcctattgtaaagatgcagtgagatgccttctgcttgctaaaaaggtatagaacaatctcaaagctttatcaatgtaactacaaggtatctgtttgggaaatggcatatttgaccacactggccttcagccaacccagtttcatagaaacactttgctaccttagtacagcacatgttaacctgctagaactgcagggactacttctcctaatgagacactcttgcaaagattctcaggctccttttaattatgttattttacagaaactctgctgatccttctgctttcctacttctgaggtaggaaagggcagagatttatcaaccacagagtatggctggaggcagtggtgacatgtttgtgtggcctttctccggtcaccagtgagtcacagtggcatcggcttcctatcagggtctgtgacatacagggcaatgtccgtcattccagtgagactccttgcaggtgaatggccttccaaatttttcagaaaagcattttttttcaagcatttttttttctgttcttgattttgagatgttaggccgacagtgattgacagaaactgacccaggtaagacatacaaactgctttaaaggcggaaaagtttgctagaaagctattgcatgaagatggttttatgaacaggagacttggtaacatttcctcggtctctcaagtttcacaaaagtgcactatcatctcatctgtctggagatttctattaggatttttgaaaacttgacctgagcttgtgtgtgcttgtatatgaggtagtagatggaagtggggtgtgtctttttgcctttgaatctggcccaactgttctagtgcagccaggtgtaagctataaaccagtggcattaggatatgagagtatcttgccctgagaatctttatcttcatccccctgatcacactgggggctactgtgagcccagtcccagtgtatttctgagcagctgcagcaggccaggcacaactgaaggttaaccccgcttgcctctagggtctggccatcccgggctgcacggggcttcagtggccttcctgcagttctcttcccaaggaggctcagcctgttctggttttgctaagagaccctggatgcgtctatttgcctcgttggtatctaccctcccctcccttccttgacccatgcagccaagattcaggacttcaaagacatccttccttcctgcagcccgacaggttaaagatttgttcccaagtctcctgaagagctgcgtcagattgcaaatcactggccagttccagaaagctgctcccaagtgtttcagggcagctcttagaccagtgcaccctcgtggtaagagaggtgacagaacaaagccagaattgcttttcatttctggaaacactagtctttcatgtcagagtttaggttacttaatcttttcgtgccgggaataagatttccctagtgtgacatctgctgatagcaatggacagtccatgatttccagcgccaagaaattaatactctaatctgcataatcaaatccccaggtaagcatcaccattcctttctcagtactttctgtcccttgcatttccaaatccttctatttatccaaaactcagaatgaaaatgtagtgcttaataacaatttttactaggggagtttttaggttactatgatagacatttactgcacaaaatttactaaattcaggataatcaggttttcttatgtgtttgaaatatgataaaaatatatatcgcctgaatgtttcatgctacagggtgcattttgtgaatttacacttcaatcacttagtctactgcaatataatgttgatttatgttcagggtttgaacctctattcaatgttgaaatccttaaaacaaactttagacacagagggctcttcacttttccattagacttcttaatccagtttaactatatccttcttcagttaaaaagctagaaagaagtgttgttgaaggtcacagtgacagaaatttcagccagcatgacactcctggaggttattgttttcctacagagctggatgagttaatctggtattgttgcaagaggttgggaaggccaaacaaggccgaatcagggtaagacaattttatagtcttacagctataattaaatccaggacctgggatcaatgtaaatataaatcccagtattagtcctgaatttagttcacaaattgctttttggaaactgttaccctagcaaactcctatttattcttcaaagtcaaggttagctgtgaccacaccctagaaggctttcctgacacccagaatagtgtttgtcactttttcctctgaggaccttggatggtatatgtttctgttgcatttactactctactgcacaactgtttgtttatattatctatctccttattaaatgatgacctttttaagtctgaaactgtgtctaaactatctctgtgtcctcaggagctagtacactaccaaggacatagtgctcaatgaatttttgttgaaataatgaataaagcaatatattctggctgtcccatgaatatgattgtgcagcatagtgcccaggtgttctgagcacatgcaccaagttttaaattaaactgccaccactttcagggcagagaaagaaaagcaggttgcaggccaattctggtccatggttgccttattgggtttcctcagtgtcattaaatagctgaactaggtgttagccaacatttaaaatttgagagactacatgcaaaagtctgcatttctagcttcttacaattttcaaagctatggcgacatctagctagcatttccatggggcctaactggctggggctggctgcagggcacacaacttcctttcctgcttccttcacctggcttagccccttaaggcatctgatctccgagcatgagagttttcattgttttggtgagaggatggtttatgtaaagccagccacatagtaatacagattgacacatatgatgggaagtcagccatgtgctcttgaaagcaattaatacctattaatacaattaatacatatatctaattttaggaggatatgaagaatagaaatttaggtgccttccattaagttacttaaaatttaagagggagtagaatggggagataaaaacccatgaaacaatatggaaacatcagtccccctgaccaaaggcacattcatataatacaatctctacagcttacggagccaacaattccaagacagaacctatgtctgcagtctcactggccacaggaagaaataaaacaaaacaaataacaacaaaacacctgaaactcatttaaaaggagagataatttcccctaattatcctgacccatctaaacataatatttcaaagcttgccttcttcactttaaatacacagcaccctaagcactgctctcactcccttctgctcttccctcccttggagccacttcatttgtgaaaccacctccctgtacctctgttacaagcatttccatttgcctggtttcacgtaatccttagttcactcagcatttattgaggctcacgtgtattccagttgtgtactaggaggattcaaaggtcaaaacaaggtttttgtccctaagaaaataaaggccaaatcaagcaagaaaagagtaggaatcctaccttgatttccttataacagaccacatacaccttacgtgataatgctgactataagctgatgggaacacaacatttagtcatgatgcatggactggtaagctctgggtcttgttcaaagaaaaaaaacacacccctcaattgctttgggaatgaagagcaaaggtatgcaaaaagaattgtagcatacttacaaagtaacatatcaatgctgccaggacttagtgagcaaggtgtgagtaggagattgagtggggcagggagttgtgatcttattccaggagtacctccaaagcatatgaatttagaaaccagattgtgaggaagagaatttctcatgcctttgcacagtgtattctttctggatggcatttatactttctcttgtccacctggagtcacatggaggcatggcttcctctgctgggccttccccagggccctctgcaagcggagctaggattccacttgccccacgcctgtctctgctcagctgctatagcttcccacatgccttttagaacatcatttccctttcaggcttaattgtagaccacaggcccttgagcaaatgcattttgccatggactcctcagcactgacattactttgggtgctcccaatttggtaatcgaatgaagaggagtggcaggggtggggtgggcaggagtagagtagcattttgaacagaaaaatgacatacaaagtggaacagttgaaggaaaacctatgtcatgctctgtggagtgaaagtatttctgcttggctgaagtaaagaatttgtgtcaggaaaaaaagaaaaatgaggctgttgaagtgtgaagcaagtctatagagggtcttgggcatattatgaagagggaaaaatcacatcttgccataaccctgatgattctttcttgtcttttgtatagctcttacttgatcccaaaccaacctcacgtgttacatctcatcatcgaaagccttgctctgcaggaactgtgtgatttttcaaagtgtcccttacctctcaaaggggccactttctgcacgtctggcaggttaatatcctttccagtgcttagtgcatgacacagaatacctgctgcacattctccatatgttttcatgtctggccagtgcccataatgaaaccaccaatgtcctgtaaccatgcaggatgacaggctcaccaccagtggatactctgccatctgagccctggtgttactcagcatccctgaagcatcactggctgctcctcctgtcaccctgtgggtgtttctaaattagatatcaggtttgtagggcaggactggaggcgcctccatggctggtccacacaaacagccaaggggcagagttcatccattccagaaactcataaggtgaacttatatcccaacagcgtgggaagccaggtagatgcttcaaacttgtgtggatgttcttgcctcttctcccaactccttcttagtttgtgtctcaagagaggccagaatcgatcagaatgaaaagcttccatcacagaaactcaagaaccacagttccattctttaccttcttctttactcactcacctacccctcccttattgctctcaccacaggctacctgcttaactagtcttttttcttttcatctttttgtctcacttcaactacatatatgtgaaagaaccccaaaggcagatgttttgaaaaagcaaaatacatacatttaaaagtgtataatggttgggtgcaatggcttatgactgtaatcccagcactttagggggctgaggcaggtggatcacaaggtcaggagatcaagaccatcctggctaacacagtgaaaccccatctctactaaaaatacaaaaaattagccaggcatggtggcgggcgcctgtagtcccagctactcgggaggctgaggcaggagaatggcgtgaacccgggaggcaaagcttgcatagaccactgatactacatgaactccagtatggggaaagttcactgaggactgctgaggccctggctggccccttgctgggacagctgtttcttatatgttattttcctttatttcacagctggatctcacagtgggatgcttggcttgtggacaggtggaaaggaaagtgtgcagtgtcttgccagatcagactcatggatagatttacactgaaaataaagactaagagaaaaaaaaagcggaacaagtagaatgtaaaagccctctcatcttactggaaataatgatataaaacactagcaaaaacaaaaagtccgcattctaagaagtaacagcaaatttttgcaccttggttctaagctgtcagatcctccactgttgatgtgaatcatctaccctataaaattcttttcttcctaacttggcctaaggatatcagtagtaggactttttgaaatatcagatgaaaaagaaaagaaaacattgtcttaatctaagaatacgagaataatgtcccatcaggataatggttacacaggtatcccaaacaagtaaaagacagaacacataggaaggggaaaatcttagatgccgcatttcagaaatgtgtaaagatggtaggctccttattgggattgtactgcagaagccctctgatctgactcaatcctaggtgagccagttaattcaaatgtcacctagaatagggaatcagaaaatttgtcctcttactcatttatgttccacgcagagggagcaccaattggaggcgaaaggggggacttaatttcaacagattttcaggtttaaatccttggtctgtcaaatacctgctacaggacttagcctgtctatgccaaagtatccccattggtaaaacgggtgcaatgataggtcctaccccatgggactgtgataaagatgaaattggtgagtgctgtaaagtttgtagaatagagtctgacacatggtaagcactactatgtatttggtaagtgacatttttggtagggccaaggctgcttctttgcttagagatctttttgttggaatcttccattatctttttttttttaatttggcatcaacacacactttatacattgtctatgattcctaatttttgttttccttaacaatggtacaggaacttaaaggcatttgaggagcagtttgcatgcagaattgttccacatttaatacaatttctggtctcccacaatttatttttatagttagacaactatatttaatgtgatcacaaatactactttagcagacctactaagttacaaaaataactcattcttggcaagtattcagctcaactggtaagacaaataagtgtacatggtagagagctctttactagctgccaacattcattaagttgagggcattgttcagtgtgatttgaaagggggaatgctgagcatcagtgaatccagacaagtaggttcaaatgagcttagttaggagattccagtctctgtaagaacattacttttggattttgtttgctatcccgccatctcaattccttggaatttagttccaatgttgattttaatatggaggggggtcttgttaatctgatttattgccacccatagtcccagagatatcattctagaaaatgaaatcaatagagaagtttgttgtcaatcttaagattttaatttcagcttaggcctttcttatttccatcatggacctggctccctttgtaagtttaccagaatctgtcaactaatcctcagagcactccctttctgtctctcccacataagaatttgctaaatgatatccatataacctcttattctgtatttttaagggacaaagaattggctgtttcttataagttattttcctttatactatttataatttgtctacctaaatcacaatgtgttcataactcttctttctgtatttcttttcaggtagcaactttggaatatagagaatcattaggctgtattcaacaaataataactaatgcagccttctaagaagtgcaaaaaaactacttagaaatctgctataatgaatccaaagaccatgggcagcagctatagggtcaataatatttggaaccagggacacactggtggatttgctgcccccacccaccacatcctcagacatactgggctggaacacatgactgtgtagtgcctcaacattcatgtaagacaggaaaacttcaaaagaggtgggagcacaaacctctcttaagtttatgcaaaataactctccagaacaatgaattattatttgttcattattccactcaacgcataatgactgagcatccataggtgtaaagcaagtttggaatgattgtattttagctccactgtatatattttgtttctcaaaccctaaagtactatcagaaaatgaaaagccatgagtgaaataattaacacaccatctgaaaagccagtcatgtcctctgtcttggattatgagctccaagatgttaagagggcaggtatcacactttatatcattattcttcacagaactattaacagcccatcttttataaatattatttaaattagaatggctcctggagggagtactatttggggagaaatatgaagtgtgttggctgaaaacacctaatgaataaacactgatgtctattgttagcatacacatcatcccctgatctctgagtatgaatttaagaaatttgtgacagccaatgaaaatgcttatatacccatagcacgtgtgtttaccatgcaaataaatgatcacaattcataaacagggactgtagagtcttaaacactacttcagaaaggcctcaagttacaacaggcagaacagaaaaaaaatcaggaacatgcaacagcttttaaaagtaattctaatattgaatcttgatgatgagattgcaaaagaaacacaattttttataaatgcaagatcccctatgacaaatatttacggtggtcaggaacagaaaacagaatagagatagatgacttcgctcccaccccacaaaatttttgagtcataaattatgaattatgttcaaacatataaggcagagaggaaattaatttaggagatgagatctattttataattcagagagctgttttattttaatttggggggcaaattacattttgatgttcagcttaccgaacatctttctttctctgaaatgaattacaatttcccgttatttctctgaggagtcctaagatttttattccaaaattcagagggtaaattagcaacacagtctggatcatttggaaaaataccgtccagcagagctttccacaatgatgataatgttgtccacgtgtgctgtctactaaggtagtccctggccacatgtggcttttgatgactggaaatgtggctagttggacatagaaacttaattttaatttaatttaaatttttaaaattaaaatttaaatagccctacatggctagtggttatagtgctggacagtatcatccagatgaccacaggatggacaaggaccttcctctcagccaattagaccacgcagtggtgggccgccctttgcacattgcacactgcccctgtgaaacctcgatgcagtctttgacagcttagcctcagaagggcttgggggcaaagctcatgggagcttgtttaagcaaatatacacattaataggatcacaaagatcggaaacagcaaaggtcagccctgcagacccctctccccattcatatgtttccctgcagtgggacatattctctagtgctttgtcaggaacagcttcaaatcgactcaaatggcttgactttccacagctttccatgttatgaaggcaagtaaaaaaaaatagttcagtgagagcacttagaaaaagacaacctgtaaaaatactgagatagaaacaggagacgttctgttataagaaggaactctgcatagagagagatataaaagaaaaacaaaccccacatgtatttttgatcataaagagtttgaaataaaaaaaatgtgctttggcactacataaaattcttccttgattatcacagtatgcaagattactaatgctggtccccaaagcaatcaattatttcctaactcctttccatggttccatttagtttactacagaacatcttctgattgtcccttttgcctgtttattatttgttagtgcatttccttatctgcatgtagctttaaaaagtcaagaacttcagacaccttcaaatttaatgacataacttgagaaaggaaagaattgggattctgatgcaatatgccttgctcatgaagatgttgctaacttctgaacttaagtaacttcctgtcaatagcatttcagtagcaaagattgttttccagataaacacatacctggaggagcagatcagaagtgggtctgactcgctgttggaataggatgcttagtgttcgattctgctgttccaaatcaaacactcttgttttcaacttcacacattcctctcttagatcctacaacaaacacatcgaaggaggaaaaagtccataactgaaagatgtctttgcatattataaccatattttatatatctcagatcattagtaaaaaacggtatttttattcttcaaagcccccagaagtaaatcacatacgttttcgtccacagaccattgtctgatagaattattatgtgcaaagaagaccaattttttttaaaaaagcaccttgaaatcagaaatgcattaatctagcatgctatttttgaagacagtaaatcttagcgatatgaagtcaatttaagtttccgcctatatattttgccttttcactgtctttataaaagcaatcatagagcacaaaccacaaggacaacaacagtgtttctgcagggaatagagatttgatgagctaaagaaactatcatttctgatggagtttttcattgtcatttgtgaaaacaagttgaaattctcggtgatggggctaatagagtcagtgatgcatttagcgggagagaaatagctccgaagagatggcttttaaaaggccacttgccacttgcccatcctctgaactcatggatttccataccttctggggctttctggtctcagtgctgggtaagaagcacacttagcccattctggcatctgtttggagcagctcttttgaatagttcaaacaccacagagaccttttccccagctcatggaggaagctgatgtactagaactgccttccaaactgactgcaataaaggaacttgcggtacttaaatatctatgccctttttgatggaattcaaggcagacgcagtagaataaaacccaaattcaaggttcttcaaaagctgacccttttctgcatttcaaactatctttcactacttcctgatgttaataaaaaaaaaaatgtcttctgttctcaccaagcagagaacaaaggtctggcgtgttgttctctaaagctctacgcattccttctaccttcttctcttttccttccactgccacttttccttcttatccaccttcttctttcagcccatatttggctctttgattgaagtacagttcaaactttatcacctctctgaccttttacctggcatccctcaatacctgctccattttctgaactcccatcagccctcaatgcctcctttgtgacggttagcatatattactctgtattcattttatcgtttgtgctctagacttgtcaattacacgacacatttttcaccagacaagctcaagaagatactgaaataaccacaccagcatattgctcttacattgtttttattccatcacctagcacaatgccacacatagtaggagcttaataagtgctcacaattattttgctaaaggggatgatgatggcaaattctattcactagtgattggtgtgataaagagcgtttaagtttctcaacacttctacttcaaagatttatgtattctgatgtggggcagctacctattgggcttaaggctctgcaagcaagggagagcccaagccacagttctgatgcctagggcctaaataggagtcacagagttacctgggcctgccataaccttgtatgaatctaatggtgaagttagatctcgctagtaaagccttctctgaggcttgatgagcatgcatcatcttatccagtagtattaattctattaaagggggcaaagaaacaggccaaggtatagcccactacagtttcaactctccttgccttttttagttaaatgggtaaagcttatgtatagggtgttttcaactgatcggtgcctacaaatggagagcagagaaaagaaatgtcatgttcagaatgacgtgcaagagtgcaagatccagcagggcaggatcacgagtgcacattttgtactcatgagcacacatgccatttggcagaggccattgtgaggacccactcactgctcaaattaaaaggtgcaacttcagcctggccaacatggcaaaaccccatctttactaaaactacaaaaattaggcaagtgtgcacgcctgtagtcccagctactcgggaggctgatgcacaagaatcacttgaacccaggaggcaaagattgccgtcagccgagatcgtgccactgctttccagcctgggcaacaaagtctcaaaaaaacccagtctcaaaaaaaaaaaaaccaaaaaaaaacaaaggtgaaactttctttatttttatttattttattttattttattttgagacagagtttcactcttgttgtccaggctggagtgcagtggcgcgatcttggtgcactgcaacctccacctcccgggttcaggcgattcttctacctcagcctcctgagtagctgggactacaggcatgtgccaccacgcctggctaatttttgtatttttagtagagacagggtttcaccatattggccaggctggtctcgaactcctgatctcgtgatccacccaccttggcctcccaaagtgctgggattacaggcatgaaccaccatgcccggcaaaacttgctttctttatttagaattcaacctctgtctgtgtctcatgctgatttttgttcttagcatgtatataacactctctgctcccaaacactaattgtttttagtactgctaattaagtagttaataagacttgactgtgaggcagataaatattaatagtacctattggatgggaaaacacaatcatcctcatttgcaacatagagatatggaaacggaagcatacagtgtggatatgcaagtaaaaggggacctgaaagcaatagtaaccacgatttttagcagcaaaactgagaataccttgaaagagttcttcagatgggtaaaaaaaaaaaaaaaagaaaaagaaagaatgaaagaaaaaaatcaatatactttatagagagtctttacacaagtgcccaaatttcaaaggccattagtattacttaaggtatggtaaaagttcattagtgggaacacaatttatcgaccctgagaactctctgttcatcactattggcacatccagctcagcacacagcagcagggaagacagaggctttagggttgtgacactgatctgatggccattgacaaacagaaatgagctgctctgaaaatctgtagataggaaagaatcgcttgcgttgtttttaatattcttattttcttcagacaagctgtggatcaccagtaactgatgccagagagttgccttcccaagaaactgtaaacaaaaacacccatgtgcccatgtacacactcataaacacaatcagaatggatatatataaacaactgttttgctaaccactattgtagtacctggatggagggggcagatggctgtcttagcttcctctatgctcccaacaggaacactttgacataaaggaatgcatgactgcatgatacatttaggctggatgcaagagcagctactctgaccctgccagttcagaggcaagacccagaacagcctccccaaggaaggctttagaaacaaaagaactctcctctggataggtgccatagtctgggatcatggctcaagggagaggctgtactatgtatcctctctcataatccttctttttcttctatgacttcctggcatgtatcagacctcaagaaagaacctcactgaaaatataagattgtgtcttcagataagaaaatggggacataacataaatatttatcatggaggaataatgccaaagatttgactacatttaatatcatgaaaaaaaaaaaggtacagtggtgtttgggttcaagaaaatactcagacctgttttccttgcactcttcatgttactatcaattggaaacagagacttaagagattacagctgagcaatgtgatacactggtctaatgggctcctgtgcatcttaatgatcccaaaccataatttctctggaggatccacacactgtaatcctgataaattccccctgtgcttgggctaaagatgattctagactcactgctatatagtacctataggagtacagttactttatgtattgaagagtaaaattgttatcagctctaggctgaagtacattttttaaaatgctgattgcttagaagcaggacatacactaacatgatcgctggtgtgtcattgaaaactatttaaatctgattttaccaagtaaaaatgacatgatagtggtatacctatttcagaggcagtgtctatcatgggaatacatggaattggggcttagagggcctgggctctagtcttcattgtccacagggccttgaagtgattgcttctgattaggtctcagtttcctcatctgtaaaccaaggcactgcacaaaattgggcttctgttcaaaacactgtatctctcactagcttcatgggatgtcttttcgagtgctgctttgttccctccctgaagcctaatggccaccaaaaccaccagcctcttttgtcataccctttcttggtggctttcactgatacatccttatctctgccccaaatgctaagacttttgtaacatgaaaagccacttctggaaaaggctggtcacatctcagactgatccagggcttcaacatcgaatactaaaaggcaagacaggtgacataaaagtctgactgaaccaggatactgcacaggaagtagtgagtcctgtggcaaaatacatactgcaagtctccaccctaaaagccttcggattaaaccacttataatgagggcaatggctaaacagttcacgtaactacagtcacttgagcccattaccaaagctagttgacaatctcaggattaaatactcaccaaggctcctggaaattggggaatttgggagttaaaaataagattgattttgagaaagcttgaccccaaatatatagagtcagttttactccacagctatcaaactctaaatgctcttcctgctacagaagataagcaatacttccagaagttttaggaagtcctgtggctaccctgccttttattttattccctgtgatcataaccagccgttggatttcaatccttcttttgattttcatggtatctctctctgtcctactgaactatgggggagaaaaacaagtgacagaatgggattgtggaggaagaatgagggagtgggtcagagcgtggggtttacagtgcaacagccataattaaagcaagggctctgccactgcctggcagttgaaactatgagcaaactttttttttagtcctacctcacggggctgccttgagaacaaaacgactttgtggatttaaagtgctgcatgtggggtctgaaggcttgtaaatgcctgctaaatataaacagccacctgataccacacagaccactgctagagaagtggacacggatggttcaattgcccctttacaggggaaataggaatttggagttttctcaggtacaagctataaaattgttttctgtttctgcctgaatggctggattctaccatacccagctttattccatgtcggtgaagaaaacacatcatcgaaatatgtgtttcctccaaagaacatgcagataagcctgagactgttcatatgaacgaaaataactgcagagaaaatgcctttcttccgtgttttgtttagtggcaaacaagcaaacaaacaaaaaacaaacccaaaacactgaagaacctaggtgagttacattttctgcaaatgtaattgacttaatgaagataaaatatatttcagataacaatatgaatttaacctgaattactgatttaattcgcacttgtagacttggacccatgatttggaggcatcaaaggaagaaaagttgggtttaatatgatcacttttgtattgttgttctaaaggggtacagtccattctcctaagggaatccacaggtttttgagataaactaaattacttgacgaggtacactgaacagaaactgctaagttcatggaaataattttttttttctatcagtatcagtagactctgttacttcaggatacttgtctgggccaattcatgatatgccatgaaaaatgtatttctggctgcccagtgaagagctgaagccacagcagatttgcctttgtgtcataactaatggcatattctaaaactgcacagtaatgcttattatttcacctcaaggatcttctggtgacttagataaatcgctcaagatttttttctgttttgtctttgctacctacattcctttttggaattatttttctcatctgcatttggagtacactgtatattttatattgtgctcttaattaaaaagaaattttagtctttttgcagcaattttacagtgcccataaaaactggaggcacacatttctgcagaacatgattcttttggaatctccaaaagcccccagcatctctttctgcctcatagtgtccctgaggtatgctatctcacagtagcatgtctttctgtgtctcactgcttaattgtaccaaggtagatttatctgtttactagttattacttggatttgtgtagctatttttttttttgtagctgacctgaagggtcccgttttcctttttatcgtaccaaatggcttccttgtctctttcctgaggcaccattaacaaaagcagccatgggaagtctttcaacagttgtacacagagctgcaataacactcccctcactccttaggtttgtaactaagtcagcatagagtttcaaacaggagaaaaacaatcgagaaattaaagccttagaaaaagaaaaagaattcaaaaatgttgaagcagcaattataatttgtcctccaatatctatttctcaccttcttccaaagtaatttcagctgggcacacacccagaacaaagacctctttgccgggtttgtttggtgtggctgtgtgagtaaggtctgttcacagagatgtatgtagtaatgtatgaaagcttttggaagtgtcctttaaaagacagctgctgtatgccctttatcatcttcatattcctcagcttttattcccttcctgatggctggaatgtgtggatgtgatgactggagctagcatagtccttttggaccatgaagtgaccttgaaaatggggccacattccatgaaatacagagatggaagctagggaccccaaggactttatggagcaaagttaccattcctgttcggcctacctgtcggtttatatgtgagaaagaactaacattttagcttatttaacccacctcattatggatctctgttgctcacaatggaacctaattctaactctacgtaagtgtactcaaatctatttatgcatgttagtataaaactggaagcagttaaaattatttgtagaaggaactgtgacattttgacagaaatagtaggcaagaaagtctagcaaaagtatcacaatgcctgtatcatagaaattttaaagaatatttaagtatctccatgagcagcagtcaacccctaataaaattattttcaattaaaaaaatcaaaatggcataaattattttgctgccatttatcacatcatcctgaatatgctgcaggatctaaaagtttcttttggagaagtctctatttcacagatagaaatcaaagtaaacaaaatctgagggaactaaaatttagcttctcagaaacttcatggccggagatggtaaacattccataaaattcactgaaatagccaaatttgggcaaaattgacctgcatttactgtctgccccaataatgtgatctgatgttgtctgcaggcagaatggcaaggcagcaaactcataggtatggaaatttcaggcacagtggttaccattattttatatgtaccacaaactattgcagtaactgttctacatgcttccttttgtagggtcaccacagcaatcccaggaagcgggaattgttattcccacattacagaagaggaactagggctcagggaaattaaatgacttccctaactcttgctgaattttagacttttgttaatgctgtccaaaagaagatactcgttttataggaattgggagaattcaccaacttattgcaagtttgtatttactaaataaaaatggtgggtttgctactcatctgggtaaatgaaaatcaccttcaaaaggctttctattattttaccgaaagtttggattttttattacaaattctattggtcactgatgttacttcatatgccatgtaaaacacaaacgattttcactaagtgaataaatacagaagtattgcatctatcaatcacaatttcctagcttaacaacatgagctccaatatagtcacaaaagtgccttgaaaagaacaaagtcagaaagtgacctaccttttgagtaagcagagcttgaacaacttggttggctacctttaaaaaataaagaaaaagttgtcatttataataatgagactttatatgcaccgactctaatttaccaataagtttctcgcagcttattgtagctaattagctcctcatttgcctctttcctctatatgcagagatctgattattttcataataagtctatccttctaggtaatattttgctttctccaaaggtgaccttgttgctaattaagatggttacacttaaaagatcattcataccttgactttcacatttccatatttggaaaaatgatatcctttcatatactccaagaaggctaaaaaatgatatagtgcaaaacacagtcctaattatctgtccacagtttctacactttgctgatttacaatatcctttgcctgtccttcctattcctttgctgtctatttcactgcttaatattacttgcaatagagataggttgaatggtctagcatagggacaactcattgtttcctatgtgtcctgctttcatcttcaatgtttttgcttaagtcacgctcttgttgttgctacctgtaatataatctggtagttgtttactacaacatccattttttcccttcttcctgagtaacaaacccaatcttttggggctgggcacattcaactgcatttcccagccattcttgtagcaaaatgttgccatgtgacaaaattctggccaataagacataagcagactattctcttgggcttacaggaagtctcaaagaagaagggggctcacccttcgtcttcctgactagaaatggaagtacagtaatggctggagcttcagcagctaccctgacaacaacagtcacatattaaggatatttggacagagaaaagcttggtcctgatgatgttatggagctgtactgtctattgaatatctatgtggtggaaataaggtagtcactgttattttgagtttcttccagcgaacaacaaaatataattcttagtaattttttcagggatctcattttcttcaagtatcaggcagcttgagacagcagaagaacctaaatccctcctcagcccaaggcagtgaatcttgattaatctaagccaatcttggcaattccagtgattggtttaggagtgggcatataacacaattccagctaaggaccacatgtaaaaccagtaacatgttcctggtgtttcaaatacctggcattttctccaggtaaccattcgttattactgtatgtatttgtgttaagatttctttttcatctgcatatttcaaaatactttgcatagagtcacctactaaacttcactattaccttgaagctatgtagctacatggctactgttgataaaattaaggtggacaggtgaactaggtggtatttttcagctaatacatacactgtaaacatttaatgtgataactgaaattgacagcatgaaagactaaatcagaatacttaaatatcctagatataaggcactctggttcattcatttcttccttcatttatccaatataaattttctgagtatctacttgcaaagctagatgattgggccatggtccttgacttcaaagactcatacctggcagtgagttggcaaaaacacaattataacacagtgtgacaaacatctaatcatcatggtaattcttacagtcaacgggagactgagggacacttttgtgttatttttctcttggtaacatatttgtttttggtggtgcccaactatttgtgcttctttctctatctagtatagtcgaacagattatagtaagaatgtttccatggagcttaattgttttttgactcaatactggcaaatagtacatccttcacaacagctggctaccagtaagtctcatagaaaattaaaacacaggctgtcatcaacttttgattagaaggcaatcacaccacaagcagtaaaagactaaaatcagattatctgtaattgattagttaaattatatgcacaagaaggatttttttcccatcagaagtcttttcaaagttacattgcagacattaagtaaaaaagaaaggctcttcattgaaactatgattttaaataaaatgttttcttaggtattgtttttgagtgaagcacaagttacagaactaccacagaccaaaataaactatactttcattaactgaggccatatgttcctttatcactttatttatatgtgatcacaacagtgataaatgttatccaacccacacaaattgaccaatagcataatagtgaaagtcagttttccagcattcattccaattcataagtaactgagaattcaaagtcaaactacatatcatctattttattgttggcaaataaacaaaacaaaacaaaacaaaacagaagaatcgaactattcatgcaggttgaatcaggaacaaggtaccaaagttaattcatgccataaataatttacttcttttggatctcaaactttggatttgatttacattctcataaaactgcccaatatcaatattttcttttctttctcccaattggtctctcactgaaaccattctggtaacggtggtcacataaaatagctctatccatgatttatcaggagacacggactaatatcctaactctaacagcccacaggaggaaatatgttatatctcacaatccaagcagttgccctataggcttagagactctatatctaacacagttccttctggcatgtactttggaaaattatttgctcctcttgaaagctgaacaaagatacacgaatgccttatttctttacctactgacatgaggttatattacctagaaggactcactgcgcttctttgaaaaatatcaggcagattatagacatgctttcctccatactgtctataacgacagtgtccgaggttttgttatcgcttttaacagctaacttccctgatgcataaataggacagctgtttggagtttgtgcctgcaacctctactaggctcaaaagataatgcctggaatgcgtccctgccctcaagctaacattatgccctaaacatttgggttgcaaataatcacacacccataggcccagctagtgagaacaaatcacttccaatgtcatctgccagctttcctctccagagaaagggcagcagctgtgctaggctgcaagggacttgaagcacactggaaaaacaaagctggcagtccttaagccactagcttgtagtacagccttccttaggctgtccatggaggcctctcccctttgctcctaggagatggagcagggctgcaggtgagacaggaatgccaaggagagcgcctgagtacatctcgtgtttccttctcagtaagaattttctcagacaatctagctcctctaacacatggctgatcttctactcacacaaaactttgctcttcttccctgaaaaacttccagggctcgtgattcctccatgcactctcttggaagtgggcgagcagagggaggaaaagctggggctatggagttctctattattttattgaaaaacagtccttgaagctgaataagaagccacactaagcagtttattcagagagggagccaattctcagccaagggctggggtggagggtggagaagcttcaggtttacgggcgtggggagcgaggatctccatgctctatgctttgacagtcctctcctggctagtgggcttgctttcatatcttcatgagctatttcaccatgaaaagccactgtcatgtcaacaaagtaactgaaaaatctcatcagaaaaagtatgtgtttttgaaaatgtgctttggagaggtgttctatgcttctgatcttggttgattgtactgaggcagctaggagaaagcatggagaatatggacttgggttaaaacagtgcctatgttaacctcatacactgacatgcgcaggggatgggagagaaatctgacttttctcagccataaaataggggagctgcctacctctaaagttgtgaaaaaggcatgagatgatagacataatcagcgaaaccacctaggacaggacttgatataaagccgtcacccctaaatgtgaatcaggccagttgaacttcggaaaatataatgcatgttcaggtaagcagttaagaaaaaattattttattttattttattattttgagacagagtctcactttgtcacccaggctggagtgcagtagcacgatctcggctcactgcaagctctgcctcccgggttcacgccattctcctgcctcagcctctggagtagctgggactacaggcgcccaccaccatgcccagctcattttatttatttttttgtatttttagtggagatggggtttcaccatatcagccaggatggtctcgatctcctgacctcatgatccgcccgcctcggcctcccaaagagctgggattacaggcgtgagccactgcgcccagccgaaaaaatgttttttaagaataagggattctacttggaaaggcgtgaggggtatgtatatgtgtgcgtgtgtttgtgtgtgtgtccacataatatacatgtataaatgtaagtcactaagcatctgtattattcatttactttgtgaaacaatcctgtaagatagaaacaagaaagaaactcgaagaggtaaatacacagccccatacaacattggaaaagggtgaacagtgaaccctagtctgcctaatccaaagcccatgaagttctcttctaattcaaatcagactatttgaagtgggtccactatttttttcagctgattaatctttggattattacttgggttagtgcataataaatgagtgctcatctctgaagagataactgaagaaattagtgtaaatatatatgtgggatttggggaaacactaatttggaaattaatttcctgctgatactgtccattcattcatttagtcattcaacaaatatgcattaggcacctagtgtgggccgggaatctgctgggtcctgcaaaaataatgaggaaacaaatacagggactgcctccagggcgatagaatctggagcaaacaaggagtagatcatctgtaatttccaagaaatgagtattttgaacatatgaaagtgacaagtacgatcgtcttccatttctttcaagaccttgatttttttttttttttttttttttgagatggagtctcgctctgtcacccaggctggagtgcagtggcgcaatctcagctcactgcgaccttcacctcccgagttcaagtgattctcctgcttcagcctcccaagtagctaggcctacaggctcccaccaccatgcctggttaattttctgtatttttagtagagacgaggtttcactatgttggctaggctggtctcgcactcctgaccttgtgatccacccgccttggcctcccaaagtgttgggattacaggtgtgagccaccatgcccggccaaaaccttgattttaaagatgacgtagggcccagctgtaggatatgcctgagagtgtcctgggaatgattctacaatctaggctaggcatgtagcatgtggatcagagagacaggtgagaaatagtctcagcaacctacttccacccttacttaaaattctatttttgtctatttctgaactacatccaaaggcctagttttcaatgtccttgcgctctgaagtgtagaggttggaaaataactcaactccaccgtcgtcactgactgtaagggcccagctctgattggagaggaagaagcagtttctccaacttttcgtgcagaagctcctcctggaatgtttgtgaaaattgccaatttcctgtccctgcatactgattgggaaggtctgaatgaggtctacggatatgcaattttagcaaccaccacacatctttctgatgcaaagggctcccagaaacacaccttgagaaacactgggatatggtttattttattttattttattttattttattgcctgtagctttatattatctcagacattgttgtggaatcagaagtactttaaaacttccacatgggtctgtgctcttctgttactgtatctaaacttggtggagggagctttcatccttctactgaaaatttctgaaaatgctctctacagcacagcattcagataatctaattgtggtgttcttaaccccaggtgaatattataatctcctgtggtgctttaaaaaaacagaaagcccaggctccacccaagagcagagtcagatgggaatctctgaggtgtgacacagccagcagtatttttaaaggtccccaggtaagtccaccaagcaggtacagaggagaagcacttgctgttctggatctgagacctcacctgctgcagcttcttctgctgaagataccctttccaattctgccccctcctctgctcacctacccgctgctcctcctgccctctggtgactgcattctgtgtttccaaagtcctcagtgcagctcatttgctctgtgactttctctcacctccctactctatgactgtccatcccttgcacttctcctgccaggctgggagtgccgtgaactcagggcctgggtgaggctgacatccagtaaaggtttgcaggatacaacggaatccattgaagtgccatgcagtggttttggatgttattttacttattttacttctttacatgggaatagtaggtatgaaagaaactgtggccaaggcaatactgtgaataaatagcaagtcattgctcaccactaagtgtctgtcaaacagctagactaagaaacctgattctaacatgcaaacctccaaactctaagattaatccttgttttttcctttgtactgcaaggctgagagatgagatagggagcagtagcggtgaggatgaagtgtatgcaggcacacctgtttgtatacaggtgtgtgcgcatgcatttgtaggtgtgtgcacttgtggatgtgcatgcctagcaagccagggtgtatgtgtgtgtgtgtatctaggaatgtgagtctgttaccttctgaataaatgtgctcttctattggaacacagattctcaagtgttttccccaaatcctcaatatgttcctcatttcccagaaaataaccatcagtgcaagaaggattgaagaacattttgtttatttatttgagatgaggtttcactctttcacccaggctggaatgcagtggcaggattatggctcactgcagcctcgacctcctgggcccaagagatcctactacctcagcctcccaaatagctgtgtctacaggtacctgccactacattcgcctaggttttatgattttattttttttattttgtagagacagagtctccctgtgttgcccagaccggtcttaaacttctgggctcaagtaatcctcctgcctcagcctcccaaagtggtaggattatagatataagccactgtgcctgtctgaaaaacattttaaatttacatttatccacctgtgtatgtttgatgacacccactagcaaggaaaaaacttacataaggccttaccttgttagtttgtttaattagcataaaaaaccttgaaaagaatttccagttggcattattactacattcaactaccccattgagagtgttctcttacaatgtgtggaaatggattatctaccctcatgtaattagttataaaacaacctgcatgtgtaatcaggggtcagtattcatgaatacaaaatatgtgtattgcttagaggcagttctttgtcacaaatcacctctttggcaacagttaatttttgcaactaagaacagaggaacacgccctctaaaaagtctgtcttcagtggaaactttatatgaaatgattttgtggataacttatatttttgtcccacacattctgatgaaacgtacggagtgcaggcatgggaaacacacaaaatacagactatgagtttccataaagaaatgtgagtgttttgattgacagggagggttgacctacgggagaactgggacagtttctgtggtgtgagtcacataaatctgacttctaaatacagataaaatctcagcagaaatttctgtgcaggaggttaaagtgaaactttgctaatcaatacatatgacccaaaggcatggtatgttcctttaaatatccttggatctgtttggtctttcttgccctaaactttgactggaccacgagcccagggagcagtgagggctgctgaactggcctcactagactctgagccatgtcagagtcaactaactttagtgtttaactttggacattgtcaagattattctggtcttttaaggtcctgacagggcagagaattgcaaataccattttgcttgagtaaccagtgtatgtggttgggaatattaaacaattaacatatctaatattaaacaaataattttctgaggacattttgagagttcttcaaccacatataagtaaccaatacaaagtggtatgatgatgacagtgtctcaaactatcaagtgcgccagcatcatcgggagggcttgttgacacataggtcgctgagccctaccccagagtctctgattctgtaggtctgtcgtgggtcctgagaatctgcattcccaatgaggccctaggggaggctgacgctgctggtccagggatcacatttttaaaaccactggtgcagggagactccaaggactactggacctcagaagagagagactgcttccagtttgaagggaacaagagttatatacggcgttactgctgggagctgagcatgtgttccttatagatcatcccattgacttctgagacagtgcattggaggagaggggaatggagagggtaagaaatatgaagaggagtttgttagaagagatttccctcatggatagtagggagaaaaagactgacgatatattggcagttcccactggaaaggtactggaaccagacgaaatgcagttcttcttttctttctaaaatctgcatcaggtacattgtaacaaatctccaactgaattactcagaccacaataaagttttaaggtgctagacagatgactaaagaagtgatttcatttaaataacaactgcaatcactgacaggtcctaggtgagaacttgtcagggagcgaatggccaatcgtggcagggagagacaggatgcgtcggtgattggtgtgagccctgatggtgtgaggtgacagcgggggaggacgagggctctgagcgcatgtctgttttctcctcacctcccagaaactctcaaatgcccattatctttgccatcatctcttcattatcatcacgtaatatttatccagtttactcatgcgtatagccctgtcttcttccattctgctccaattttcttcctcatttctctttctcttcttggcttgttctgaatctactgatttttttccctctggttgccaactgtgaacatcatccccacccactctatcaaggatttgctttttcagaaatggtatccaactggagatgcagcatgccccgacatggttcttctcattcattggaagggatcacacttattggacagaaataatttatcatgcagtaaactgtggcccaagaatatgaaacaacaaccaaaaggaatatacagatgcctggataaggaattagggagggaggggggcagatacacacacacacacacacacacacacacacacacacacacacgcacgcatacacacacacacaccgcccacacacacacacttccttttcaatggctacatgtttactacatttctttggaggagaaaatgctgatgttttgtggatactggtagcacacacacattttgagatcagattaagggaatcccaactagtccagccttggatcaggagcctctccatcccccttacctcatcaagacatcgctcatattgttccctttgattttcattctccaaagccaacgctgaattctctgcctgcagtaagatacaaaaataacacaaataaatcaatgaaatgttgtgttatgtgacaacttattccatacagttactaaatatatctcctcgtgatccaaaacaatcttttagaagtacctatgacaagttcactctaagtactattataaatatcgcagggatgacttctgtcttaccaacttgctcactaaaatacatgagaacttaaagaaatgcaaaacttgatattctgaacaggtagaaaatcaaatcatggtttgatgtgagagtgttccgtaaaaagattacaatgtttattttattctgtgaaaatgtaaatgggagaaatgccttaatccacttcattaaggcccatcacagactcacagacttatatttgtttaggccacagaaaagaatctcacataaagtcatgaaagcataattccaaatgcaaactaaatatgttactttcattgttagtcaatgacttacgtacataagataatgagaaatgtaagacttgaactatacttaagcatccccttccccacactcttgtaatattactgctttctcgctccttagagccatgtgggtatgtggttgaatatggttactaggttgacatgtagaatagtaaggggaaagaaaagtaatcactggaagcttattaggttttagaaggagcgtgaaatgctgatatgaagctgccctccacctcaggtgacctggttccactgcaggttcctgtctgaatcttcaactgtgccagtgaacccttcccagggctatgacaatgaccacccgctctaagcccacaagcaatcttggctctacgtgccccttctctaaaatcctccttgacatttggaagtaggggtatagtaatctaaatcagtattttcaaaattatggtatgatttttaggtggtacacagatcaacattttaacttcatagttttttcccatccgtttttctaaaccttttatttggaaataatttcaaacttatatcaatggatgaatggattatggtatgtatacacaatgaaatactatttggccataaaaaagaatgaaataatatcatttgcagcaacatggacagaactagaagtcatgttaagtgaaataatctatgcacacaaagacaaatattgcatgttctcactcatatacaggagctaaaaatgtggatgtcataacggtagagaataaaatgatagatactagaggctgggatttggggtaggtgcgagaggggatgaagagacattggtcaatggttacagatataagttagataaaatatatagttaaataaaaggtgtaagttctattttttgacagcagagtagggtgactatagctaacaacaacgtattgaatatttcaaagtagctagaagagagaacatgaagtgttactaacacatagaaatgataggctgggcttggtggctcacttctgtaatcccagcactttgggaggcagaggcaggtgcatcactagaggtcaggagttcgagaccagcctggccaacagggtgaaaccccatctctactaaaaatataaaaattaaccgggcttggtggtgcacacctgtaatcccagctattcgggagaatgaggtgagagaatcacttgaatctgggaggtgcaggatgcagtgagtggagattatgccactgcactccagcctggaagatagtgagactccatctcagaaaaaaaaagagaaaaaagaaatgataaatactcaagctgatggatgcctcaaatactgtgacacaatcattatacattctatacctgtaacaaaatatcacatgacccataaatacagaaaataatatgtatcaaaaaacaaaaaggatagcattaagaacctcacaaatcctttcctaagattcacaaattgttaacgttttgccacatctgccatatcgattcctttccatttcttttctgtacctggaaagtaccttgtagacatgatgcattttattcctaaatacttccacatgtgtttcctcataacaaagtcattgtcttgtacaatcacagtatagttgttaatttcaggaaatataggaaatataaatacagtaccacaatgtgatctacagttcttccagtttcaccaattgtcccaataatgtcattgatagcaatttttttccagtatacaatcctacctgtgatcatgtactgcattcgactgtcattgccattcatcaggtaatctctaatccggaataccttgccttttatttatttattttttttgagatggagtattgctcttgttgcccaggctggagtacaatggcatgatcttggcttactgtgacctccacctctcagggtcaagtgattctcctgcctcagcctcccaagtagctgggattacaggtgaccaccaccacacctggctaatttttgtatttttagtagagatggggtttcaccacgttggccaggctggtcttgaactcctgatctcaggtgatctgcccgcctcggcctcccaaagtgctgggattacagacatgagccattgcacccggcctggaatagtttgtctttttatgttttttattttcttcttcccttcttttcccccttatttcctcttcttccttacctttctttttttttttttttttcctttctgagtagaggccagttatgttgttgaacatcccttaatttgggcttctctggagctccctcatacatatttggtggaaacagtgcacaggcaatgctgggcccttctcagtgcatcatagcagccacgtgacatccatgggacctgctgctggacatgttaactttcatcacttggttaaggtagggtctgccaaatctccccactgtaaagttactgattctcctcttgcaattaataagtaatttgtggggagatactttgaggctatgaaaatatcctattgctcatcaatctttcacctacctatttaagcaaccatcaatgatttttaaccaaatcattgattaccttggttgcatatggtgacttctaactccatttttctatctacatttatgagttgacattcttccataggtaagtgattttcctatctgttagtatgaaaacatcaattctgataattttgatgttcaaatcactccagctttgggcaggtgagcccctttaagctggtgtctatatccttttgacatgtacccatcatttcttaaatactttctttttcagcaaaaagagatgttctaggaccatcttgctttttccttgcttcaatccctgaaatcaggcatttctctaaggaattctacttcctcttacttggggaatgataattgggaactaagatctgggtgttagcctgtatcagttgctaccaaggagtcactgcttctagtcgctttcagtggaaggatttttccacactcctacatgcacaggctcaacacccccaccccaccccaagccctacaggattctttcgtatcttctccttttcatattagtatcttcctttttgtatggttagcactcaggctctcagcattattttaactcctttgttcaatcttaccatgtgtacaaaattggtacgctacccaaaccagtgctaggaaaagttcagttttgtgtttttctttagaacaaaagtataaagtaaaaatactgtgttccaaagttactaagttggtttttcccctcctccccttttagtgtgtttatattattcatttgaaattcggttcagttcatttgtttctgatagtattcaaatttaatttcctctcttcttaattacattttgttttttagaatacataaaacattaacaagaatccaaaagttaaaactatattaaagggtatatattgagtgcagtgtccctccctctcctgcctcgttcctttctacctctcgaagattctttaatagtgtcattatcccttttttgtcttcctctgttacttttaaaatcatgtcctttggccgggtgtggtgattacaggctcacacctataatctcagcactttggaaggacaaggtgggaggatcccttgagcccaggagtttgagaccggcctgggcgacatagtgagatctccatctctactaaaaataaaataaaataaaaattagccaggtgtggtggtgcatgcatagagtcccagctactaaggaggttgagtttggaggattgcttgagccccaggaggtcaaggctgcatgagctatgattgtgccactgtactccagcctgggcgacaaaaccagaccctgactcaaatacacacacacacacacacacacacacacacacgacacccaccatgtcctctgactccctcctattacatatccaacaatcacctttcttcctttctctccttttttcctgctattttattagttgcatacttcctactttgccagggtatatcattttcacacaggcttcttccacctttgcccccacccttggtttggtctccttaatggataatggctggttggtcttatgttcttttgcttctgtagcaaaagaaattgctttgaaattccctcttttccttttccccttcacaaccacgtctccacactgcacctcctctttcccctttatctccttctttcccggcaggctgcctctctgagacagccacctgggtctgctcactttccagccttgcccaacagcccactggatctgccacgtgtccacctgtgtgcagtgctggccttgggctttctcatttcctcggtgccctctgctttccatctccctgggcacacacgctggcagcaggagttacatgggtatctggtatttatttttctacttacagtaatttgaaattcaagtgttctctgttattgataatgcagaaggcatgggttatatgtggttttatttgtgtttcctggtgatatgaatgtcttctttggcaggtgcttgaaaagtttcaactgtaggctagtttgttactttaatcaacaatgaaacttaggagaaatgattgaaccagaatagggcacaaaaatgaggaaaactcccggaaaaagtctgtttgagagtgacttgccattttgatcaaggtcaggtcatttcaactcagtcacggttcacattccagaactcctcaaacactgtttcttcttcaggttacagttttgatccttggctttgaccttgttgctctggggctgaatccgttttaacaaacctgtgaacaccccagtccctcaggtgggatcctgccacgttctttcaggtctcataatggacagacatctgccacacagcacgatccttctgtgctcaggctgatcatccgtttgccctttttaagcacagttattggttattcccagactgtttcttctcttcattcttcaccaaactaaactgactttgctgttcccttcagggattgcttttggccagtcccatggaagcttttccgtctctgcagctgagatggaacccctcagttcctcctccagaccaaaaggaagagcaggctccggttccagttccattctgttgcagtcttattaggcaatgccatcttgagtaacttttagcaagtcacttaccattgctgggtttataatttcttagttaataaacaaagatatccaacttgccaatctaaaagcgatttccagttcaaatatttggataccatgaatcacggaggaaaatgctagaattccaattctacaaagtcatgatttctttggagaaatttaccttttgtggagtctgctgattttagtaagccagcagtacaagggataatgggaagagagataaaggagagaactgcaaatgccacttcacactgtttactttaaatgtcttggaaaaaacatgtatggaaataaagctgaaaatgggaatttatatgggatatctacacctcgctcctacccacaatatcacgttgcaaaaacactgcaatcgatccattcagataattaccgtcattataccgtttacattacttgcctcacgtttactgctctgacaatctattactgccaagcaaattaaatacctaaagggtgctggtgaaagcacaatagtcacatttatggttactgtgttcagttacagagaccaatttaattgatgtaatcctacatatcccatgggacaaaaaagatattaacaatcatgctggtgaagttaaaataatcttgaactgatgattttctttaatccatttgcatttattagagattcaggattaacctgctaccaacttaaggcaacagagaaaaaaaaaacaggaaaaaaaaccctcttaactaaatgtgatttaaagaaacagtgaatatttatatagcaggaatgggaaaggataagcagagagggaaaggaaagagaaaatgcaagtgtcactattaagaattacagacatcacaatacaggtctttttctactttaaataagtatgttattaaagtcaatatgcccagaggatgcagttagagcattcaagtaaatgtaacagtgaatctttgcattcagctttgtcttccacaacaatcaaaaacttttgctagacttagcccgggatttcctgctcagcgtggtttccccatggctccaaattatagtggtctaaatatgttcatggtttcatctctaaaaatccttaaatgtccttataaaatcaaagagcatcacagagcaaatccgtattggtttggtttactgtggaaaaggggtttgacttgatacgtaaaaggaactgtgtttcttagaggtcctgctcagtgaatagataggctggctggaacttacgaatgattgaaaaatctgatgcttctaaagccactgtcctacattaattctgtaagtatgtattatgtttaaaatctttgtatactataaatttgtttaatagatccttttccacagaccaaaggtagactactagctctacacaaaaatctgtcctctgcataacataacagctccgctgcaggcttttcacctcttatactttgtctccactcacttccatgaccttatatatctgattctccacagcacacaccatctcaagagtcaggctcagctcctaaagctcccatgctccttcctgggctgtacctttggttttgctgctctagcatggaacaagctttactctcccattggcctttctaaatctcactcagttttggtggtctggctcagatgtggacttgaaatacttaaatggggacacctttaaattaaaaaaataattggatgtataaaaatgtagcaaaatattgcaaagaattcccccacaccattcaagagactccccaaaggttaactattttaccacatttgcttatcatttaatactatctatacctggagacaactttttaaaaacacttgagagtaagatgaagacacaatgcaatgtccttttacctcttaatacttcggcatgtacttcctaaaaatacattttctatataaccactgtgtagttatcacattcaggaaattaacattgatgcaatagcctaatctactctacaggccttgttcagatttttccagttgtccctcaggtgtccctgtctagtccaggatccaatccaggttcacagagctgcatttagttataatttctctttagcgtcctctcatatggaacagttcctgaggtgttgtctttcatgatcttgatacttttcaaaagtataggccagttattttgtagaatgtccttcaatttgaattcgcctgatgtttcttcatagattttaatatttatggcgagaatatcatggcaatgatattgtgtccttcttagtgcattgtatcaggaggcacatgataccaatttatcctattactacaggtggagtatctctaatctgaaaatctgaaatgctccaaaatccaaaactttttgagagccaacatgaataaagaaatgtgcaatagagtcttttagattttggattttcagattaggaatgctgaactgggtaaatacataatgcaaatatttcaaaatctgaaaaaaatcagaaagttgaaacacttctggtcctaagcattttggataaagatactcaatttgtatgttaaatttgatcacctggtgaaggtggtatctgtgacatttctccactataaaattatttatttccttttatcaacagtaagtatcttgcggcaaggtacttcaagatatgtaaatatccagagtctttgagattgcaaatatgcaaatatctaaactttggttcactcctcttagtatctattggtaatttttttttgactaaaacaattatgactgtggtggttgccaaatagcgacttttatttttattttatctatcatctatctatccatccacccatagcaacttttattttatctatctatctatctatctatctatctatccatccatccatctttccatccatccatccatccatccatccatccatccatgttggtgcaaatgtaattgtggcttttgccattacttttaagggcaaaaactgcaattatgtttgcaccaatataatatctatcttgttacctcttatactttgtctccactcacttctatgaccttatatgtctgcttctccacagcgcacaccatctcaagagtcgggctcatctcctaaagctcccgtgttccttccagggctgtgcctttggttttgctgctctagcatggaatatgctttacactcccattggccaaatagtgactattggctctgtcacccaggctggagtgtagtggtgtgatcatagctcactgcatactcaaactcctgggttcaagtgatcctcccgcctcagcctcttgagtagctgagactgcaggcatgtgccaacatactccactaatttttaaaaacatttttgtagagataaggtattgctatgttgtccaggctggtcttgagctcctggtctcaggtgatcctaccacctcagcctcccaaagcataaatagtgatttaaattctactagtcttcctgcatttgctagtttgaaccttatcacaagtaggggccacacattttagcactttattataatgccttcaattgagatgagtagtttcatgagtattattagtcttctccagttagactctaagccctttgagacagggatcatgctttatacgcctcttttcaaaggagtgagatgtaaattagtgtattttaactatagctatgggtggaaatgaaaattcagtttgatatttagattcacttagcatcaatgcgtttgttggcatggaatatgtacttttacctatgtcatctcagtggtggtcatacacacatgtggatatatactgatgtatcttttaaaaatattatagacaaatgagaaattaaaccagtgataaccaacttttcccctttgcaaacatcaatataaatttgatttattattaggatgtctatattttttcttctttcttttttttgagacagggtctcttgccactcaggctggagtgcaatggtatgatctcagctccctgcaacctccacctactgggttcaagcaatttctcccacctcagcctcctgagcagctgggactacaggcatgtgccaccatgcccagctcatttttgtattttttagtagagatgggacttcaccatgttggtcagcctggtcttgaactcctgacctcaagtgatccacccacctcagcctcccgaagtgctgggattacaggcgtgagccactgcaccctgcccagtgtgtatattttcaaaatgaaagatgaatatacaccatctgacacattctgacaactgacaaaatatttaaagcttgtacttcgttatattgaatagtagaggagactgaggttttgcccctcacttataaatgttaactgcatttattactagtattgttgtagtagtagattaaagatggttgcaaatgctctgtgacttatcttcttgaatctagactggccttactgacttgattgaccaatggaaggaggctgaagtgccatctttggtcttccaagactacaccatgagcttttaagcttctacctggcctcttagaacacttcttatatgagctaccatgtaggcagtctgaatgttttgaggtggtataaagccccagctatgcagacaggccctggaggatgagatgccttgcagagagagataggccaggggacactgagaggccagccatgggagtgaaggagccatcttggaaatggatcctttcacctcccaacatcacatagattggagatgaactatccagctgtgtcctccccaaatttctgacccataaaattgtgagaaaaattaaattgttattttaagcctcaaagtgttgagatagttggttacatagcaataaataagtggaacagtcatattcaggaaacgaggtggaacatcaattcttttatgtgtacattcaattactggtcctttgctgtacctgcaggagctatgctgggggaaaataaagatggataaaatatacaggggccaccataaagaaaacaatagtctaatagaagaaacaagttaatttctcacattgaaaactacaatgcaataggatcagaacaaaaaaaaaatcaacaaacttcagatgaggtaggaaagaggtgaccgacccttgaatcagtctactcaacaggcaatcaaaacaatgacaaaggtgcacattggactaaataaaaataacacagttttgaacaaaatgccaagaaaatgacacctgacttgtattcaaaaagcacattattcaaccaggctagaatcctggatgtaaatattgtcaaattattatgaaagcaaataatgtcagacactatctaatacccactgcagagaaaaccttgggttcaacaatggcaaaaaaaataaataaataaaataacaaactgatcatatgcaaatgaaacaggtagaaatgaacagggttgagtggtgtggaggaaagaaggtggaaagaagatgtcctctgaaggcaaaaagagagagaaagagaagaaaacgaccaattcacagtagttaaaaaaggctgcctccctgtggctttcccacggcaaaagctggtcttttccagagtgacatctttcaagcttgctgaaactccttcaattcaggaaaggcagacaggtcagaataagatcagaaaaggtatttctctaaaataccaattcaactcatggtttggccccataggtaagaaaaggtgcttctgtactttattttctctttggaattttttccagccaaaaatgtgctgctttatgatggccagcctgtgtcagagtcctgtgccactctacttaaataacacacttcacaactctaggccatcccaacaatttcatttggggaggccaaagggctgtacctgcaggagctatgctagggggtatacaaagatggataaaatatagagaggccaccataaagaaaaaaaatagtctaatagaagaaacaagttagtttctgacagtgaaaactacaggcttccaagcaaaatacacaggtccccaaaatgttcctaattcccctgcagtctgttctgttttgaaagctgtttaaaaacatcctgaggaaaaagtcccaggggagtggctaagcgtgccagccaggtgagtgcattttcatctgctagagtgatataaagtctgaatacaaggaacaccaagaactggagctggaatattgaatccccttccctctatgattataattcaaacttacggggtttctgaatcactcatcttatcacacctggctgccatagtggccatatgtgtagcgtagttggctaaagggtgttccccactgattgtatttgagagcttgtacagtatccagacccagacaatgtctagggctgctgggcatcttggaggcaaatgttatcatcctagaaaatgtcaataaagacattaagctctgaccacctacagagaaacaaatacgtgtacccatacatgtgtgaaggcatcctcacaatgtccttattcttggactcaacccattaggtttaggaccagcacaagacactaaggatataaactacattaaaatgaagtctttgtttaaaaaagttgaggagctacgccgtgagaagatgtgatgtagaacctgtccacaggttcatttttgaagagttgaatagaaaacacttcataatgaaacctctgtgtacttctagaatttaaacgtttggatggggcttcaggccagtggttggaaacttgagtgtgcattggaatcacttggggggttatgggatcacagactgtgggggagccaccctcacatttggattcagggcacctacagtagggtccaataactgacatctctaacaagttcccaggtgctgctgctggcctgggaacagcactttgagagctagtgctcaagatggatcaacttcagggtgaaggtgggtgtcacctccttcttcccccatgctgccattgccttggaagcattcagaagtctcttactgcttctctggaactggggggtggtaaccacacaattttatacttttccttctcttgttttgtttatgagtctgcctctctctcctacatcagtgactctcattgggagaaaacagcctaagggcatagatcagtgtctctctgtgtgtgcatatgcatatgggtgagtagaacagaaaaaaactgtgtgtgatttggaaaaccattatttgatgctgcattacatctggaaaataataaacggtaatgctttcatgatacaagaagtcagctcgataatttccttgcccagggggatatacagaaaagaaatccatgcctggagtgcgaaggcaagaggagtggtaaagcagatctatcttcctaggaggagagtaagataatctgatgggaagtgacggcgtgcttttcaaatttccttttatttgaaatggatgtaaaaataaatgtctgtcactgttttgggttgaatgagatgatgaaggcagaatgtaacgaacatggagcctggccctctgtatggtttggtgaatggcagtttccttcagtcttttgtaaaacagctcccatttgtaaccacggccactcacaggctttaatgcagggggtggtggtgtcagccaggccagaaattgtccctgctgagggagagattttggccaacagaaatgtaccatgggtcctctggattggacagtttaaacaggctcacatacagattagcgtcaggtcctgattcttttaacccacagtcttcctctctcaccctttcttcttctctttctcaccttcttacttctgcttccagatgcccatttatcaactcattattacatttatcaactcaatattacatatctgagctcaagatacaacacgtattttccaattatgagagaagctgaaattttagggactccaaaatttctttgtaaaaacaacctttaaaccttaaaacatattccatcccccaccaccagatgtgctttcagagatacaaatctatgactttcaagctagggtggactagagtggatttttcggttttagaagcctcacagagaaatttcatggagctaaaaaatgtaaaacaatctgatcactctgttgagtagagaatatttgtggcattaaccaccaggtattttagaagttaaactatgcaaaactcattgactgatttgcagaaaagaatatcaattaatatattgactttattacctcatttaattgaaggcccccaaactctgaggtagataggatcagctccattttacagatgaagaaaataagagactatcaatataaatcctttgtgttgcagagatagtttatttatatacacagtccttattccttactaaggacttaatacagtactttgaagaaaaaaatataaatgacaatagcctgataaatgcctaaataccagcgtgtttgaaccctctctaccaagaagcaggtaattcaggtcaggaaaaagactgagaatttctctagaaataggaattcttgacctctgatctataaaaaagctgaaaaaaaaaaaaaaaaaaccagaaaggaaaaaagcacagacatagtcattctaggaatcatttcatccaaaagaggaagccacttataaagcaagtttaaacaacaacaataccattacacaccaacccaactggtgcaaatgaaaacatcttacatggcaagcgttggtaagaatgtggaagaacaggcacactcatgtgccactggtgggtgtgtaaattactacacccattttaggatactttggttcaacttgctgatagagaagatgctcatagcttctgacccagcaacgccattgctaggtataacccctgtaggtacccgcaaacacatataccagggtgggtgtacacatgggttcacagcagtcttgttttctagccctcagacagaaatcatctaaactaagattgacagtacaatgaataatttttattaatcaatttatataatgggatactatatagaaacaaaagccagtgaatgagaactgcatattgaatctggcaatgataacattgaatgaaagaggcacaacatatatttaaacacacacacaaaatcttccaacatgattctacatacaaagttcaaaaactggaaaaattaaattatattgttaaggatacatacataggaggtaaaccatattctttcaaaaagcaagcaaattattattacagaagtcagattcatcattaccactagtggggagaaaggaaactgtgataagacaggagcccatggggtgccctaggctactagcaatgtttcatttgtggacctggtggcaggtactcaatgttttgcttcattattttttaattataaatatacatttttgggcatacaaatgtgcagtcttctgtaaacatatttcacacacacacacatacacacaaatgtacacactctaataagtaacagagccctaggagagggcctgaaggaaaattgtggaagggccctggtgtacccgggcatcccgctgccactgtaatgggcccagcaggtggacagcccatgagatgagagagggaagacactgaggcggatggagccagttgctgaggcaaagggacgggaccaaatgtatattttaaggaaggaatcctggcaccagcaacaaagagcgatggaaggggaagatggggagatccaaagcatgctattgtagcattcctttcaaggatgacctactcctgaaataaaacagcggcactgaggcgaggaagacctacatttgagaaagaattcagtacagattcatcagctcctaaccagtacctagatgagaaggagagccaaagacgacactgagttttatattctgggtctccgccagggcgataaggtctttaatagaaatgggtaacaaagtgagataaagtgccatgggagatttttagaaaaaaacctattgccttgccatgtaatgacttttttttcttttcctacagggaagaaaaaattgcagtgaatgtatgactctagttcttaaggtatgccagcagtcacagcgacctctctcccctttctttccattgtttgcatgtttgtatgaaattattttgttcagggatgctgactgctcactctaactctccttgttctctcaaggatgaatattgtccctttgcttcagaaaccacaggattaaactttagggagattatatattaatcatttaatttgatcatcaggcatgagctctggccttcccactcaggacccctggccttgcagctagtggtgcagatggacagtagcagggtgacagagggccgccctccgccctgctccccaatttcttctgcctccagcatgagtgggtgagcagcagtggctcaggagcaccaggaggctcgcagcctcctgccgttctgcgaggacaggaggacagggtgcagtaggggtaaagcagtgtctaagtggaatttagcttgggcattgccagcatctgagagggaacataaggacttgggaaaccctttgacttgtttttgtcatctggagtgtccttactttgcctaaaaaatcgaaataagggccgggcgcagtggctcacatctgtaatcccagcactttgggaggccaaggcgggcggatcacaaggtcaggagatggagaccttcctggctaacacggtgaaaccccgtctctactaaaaatacaaaaaattagccgggcgtggtggcgggcgcctgtagtcccagctactctggaggctgaggcaggagaatagcgtgaacccgggaggcggagtttgcggtgagccgagatcgcgtcactgcactccagcctggagactggagtctttgagactttgtctgagactctgtctcaaaaaaaaaaaaaaaaaaaaaatcaaaataagatctggccatgagagagaagttacctttgatttgtagcagttctcaaaatcatcattctttgcagaaacaattattagttcagttttgtatatatgcagcatgagagcaacatctggaagacatctagccagaagctggaaatgtaggtctagtttaagaagccagggctggagtcattgctgtggctgtgacagagaagaacatggaagctacagaaaatgatgatgatgatgacaatgacagtcaacaggtgctgatgattactatgtgctacactctgtgcttagccctcaacaaactttatcacaagtaattctagcaacactacaaaagagacatctgttgctagccccattttacagatgtgcagtctgaggctcagagtggttgagtggctttcttcaggccacacagagctaactgaatgagaaggactcaaaaaaaaaaaaaaaaacaaaaaaaaaaacacagtaggccaggcgcagtggcccatgcctgtaatcccagcactttgtaaggccgaggtgggcagatcacctgaggtcaggagtttgagaccagcctggccaacatggcaaaactccgtctctactaaaagtacaaaaattagctgggcgtggtgggaagcacctgtaaccccagctactcaggaggctgaggcaggagtatcgcttgaacccaggaggtggaggttgcagtgagccaagatcacgccactgccctccagcctgggtgacaagagtgagactctgtctcaaaaacaagcaaacaaacaaaaacaaaaaaacaaaaacaaaacacagtaaacttctcagcgttctgaactttcaattgttttgtcataatgaaattacgtgaaaatgaatcccattctagaaaccacatttcctgtttgcaagttcaagaactaaaagtgggtggatgatgtttggtttctctgtagagaactggcaagcagcaacgtttgctttgaaaatcgtggaaaacgaagagcactaacagattcatacaccacccttgttcctctccttctagcttttaaaatttcctccgtttctttgtgtaagtgagtgggtaggagttggtagatatttctaagcagttaggaccctgaggtgataagggttgaggggaactgaaatgtagtttcttatcgagggctggataaaggaagaataaacacctcagtttacagctcagctcaggtgcaataatagacatgtagactgagaagctggcagccaccaattttattaaaagatttttctgtttgaattacatatcattttaccaagagaatattgaatcattgtgcatactgtgtacttctccagtgatgctaccaaggaggtattttatacctagatgatgtctcatagagaatcttttaagtataaaaagaatgtgttatccagagacctggctttttagttgtagtctggcattttagaaacactgtccagcagcatgatgtggcagagagaatggctaggaacacacggtttcaagctcttgcatttaattactatgtgacattgatcgagacactgaactcctcttagctttatttttttcccttcataatcttactagaccacatcatctccaaagtcttttgcagccataaaatctcagacagtatgaatttatatagtaattatccagagataaataatcatggaatcatagtttgaggtgacagaggatgaaattttaactgtcttcatagtagaataatccattttataaaattgtgaaatatatggtgctcacttcttcctttccttgattccatgagagggtcagcaaacctccactaaaaccctcagagcatggctggccttattctctaaaccagactttgatgcaatctgttgagcagagagaagcataacaaagccagaatgaagtctcattaagacaaacatggatgaaatgtcaggctgggaacagcaaagcttatttctatgtctcaacagatggctgggaaaacagtgtcttgttgatcttgttagaataaattatatacaaagaagctctctatataatgctagagtgtgtatgcagtacttgagtgtatttaacatacctatatatacatacgaatcagagtttctcaaccgcagcactattgacattttaggtcagatagttctttattttgaggggttgtcctgtaaactgtagaatgtctggcagcatccctggcctctacccactatctacagacataccttggggagagacatcatgagtttgatcatggattccagatcaccgcaataaagcaaatgtcagaatcaagcaagtcacacgaattttttagtttcccagtgcatgtaaaagttatgtttatattacactactacactatagtatattaagtatgcaacagccttatgtccagaaaataatgtacacaccataattcaaaaatagtgcattgctaaaaaatgctaacgattatctgagccttcagcatgctggaatctttttgctagtggagggttttgtctccatgttgatggctgctgactgactagggtggtagctacttacggctggggtggctatcgtaattccttaaaacaagacaacaataaaggttgcagcatcaattgactcttcctttcacagaacatttttctatagcaagcaatgctgtttgatagcattttacctacagtggaacttcttccagaattggagtcagtcttctcaaaccctgccaatgctttatcaactaagtttatgtaatatgctgaaatcttcgttgtcatttcaacagtgttcacagactcttcaccaggagcagatttcatctcaagaaatgactttctttgctcatccataagaagcaactcatctgttcaagttttaccaggttggagcaattcagtcacatcctcaagctctgcttctaattctaactctcttgccatttctgccacatctgtaattacttcctccactaaaggcttgaccccttaaaagttatccattggggttggaatcaaattcttccaaactcccgttaatgtttatattttgaccttttcccatgaatcacaaatgttcttaatggcatctagaattgtgatcctttccacaagggtttcaatttattttccccagatccatcagaggaatcactctctctgccagaaatagccttataaaatgtcactacttaaatataagacttgaaaatcaaaattccttgttgatccatgagctgcagaatgaatgttgtgttagcaggcatgaaaacaacattaatctttttgcacatctaccccagatacttcagagctcttggatggcaaggtacatagtttatgagtagtaatatttggaaagggatattttcttctgaggagtagactctcaaaagtagacttattagtaaaatattctgtgaaccatgctgtaaacacatatgttgtcacccagacttggttgtaccatttacagaggacaggcagagtatgtttagcataattgttaagggccataggatttttcaaatggtatatgagcattggcttcaacttaaagtcaccagctgcattagtgcctaacaagagagtcagcctgtcctttaaagctttgatggcgggcattgacttctcctctctagctatgaaaatcctagatggcctcttcttccaatataagattgacccctacatcaaaaaatctgttgtttagtgtagtagctttcatccattatttgaactagatcttctaaataacttgttgcagctttacatctttacatgaagcagtggttgtttcaccttgcactttcatgttatggtgacaccttctttccctaaacctcatgaactaccctctactagcttcagacttttcttctgcaacttcctaacctctctcagccttcatagaattgaagagttagtaccttgctctggattaggttttggcttaagggaatgtcgtggctggtttagtcttctatccaggccactgaaactttctccataatagccataaggctgttttgctttctcatcattcatgcattcactggagtaccactgttaaattccttcaacaactattcctttgtactcacaacttggctgtttggggcatgaggcccggctttcagcctgtcttggcttttgacatgtcttcctcactaagcttaatcatttctagcttttgatttaaagtgaaagacatgggccgagcacagtggctcatgcctataatctcagcactttggaaggccgaagcgggcagatcactggaggtcatgaattcgagaccagcctgaccaacatggtaaaacaccatctctactaaaaatacaaaaaattaagcattgtggtgtcacacacctgtaatcccagctactcgggagcctgaggcatgagaatcgcttgaacccaggagatggaggctgcagtgagctgggattgagccactacattccagcctgggtgaaaaagtgagactccatctcaaacaaacaaacaaacaaaaacaaacaaacaatgaaaaaaaaattaagtgagagacatgttcctcttccttttacttgaatacttacaagcagtgtaggttgaataattggcccaatttcattactgttgtgtctcaggaaatacatggcccaaggagagcaaaggagacagcagaaaggccagttggtggtgcactcagaacacatgcaacaggtaccatgtgcaccttatataggtgtgcttcatggtgccccaaaacaattaagtatgtcacatcaaagaacactgatcacagattaccataacagctgtaataataatgaaaatgtttaaaatcttgtgagattataaaaatgtgaaaaggagacacaaagtgagcacatgctattggaaaaatggtaccaacagacttgctctatgcagggttgccgcaaaccctcaacctgtgaaaaaaatgcaatattcacaaagcacagtaaaatgaggttatgcctgtactagtagcatccccttcacctagttttgataataaagatgtctctagacatggctaaatgtcctgtgtgagagatacacatacaaccacacacacacaaacacacacatacacatatgaattattgtacatattcatatatacacacatacatcaatgacatcagatctatactggcatggcactttcaacttcatgaataaattttctacatttttagaattagaagggtttgaggtatcaagtccaaccacataattttatagagtatgaaaactgttatgaaaactactgttattaacagactgtagcccagaaatgtaaataatgactcttacccagtgactgtaatttatcttttgttattagacacaagaacaccagattgagaccagcctggccaacatgtgaaacctcctctctactaaaaatacaaaaattagccaggcatggtggcaggcacctgtaatcccagctacttgggaggctgagtcaggagaatcgcgtgaacccaggaggtggaggtggaggctgcagcgagctgagatcatgtcactgcactccagaccgggtgacagagcaagactctgtctcaaaaaaaaaaagaaaaaaaaaaaaaaaaaagaacaccagaactggaagagatctcaacttcactcaacccagagtctattttacaaacaagaaagttacatctctactttttgcttttctgcccttctacccattacactgattgtttcgatcacttgttctgacagatttggtattaagtgaatcaattttattcctcaaagtggtagaatctgtgcccaattattgggagagacaaactttgcagagcatattccctttgttcaggtaagtggtgacaggttgagtcagctccaggctcagaactcacatctgctgagttccacttaggttttgtggtagcaagaacacaattatctagtcaattgctctggagggaacatcatcttgaaaacatgaccaaattcacaccactgtaattaatcagacaactgctctagtgtgatcgtggttaccactccatagaattggaattgtctttttaaacccgaggagacactgctcactttaaggttgaactttatagaagctggtcccacatttggatgctaattagcaaaataatacccacaatgcaacctgattaaacgtttcacccatgggtggaaacgcattaagtaaacaatgctgtaaataaaataagattgtgtcaacagaatatatttgtgtcagtatgaaaaaatacttaaaatcccttaaaaatagctcttcatattttaatgtcctagaattgttaacttttaaagatgaagattttgggggattatcaagataggactatagaaagaatttatttaaaagagcaaaaggcagtgttgcactgtgcattaattgcatgtaaagatacaccaggaacttagaagggtctggttccaatttgcaaatgctagtacagtacatgttttcatccctaatcatattacatcatctttgtgtgtttgagggcacagataagacttattcaaacttctagttgacatgcattttgcttttgaaaaccaaaggttctcattttctattagcttttgtgctactagtttcacagcatttgaagattcctgaatttctgtgcatattggtttttccacttatcaatattcatatacagaagcaattattactgtgaatcaccatgataataaacccgattttacagcaccaaagtaaagagaaatctgtatttaatctccatttgtctgtactggaatgaagtattcttaaatctgagaaagtcaattattattcaaagaacaatcacagcatagttaaaaaatgagaaatccaggacagcagaaggtgtaaagaaggcatttatcagacaccaagggaaaagggaaagacggttgatagctgaggtgtccagttaaaactcaactagcaacacaaatctctggtaggtatcactgataaaggtcaaggggaacagagttatgacagtgaactttaaaaatactgacaggaaacaagagtactggtttccacgtgtgttgccttgctattcacataaaaccattagtcctttcacagaagggtttattgatttacacagatactcgtttgtcacatcctgtagagtacattaaaagctgcccaggtatttcaaatgtacttagcaaatttgccttctcacttgtgtgcagtctggaatcttggctgtaagatagttttcagcataaaaggcttgattgaagagaaagtcagcaacttaacaaaagaatcgccgtgaggcctctttgtgatgtcttaccaagaagctgctctcatggctggtggacattgatggggaattcatcatgtgaaggggacttaacacattagatgcacagggattcacaaaggatgaacaacacagttttcctcttgctcatccccataatattactgacttcctatgtagtttgtcacttccgccagatgtgactgccacatgcccagtcctgtgtcatgtaggaggcagtgcagagtaactgataggagaggtggctttggcatccacttatgtaggtgtgaattctgattccacagcttatcgacaccctcaccctgggtcacttgcctctttaccattcagtttcccaatctataaaatgagagtaaaaacagtacctggatcacaggttgttgtgagggtcacatgggataatgcatggagagcactgaagaagatgcctagtctaaagtgatgccaccttgtagagctgcagctcccaccccccttgccacatgggctactcataaattaactaacattaatttaaaccaaaaatgcagttcctcagtcccaccagacacatttcaaatgatcaatagccttgtttggctaaatggctaccattttggttaaatggctaccatgctggacagcacagatagagaacatttccaacactgcagaaagttctattggatagtactattttagagggtgacttacatagttttaactttattaactagtttttaataagcattatcatttaatctgaggcacaggcccgtgtctgatagtcactgaaaattatttaatgtgttgatgtgacaaatgtatgttgacagacctcaactcatatttgtatcacttcctttccttctaaatcatgctttcatgtttatctcaatttatcctcacaatatccttgtcaggtaaatacatcagacatctattattttcatgtcacaggggaaacagaatgtgtggtatatgtacattcagataagcaaataatgtctatcttttggagggttttgagagtaagaaacagattaggcaaggtagactacttgggaggaagttcttattttttctggttcaaaactagtaagagtttattaggagaaacttgaaaaatacacaaactatgatgaaagcaaatattgttcaaacttatgcaacccacacgtaattaccattaatgttataatgtagcttttcaggggtataaaatatacattgtatattacaatttatgtattgggtgataattctttttcttgtgacatagagtaaatatttccccacaccattaaaaatatttgataatggcccggcgcggtggctcacgcctgtaatcccagcactttgggaggctgaggcaggcggatcctgaggtcaggagatcgagaccatcttggctaatgcagtgaaaccccatctctactaaaaatacaaaaaattagccaggcatggtggcgagtgcttgtagtcccagctacttgggaggctgaggcaagagaatggcatgaacatgggaggcggagcttgcagtgagctgagatggcgccactgcactccagcctgggcaacagagtgagactgtctcaaaaataaataaataaaaattaaataaataataaataaaaataattaaataaaaataaataaataaataaaaattaaataaaaattaaaaaatatattcgataacataatgcatgcacaagattgtattatgggaccatactatacgttatttaaccatttctcatgtttgctgcaaggattatgcttaaacataaatctcattttacatcatggagtattttgaaagatagagccctgcagttacaactactggatgaaagccctagaactttctcagggacttctagtacataggattactttgctttctggaaaggctatatcaaatttcacttccccaggagcatacgtgagaatcaccgcccactgattagtaccatctaaacattttgccaattttgtacacaaaatatcctcttttcttatttcactttttattgccttggtctcatgtgaggctaaaattttcccttgtgttaattagctaatggtattttctaatctgtggattgtctcttcataccctttgccaagcttcctgtcacaatgttcctgttatgagtttatactaaatcttcataatgaggatagaaaaaatctagttctgatgttttctgtttgtcctttaatgttgtttctgatatttctgatatttttatgttcatagcatttaaatgtttataaagtcaaatcaatcttctttttcctttgtgatttccttcattgattttgtaatcaaaaagtccttttcccacccgagcaaacttaaatagccacttttgttttcctcaagcttaataatgtttcaattatcttttttttggtacatttatctctttaatccacataggatttatgttatgctgtcacataagtatcttctttctttccaaatagtgatattattgtcccagaacatttccagaatcagttttgcttctgtgttgatatacaatatctcctttacaactattaaactgttaaattttgcaagacttatggcagcatggcttattctgttttatggatccaccttatctaaaactgtaatcacacagttttaattactgtaagttcacatcgtttcaatatatgatatggcgagccagcatttgtgagtcctctcttttcgaaacatttcttggcttgtttattgttctacatgaactatagaaccatttcaaattcttcccatagctctcctctaattctactgattttttctacttgtcaagatttaatccaaccttaaattttgggaaaaagtatcagctttgtaatatttggcctgcctatcttggaacatggtatgtctctttactaaattctgccttatttcttacaacgagtgttatagttttctttaaattggttttgcacattttaaaaatagtattttataaccttcattatatttatacactgaattttcccgataatttttgagccaccattcctcatttacagaaaactactgatttttatatactcatacctgaccaccttactgcactctttatccgttctaatgctcttccaattgattttctcaggttcatagtatatactatgccacttgcaaatatttttttccttcttctcaatagccagttttatttctgattcacatatgaagggacgcagcagaactccaaaaacaatgtgaactaagtgtgcagatcattgatgtgattgttcctgactgcagtaaatagctccagcatatttttctattgagattgctattggttaccaaataaagctattctttatcctgttaaaaattatacatttagttcaaattttccaagagtttgaaacaaaaactggtttggaattgactgaaagactattgatctattatttttctaagatggtgtttggatttctttgccagatttgggtatctttccatccaactatagttactggagtagctaacagagcaagagagttctctaagacttgaaattttacaaaaatttgtccacagactacttgactagagggaatgaattccaatttaactagatgtgggacaaattagctgttaatgaaagtgccaacaaaattacagaagcagatggctattttctagatgagagattatactgtaaagagagaggcatttttggagttgtcatcgccatgcagaggtgatatggaccttgcaccccaaccaaaattttgttttggatattgagactgataataccacatgcacatgaagaaggcatgaaaatacttataactcccataatgaggtcttctggggagattaggggagacccccaagcagatctgaagtagcttgagagagcccaaccttgcttagtttgaacttcccacctgagccaaagaagaaagtacctgggctttcttgacaaccagagcagatgtggagcagaatggaaagggatagtggtgaggcttcaaagctgccagcaaacataaaacatggagtcaaactctttattacagttgaggttgaagaaagatcagaggagcactgatttgatgatggagaaagaagacatgaaaattgatggtcatggacctcaggagtttgggggtcaaaacagcaattctccaaatatttaaaattgcatgatgaataaaggattcaggctacaatagaattttctttcttgacacgttttacttgaatgatttactgttttgcagaaaatttactgaacttacactgcatccaaggattgtgacttttgtaccataatcaaaatcattgttgttgaaattccaaaagaatattttaaatatgcaagagcagaaacatagggaatttagccttttcctaacattatttatattactaaacattacttttaacttatgaatagtgacaaaatatttagaacaacataaggaaatacaaatacctagaaactgaaaaccttttagtccatcctcaactcataacaatgatcacctaaccaaggttagccatttttgaggttgaatatagacttttccaaccctgtttgattctttacctaaaaggtaaaataccttgaggacacacctggctctaacttgggcatttcagagattaagatcacgcgggtagcaaagtcttcagggctgctgcttctcaaaaatttagagtcctctttaagtttagcccagagggctataaactcccatcttaagatactcagtttagctcttagagactctgtccacattttcctctttgtaggtgggaaaagatacttcctatgtcacctgcctgaagccatcacctgtatgtgcactaagaggcagtatgattgcctcataatcaaggctcttaccactcaaagacacgttttagaggtgtttagataaacatctcagttaatgtaatcattcttttttctttttttttgagaaggagtctcgctgtgttgcccaggctggagttcagtggcacgatcttggctcactgcaagctcagtctcccgggttcacgccattctcctgcctcagcctcccgagtagctgggactacaggcgcccaccaccatgcccggctaattttttgtagttttagtagagagggggtttcaccatgttagccaggatggtctcgatctcctgacctcgtgatcctcctgcctcatcctcccaaagtgctgggattacaggcgtgagccaccatgcctggcccacaatgtaatcattctttataaagcctcatacccaacagagatttatttggtcaatgcttttgtttataaaagcttattagtcacaataagcaactcctcctatacctagacacttttaacagttacaaattctttctttagattagattttcatttctgtaacctttatttattaactcctttttgcttttaagagctatattaaatatatctctatggggttacacaaaacattttttttttatatttacacatctaaattacatcatcttgatttttctttccctaaattaagtagctgtggcctgatttctatcttttcctacaacatggtttttaggtgcttcaccatcttggttgtcttttctctttctcttcttttctttctttcctaaggcactctggtcagtcaatttctctcttgaaatgcaagtatccagaatcaaatcctttaggatgtggtctgaatggggtagagtgtggcaggactaactgtggtcttccaaaaggatattattcttctatcgaatatcctccgactgtcttagcttttagcataatcttgactaatactaagcttatcttcaactactctcccatgatttttcttttaatgctaattgtttttaagcctcttgatttaataaattgatttttaagccaaaaatgcaggaggtgacatttattactgttaaatttttatcttgtttactatagtccactgttgcaggatattaagaaatgaaagaatatctggaattctgactgtgacaaaatcagttatgctaccttcccagtttggattacctttatgttaaaaacctgctgtataatcttcatgttattgacaaattatgctgaataatgcagttctaaaacatggatccctatggcataattctgaaatatcgtagtctttattgtggcagctgattacaattacgaatctttccaactgaaagatcagccaacacacatttcttcatcctcactgaacagtgtcataagttaagtaatcagatgttttgttgaaatcttggtgtgatcaacttatggcaatctcacggtaagcagtttttaaaaaatcgattaaaaaagaaaatactggccaggtgcggtggctcatgcctgtaatcccagcacattgggaggccaaagcaggaggaccacttgaggtcaggagttcaagaccagcatggtcaacatggtgaaacctcatctctacaaaaatgcacaaattagctacgtgtggtggcgcacgcctgtgatcccagctactcaggaggctgaggcaggagaattgcttgaacctgggaggtggaggttgctgtgaactgagatggcaccactgtactccagcctgggtgacagagcaatactccatctcaaaaaaaaaattatatctatctatcttatttttagtatgctcaggctatatccaatgatcatgcctttctttctcatttgctcctttttagaaatttcccaggcagcaatctcaaatttcttatgctagggtattcaaattttcccctttatcaaaatgaagacggtattatcttctatattccatttcctcagagattatcgacaatggttctgagataatatccagtacttggaatgtaattttcctgactgggagatgactcatccagaggagctaactgcttgtgttctaactcctcaccaatcttgggcattgattcatccattgggataattactccatccttcccaatgtgaggaacactttgctttacagaaactacagatggaaaacaggaggtgactagctttgtcatttatggctcctgctgctgcaaatgctgctgttttcaccatgtaaccaaaatctccaagtggttgagaaatcatatgatttttcttcttggagggatatgagtagcaagctcttaaaaagtccttactctatgtgataggacttgctaaatgcttaaagaatcttatttaatattcacagtaaacctatgatggaagtgcagtcattatgcccattttacaggcaacaatgcttacaattagagcagttaaggaacttgcctgaggcacggctagtgaaaacgtggagtcagtattcagactcagggttttctgataccagcaaccataatattttaaattttttttcatttctaatttttatgggtatatagtaggtgtatgtatttatggggtacatgagatgctttgatacaggcatgcaatgtgtaataatcacatcatggagaatggggtacccataccctcaagcatttatcctttgtgttacaaagaatccaattatactcttttagttatctaatatttaaaaatgtacaattattattgactatagtcaataatatttgtgctatcatatagtagctcttacacattcttcctatttttctgtacccacccattaaccatccccatctcccccgagcacgcccccaactacctttcccagcttctagtaaccatccttctactctctatattcatgagttcaattattttaatttttagatcccacaaataagtgaaaacatggaatgtttgtctttctgtgcctggcttatttcacttaacataatcacctccagttccatgcatgcctttgcaaatgactggatcacattctttttcatggctgaatagtactccattgtatatatgtaccacattttctttatccattcatgtgttgatgaacacttagtttgctcccaaatcttagctattgactactatgctacattgcaattcatttttttctttaaatacaaaagaatattttaattactgttttagaaactataaagcttatatgtataagctttggattggattggatttggaaatgagactgtaccaaacaatggccaaagaagactcatccattctaggccttctcttttgcctggtaactcagaagtataattctatctcataagcatcagtactcataggcccagttagttacttacaacatggccgttttctgcaaatggatgccacatctcttgggcctggctggaatactgatattccgtgccatgttgtcttctgaccgacaccacccattcggtagagagacttcactgcctgattcccacatctcatttgttgctagagaatactgtgactggatgtttttccttccacctgtctcatgataggggcctgacccactcagccaagtaactgcacatgattcatggatctttcaagaaacaaattgctggtcatttcagactcacgtcttacaaactgataaagcacttgtaacgcaggtcttcaaacatggcttctattttcttttcttaaaatctaatctttagactcttcctgatgctctagctcagccagtgtccagctaggaaatcaattccagtgcactacaattcacttaaaaaatgtaaatttggttgacattctgactttttggcaaattttagttcatcattgacttttatattttatgatactattcttttaagtttatgcctctcttgtatcaggtaatagtctttccttcctgcaaaattccaagtcctttaaaaatcaaattttgttggtgaactccctatgtgatattttagttaaatatctcactgtgacctcccctttttcctactacagttcaaaagtcttcttttgtgtttgtatgtgtgtatatacatgtaaatgctggcactgttttctaagcatttcccacacagaaggacatattttcctttgccctcctatgtgaactccataagcagagaaagggccctggttcccatcctaaagaggtaacggagaattctctctgcagcacaaaaaggaaaaagatttattattccctggatcctattacatacatctgctgaactcccccatggctccggtaaactgcaggactgttgattagcgggccctcccaggccttccaagctgcctgagagctggccagtcgctgcttcttgctggtggttggaggcacgcccacagtgtctgcctggaggagcctgtgagctggggatatctgcagaaactaccaatctgagccattaaagaaaactggtgaaagagtggtgttagaaaagagtactcatagttttctactcagcagaggactagctctcaaactcttctgtgcaaagtcagatgctggcctgtggtgactatgtggcagtgagagaaagaggcaggcttgggcacctccaacaggaccatacagggactgctgtgcctgaagtgagccaagctctcgctctctgtggcacagtgccctttgggaaaagtcatcatatggtccagaggaagaaatgcatcctatcctagacttggtacataataccattttattcaagtacatgagtatgaaaatgcattcaaataacccataataaaactttggacagtcaatcagggtttttcagaatatatagatagatttcatctgcagagccttcaaccctctgtggactatgtttcttttcagagcccgtccatgacatcatagttgctcattcaatgaacattctgatatcttatttcctaaacattaagtagtgtgtacatatctacaaactgccctgcttcctatggttcctttgatgctgatttgcttctttaagccttccttccttccaaaccatgaatcaggtccttccagaggctaagaattaagttcacaattaaggcgactccctcactgtttcctctgctttcagagaggggaaaatacttccaggacaagtcaagaatttatcagatgctctgctttcagcagcctgaaactttcagcaggaacacgatagccgaaatcccatgccacttcttctattgaggcttccgtttaaatcaggtgagattaatcatcctccccctgtatagtctggttctagtgttatttcacatccctcctcatctgtgctttgaaatgatatagaatttttttctatatcaacaacttcacaaatttccagtttgctttcaatttgaatgttatccctacagaacattagaaagcactcagtgtttaataacctaataatttaatatgctgccctcaaactactacggtctcttccctatacttaagacttggacctaagatttgtctcaataaattattcagctaccatcaccagggcctttcagctatgatatgccctggtgatcgtagctgaatcatttattgagacagctcttatttattgattatccaccatgtgccaagttcctacataacacagtcagtccacacagaaatgttatatgttaatcatgcacatctagcttgcaaataagataaagagactttaataaataacataaacacagatctgactatctttacaccatgtcatggataagagagattctacagccagatggaacctgggtcactatactatttattagctgtgtgatctcgggtgtgatgcttaacctctcagtgacttggtgccctcatatgtagactagagacaagaagaacaataatgtggttttatgaaggataaataagaggtgaaaactgatagaatatgcctgctacctagttagctctcaataaatgttagctgtcttctgaatttttatttgtacttataaatcaattttttccataaggctggttcttagcattatagatgtaaatgatcactttgggaggtggacgctgataaagagtattgactgggttctgtggctttgcttcccaccaaaatgcctcttgcaaattatgcaagacagtaccttgcataataaacatttgaatatttgaataaacaagacttcaatttttaagatatctatgtttggaaatacccacaaagaacagggctcatattgaagtgcatggagaaaactcttgtcataattttccattctctctatcctctattagcatacttatcgtcttcttcaatctataagtaaatttgaaaaataatggaattcagatttatttatgaaaatgaatctgctttttcgtttagcccaatgggctcagttggtaatatttcccaaggggtccttttaagattcttaaagtaaacatatagttaaaactcgcaccaccttgaaaaataagcataagagccttaattgcctttttcttggcatacatcaatttctacacataaaaatgcagtactgaataacagcagtaagccaaatttctttcaaatagcacatctatgtgaatagtagctgtccattatgtttcttaaaatctaggaggctaaatcatatttgtgaaaagaaactttataataaaatttaaaaagcctaattcgtgtgcaaagaaaaaaggcatagaaatgtttctttttaaattaatacaaaaccttcccacatgctccaaaacagtaacaatttgatgttaaaataattcattgtatagtcttttatgataaaaattttagaaaaaaaataatgaagtgtaaaatataagcaagataggagaggaaatttggggaaattttaactgatctattttttaagtagaaatggacaattcctgagatagccctgttttctctttggccccctttcacaaatagtctcatggactaatactacctttaaaatacaactgcaatatagactctctgaaacccaaatgctgggggtagggccaggagagaactgagaacacaatggaatcttgaatgggatcttgtaccccagtaacgttaaaggacttctgaattctatgaccactgaaggtactcagcactttaagacctgtgcatttcaccacccgataattttatttcaatacaaatgagatagttttgtaaatctgatgggtcactgagacgtgaatgctgctcaaggccatcagataaaaagcctatcaggaggaagtgtgatagccctggatatgtgtgttttgtggcttcatccttagagcaacactgctgtatgatgacatcccagaaagatcatagctcttatcctaagtgtctcaagaggcaatctaagatattgccagaactcagccagccatcaagtaaagctatggccaaaaaaaaaaaaaaaatgcctattgcataccttctatttcagcaattaggcctctaagtattcatctaaggaaataatctaaatgtttatttaaaatgtgcacaaatagaagggtgctcgctgttgcaccagacatgtgatgaacctaagaccggatggaccatttgatggatctgctagacttgtggctaagggcatccagtgtctccttcctgagtttatatcatggggaaggaagtctgaatggtgaacagtggcatactgtgcagagctgtatcagatgagaagacgagaggccgtcctgtgtgctgcatggcctgacctggtgtgattcctacagagaaaggagcaggaggctaaaggggatgaggctgtttccaaacatgatttgggaactgctgctctagtcaccaaaatcccactttggggcccaggagggaaaggcatgttcccatcattttcttggacaggaagcaaggtgattgcaaaccaacaggggctacatcctgggaacaaggcactgcagaactctcaggataagtagttctggaacactgtaaacacagaatacagcccactggttggggcatcagaattcctgtgggggtgccccgagtagcagtcacagagaggggccttcgctaagctgctttcaatccaggtttgtgtgtgaggatgtgtcagtcacaaatggaagaagatgtttttatgactgtacatacgaatgtcctgggaacttctgaaataactagggggaagtttcttgtggggaagagtgagcagagcctctgtgtctgttgggagtggggaaagatggaaaagagccagccacactcagtttcttaatgtgacctaatctgaccccagaggcagatggcttagggagacttggggataatatttataatacggtaaatttggaaacagataaaatacccaacactagagcattggttaagtgaattatcacacatccatacaatgtgaggtggggctatgactcaataaatgtgtatactttctctgtatttcacagcctcactacattcattctcactgttaccccaagggaactgctagacctcagtgagcagaggcaatgctcagagaaattgactgccaaagtaaagacagaaatattcatgtttgcagaggctgccctctttttttttaacagcaagcaaagatgagaaatactatggtgaaggcaaattgggataggcaggggacccactatattgtgccttgggttaagaacttccctaggcatagactgaccacagaatttatgatcgaatgtgacagagggcgttagctggatgagtaactgggactcagagaaccttactttgcatggggctggttgatcctaggccactgttacaaacggatcattatgtaaccattaaagtgacagcataaaaacacacatcataaagtggaaaggttccactgtgacattactaacaatcacgttacaaaaaggcttgtactgtaggatcccattaaaataggaagaggcatagagaagaatgactggcgtgtagatgccaaaaagaatgattatttctgtattaactgtataaaaggttatttgaattctgtggttttccatctttctattaatggacatttattgcttgtaaaattaaagtttatattaaaatgtgaaagaaagttagttgacttaggaccaaaagtacagcttatatgtggcactagctgcttaattttgaaattcaatttctagaccacctttggaatcatcactacaattttactgtggactcaaatgatgattttctcaagggcatgatctgtatcttatttcatctctttacttttttggaggggttagaataacccagtttgtagctgtgatgtaggttagcatgtggctgccttcctgggtaaatcaaattgaaatattctactttgagtcttgattctctaatgcaaaattgatggaagtgccagagtggagtagacccaataatgatgacaactaatgtttatggaatggtttccatgtacctgtgtgccaggcactgttgtaggctctttgtgtgctttatttaattctcacaataatcatatgacataggaactcttaacatcccttgtttacagataagaaagctaagcagaaagatatgcagtgacttgtccaaggtaactgaaaatatgtaatctactcttgatctgccatggctttgatgaaactagcaagccactcttgagtttggcagaaaaatgacttaaaataattttcagtgcttcattatggttttagaaaatgatttttaaaaaactttaatatatacttttgataactcatttataagatccatacgtttggctgctcatcataatttacactgtgttctgatgttatacagaagagggcattaaaatgatagttcatagcccttatttaaccgccaggattggtaattttcattttgtcctttaatctattgggttggttgactcatttgttataaaaacttgataacattttagtaaatacatttttctgctttaaaatttataatagttgattattatgattagtatttacagttgctaacttgaagaacaaacataaactaggcaaatacagggaaaatattatttcacattctttgactttattggctgcagagatgggaaaacagccctacaggtgcacctttgtccacctgtggggcttaaacatccagctcccatgagctctttattgaggccatcagaaacacaggcctgtgactatgattccttttaatgtgtctttgggctccaaaccataagacttctctccaatcactctgtcacttaactctaaatcccacttataccatttcataaatttagtttctctgaggatcctcctcctcctctgcaggaggaccaatttaaatcatccttaaatcatcacattaaacactagctatcattggctgcaagggaaccaagaagtatattataccaagtcttaaaatgctgtccatgcctttttaattttaccataaaatcagagatagctatttgatcaggaaggatttaatgagtttaccttttaaactaatggactataatgggctccttaaattttgcatgtaaaaacccatgggttgggaaactttcaatttctccttaataactcatcactataaatcagattcctttaatatactatgcatcaacattgcaatgagctcagaaggatctggtaccattttcttcctgatgtctcagccacaaggaaaggctggtttttttctgaaaggtagtactcaaagcaatttcattttatttccctctacagaagatatcagatatttaattaagcactcccataaaagatctacccttaggtatttcagaatgacctgttccttgaggatttccttggtttctctcttgctagaaaagaaattaaaagacatagatcgtagggtttgtcatggtacattcagcatatattttgtaatttttttttatagccagtagttaaatattaacagtagaatgcatttattggatcatttctcctccaactaaaatataacactaatgattataatgatgatgacattacaacatccataatgatgatgacaatgctattataaaataacgttaacttgatccttctccaaagctttgcatttctctagatttctaaaataagaacaaaaaagacaataaaacacaagtgattcaaaggacagtataatgtaaataacaatgctttctgaagattccaagtttagaaaaagccatgaaaagaaattccaagtttagaaatagccatgaaaagaaattgcttcctgaattacatagtaaatcacaatctgatgcctaaaggcttttgacagtgaaaggtctacacattgccaaatattgggatgaaagcttcatgttttcaaatacccagtatcaaacaaaacaaggatattcccaattcatctggagttggcaccatggtaagtcacaaatgatctggtttaacttcttaaacaaatgatgaatttattgtttcatttcatggacctacaagccatagtcaaagggagaaacagaaattgtccagcttcttttccatcaacctaactaacatggcaattcacatagcaaagtggatttgcagtgacaagagaggaagccaatttacatgtatgggtggaatgggagtggtgatacagccttcttggtctgggggatggagaagggaaagaaaaatgcactttcaggtagagcactcccaggatgtgttcacttcagctaaaaattcatcaattaccctgccacagagaataccaagattatagtacagcatataattaaagaaggtggaggcgcagaggccctggcagagactgtgtctgtctatcttgctttgaatgtgtgttctacacagcagcacatgtagcttgctggagtctgggcacctggagagaagggtgggtgggagccaccgctgacagagagtcattcactgaacacgcaaactagctaaaagaaattaatgttaacaccaatcacaagattaaatacacaacatttgatgcaagatcaacagcgggatgatggtatagcttctgaaaacaggtggagttgaccttaaagaaatcagatcagcaacgacagacaagaagaacagaagagacaaagggcagaagaaacagaaggaaagaaaaagataaagcaaaaaaagaaaaaaatgagaaggaataaagaaaatatgatctctagaagatgacatctatacttctacaagacgatgcatcaactctagggaaatttagggcttatatgaaatatagaaatttgactcaaagtgactggaagatgctgagtctatttttcacacagctccagaatgagcagtaagtatctgcaaagttatgaagagaggccaagtcttgcttgtgtctaccttagttatcaaagggcagaaaagggacctctgtggcctggatgctgttgctggttgaaatgtgcattgctggagccaattttaaaatccaagtagcaagttcatggttccttggctactgcctgcatacctacattgcccagctgactggaccaccaggacccaccgtattcccctctcccccttgccatctggccttttcatgattttttttcttttaaattaagttcctatgctatttcatggcaggaagttttgtgtgatgtatctatgccagctctgaagtcagactgttcacaactcagtttcaccatttcaatcagatagttatgtgaccaagggcaggttactggtcctctctgaggtcctaggtaggaataacaacacattccacagaggaggagctgtttgctcattttgctttcacatactagaaatgttcacaattattctccatcctacaccatgtgttgagtactatctgtgggttacagcatcatgtaaaaagttaggcagagaaaaaaggacccccttttgttgatggactctaccaaaaaaaaagtgggagacaaagggaaagctgatggccaagaattaagaaagttcctgtaagaaaattcaacacttgcctgggggtgctgtgtgttgactttccatagcatgaggcctggttcaagggacctgaatgtcatgttccattgagagcttatatatatatggaagaacttatatatatatatatatataagttagtttatatatatatatacgtatatgtatatatatgtatatatatatatgtatatatatgtgtatatatatatgtatatatatgtatgtatatatatatatatatatatatatatatatatatatatatatatatggaagaactaggttgtcctttgagggctgggtccttctgctcctcattagctcagaatgcacctccctattctccttatttaaaactgtattaaactgacaattctacttgattgagatcctgatctcccttgtggcatttaggccttaatgtatggcactacagttaagtatcatcaactcccagcccactagtgtgaaatccaagaatcaaagtccatcatcagcaggaaagacattgactgaactgtatatattcccagagaggatcttctcatccttaaacccttccttggtttttctcatcctctcacgaagctttatctgccattcctaggttgatgaatcctcaaagtaagccccacaggaacctcatgtaccaaactgaaccctttatctctctctccaatctcctctgttgtggaggatccagaaactagggtataatcctccttctctaagacatggagacctccttctcacccaacactcccacctgaagcaggccctcaatcctgtagattctccctttttaacattcctcaaacatgtgtcccactgcaactaattataacttttttctttattgtaagctggcttctcagattctaggatagctcaatataacatccccataacaaatatttatcgagttgtccactaggtaccagaaatatgcaggtggataagtaaagagccattgcaatgctgctaggacatgagtatatgatgctattgggcatgcacaggagggatatctaacctagtctttgatagctcagagaaggcctcctggaggtagtggcaatcatcccgcctttgaaggctgagtgcaggtgtgttagccaggtatagcatcagttgatgtttcctgggccaacatcaattacctatctttgggaaagagtatcttgacttacgaggaacctcttcccctaccctacaagtcactgttcctgtgatttggttggagctgactccaatacagcacctccactcctcctgctttccaggtgggaatgtaatgcaggtttggccattcggtgcattccaaccccatggcctcagtgactgtttcagagatgagcccatgactctatcagagtcaatatcaggacttttgctgggaggtgcttagtttccacggacatgactgcgagcccaagatgtaggtctagaaatgttggccattattttgctaccctgtactgagagtctgcctgagaacagagcagagagatggacagaaaaagacacctgattctgatgacaccacctgggttcatgaacgcagctatgcagggagctacttctgagtaaatacactgccagaaccagtgtgagttaggttttctgccatttgtaactaacaaagttcttactaatgcattaaggaggaaaagagtattctaggaggagggaatcatacatgtaaaagctcagagaccaagaaactttgacccattctatgtacaaagttctatgtgaccagagagtaggagagaagagtcacttggagaagaagctagaaaagttaagagccaggcttttccagtagaatgttgctctgccagagtcaatgtcataaaatgcaaatgtgatcatgcaattcctctcccctgcttaaaatactttaatgagaccccaaaggttttaggatgaagttcaaacccattagcttggcacccaaggcttttgatgacctggctgttccttctctctctggactcatctcccacatctctcccatgggcaacctgtgctccagctaaattaaactacttgtagttttccaaacagggcatgctgtttcatgcctttgtgccttcatattgcaatgcattatataatttaatcctcacaagggcccccatgaagtgcatattattatcctgatgttcccagaagtatagagaagttgaggagcctcaaaaatcatacagccagcaagacagagatctaggatttgaacacatatgtctgacaccaaagctctccttctttcttttctactaccactcattccagttcttttaacttctggtcatggacctttatgttgcacagcctggtcttttaatggaatcaataaaatttcagaatttcaggagtgggggctggagggatgcataatgttcaatttaaagctactttgctactaaaatcaacacaactgcatcttctttcagtccaccttttttttagcatctccttcatgccaggcactgtgtggagagatggtgctacagaggtaaactaatccagctacagtccttgccttcatgggctttcagcaaagtaatctactcctcacacttaattctcctgagaaggcttcctggatacacttgagaatgaactccactttggttatacagacacatggaactccatcactgctgttgctgagaaaatatcaatggctacattattttcaactgctgcctatgagttatatcagagattaattgatcagctaaatgagaaaatgcagagaatacacaaggaataaatcgatgaaggaaaaagtgtgctgtgtcttctatacctgggatcaattgtgttacagctcactcagagaggcaccagattgccaaacagcctgcttgcaaggggtcacaaatagggcaaatcaccagcttaacaacatgtgaaattttcattgtcttatttataaccaatttctcactaaagtgaacaacatttcttaatggtacagttctgcagaagaacaaactagaaatgttttctttccttctaattgggacaaaactgatcatcacctaatgggctctttacagagaataaaagaaactaaactaaaaaaaatgctcagcacgaattggacgctaaggattaaatgaaaataaaaggacagttttgtttcatttttacctcagatctttaaaggtactgttagaaaaatctaataattgttttataactcttatttggtagaaaaagctaattattattaaaaattttaataaaaatgagaaaggattgtcgagaagtgaaaaattaaaagggagatttccaatgttgaaaaagcaccttttatgaacataaaaatctatcagtctgtcctcccctaaccatatttggataggatctgacacattaaaagctggacgttagcccagttagcctgagtgagaagtgattcaggagacaccagacataaaccaaatggctggccccacaaccagtgggtaaaagatgcttgctgtccagcagggtctgcagagccaagtggtcacagtgcccagagaagcccccttgggcaggcgacccctacaaacctcagcttctactcctgggcagaggcttttacagtcctgaaaatgctatgctacagaagagacattctgcgagtgaaaaaagccattattccacccaggaaaaagatgatttttttttcccataaccgcagtggccatcaaaaaatggattcatttttcttgtgctgtactctgggcccataaaatagtttcaggatctcaaaaagacgatgtcgtagatggaagttttgttgcaatgagccagccagaagtgagaatgactttaaaagactgaatttttaaaatgctctaaacccaaagattaagaaaatataaaatattacagataggtcactccttttgtgttgtgtgagttaatcatgtttattcaatgggtcccactttaaatgcagtatgtcaaatcctaaaatattattcttagttcttttaaaattacatgacatattctcttatcaacataggccaataaaatacaaacaggcataattggtgcaagacaacccttaacagctagtccaggttaatccactggcatggattagattatgaaaggtttaaataactaatttcaaagtcttacatatacatcagggatttcatttgactaagcttagtgattatttgagtgttaaccagagtaagttgagaggctataaaacccatgccaaatcacattcaataacatgagacctagggaggtctaactggaactgcagaattgacgtgaaaaaaatactaaggaatattttcattatagatttatgaatgtgaagtggattgggatagattttttttttaagctaagggtgaaaaaatagagatttagtgaaaataagttagggcaaaatggcaccttgtgatttagaattgtatgttttgcatctcatacccctacagaggctggctgtgccttagacacagtagtgatttgcttcttttgggggcagtggtcttcaacatttttggcaccaaggaccagtttcgtggaagataatttttccatggactttgttggggggtggggaatggtttcaggatgaaactgttccacctcagatcatcaggcattagattcttataaggagtgcacaacctagatccctcacatgtgaaggtcacaataaagtttgcactcctataagaatctaatgctggccaggcacggtggctcacgcctgtaatcccagcattttgggaggccgaggcgggcagatcagaaggtcagcagatcaagaccatcctggttaacacggtgaaacatcatctctactaaaagtacaaaaaaaaaaaaaattagccgggcatggtggcaggcacctgtagtcccagctactctggaggctgaggcaggagaatggcgtgaacctgggaggcggagtttgcagtaatccaagattgtgccactgcactccagcctgggtgatagagcgagactccgtctcaaaaaaaaaaaaaaaaaaaaaaaatctaatgctgccacttatctgacaggaggcagaggagctcaggcagtaatgctctctcacccactggcccactgctcacctcctgctgtgcagcctggtttctaacagcccacagagagataacaggtctgtggcctgggggttggggacccctgttttgggggatagttaattctagtctaaaattcatcttcaatagttgaggaagtaactttgccaatgtgacaaagtaaggtaggggatacaaagttctaaaatcaagatttcctgaccaccaggtgttatgttttttactaatcttttctaaaaaattttacgaatttagggggtacaagtgcagttgtgttacatggataaattgtgtagtggaagtctgaactttcagtgtagccatcacctgaagagtgtacattgtatccattatgtaatttctcatccttcacccctctctcactctcccaccattttgggtcttcaatgattattatcacacactttaggtccatgtgtacacattatttagttcccacttacaagtgagaaattgtggtattcgacgttctgtttctgtttctgagttatttctcttaggataatggcctccagttccatccatgtttctgcaaaagatatgatttcattccttttaatagccactagtattccattgtgtgtatataccacgttttctttatccactcatccactgatggacacttagggttgtgaatagtgctgatataaacatataagtgcaggtatctttttatatgatgatttattttctttaaggtagatacccagtagtggaattgctgggtcaaatggtagttctacttttagttctttgagaactgtccataccattttccatagagtctgtagtgacctactttcccacaaatagtataaaaatgctctcttttctctgcatctcaccaacatttgtttttgtttttggtttttgtctttttaataatagtcatctgatgaatataagataatatctcattgtggttttaatttgcatttctccagtaattaatgtttagcatttttttcattgcttttggccatttgtatgtcttcttttgaaaaatatctattcctgtcctttgcccactttttaatggggttatttgtggatttttgttgctgttgttgagttccttgtaaattctggatattcattccatgtcgtagtcacaatttgcaaatattttctcccattctgcaggttgtctcttcactcgtttatttcctttgctgtggagaagctgtttagttttattaagtcccatctgtcaacttttgtttttgttgcttgtgattttgaggtcttaatcgagaattatttgagtagaccaatgttcaaaagaggtttccctaggttttattctagttattttaatagtttcagatattacatttaaggctttgattcatcattattaatttttatatgtggtgagagacaggggtccaatttcattcttctgcatatggcaatccaattttcccagcaccatttattgaaaatggtattcttagtgtatgtttctgtcaactttgtcaaaaatcagttggctgtaggtgtgtggcttcatttctgggttctctattctgtttctttgacctatgtgtctatttttatagaagtgccatgctgtattggttattattgcctcaaagtataatttgaggtcaggtaatgtgatgtctaactttgctctttttgcttagaattgctttggctattcaggctcttttggttccatattacttttaggatttttttttcccaattctgtgaaaaatgacattggtattttgatagggattacactgaatatacagattgctttaggcagtatagtcattttaacaatattaagtcttctgatccatgtgcatggaatatttttccatttgtttgtgtcatctacaatttccttaatcactgttttgtaattttcctcatagagatctttcatctctttggttaaacgtattcccagggttcttttgtttgttttgtttttttgcagttcatttaaatgggattgacttgtggatttggttctcagcttgttattggtgtataaaaatgccactgatttttgtattttgattttgtatcctgaaactttactaaatttatttattaaatctaagagtttttggagacatcgttagggttttctaggcataagatcatatcatcagtgaacagaggtaatgggctttaatattaagaagttgggcaaaggggttcaccaagataagttctccttctataccttctactctttcttatggagaagagacagagccatattttcatgaactttcttgcatgttgactcataattgttttcccctttcacatgtataaaatatatctgtttcttaagtaaaagcaaaatttcttgtccttcccatatgcttctctgaaccctttctatagtgctttgtgcatggcttttgaatatagtaggaaatagaacaggatagtgtttaagaggtcagactacttgggaatccaatgtcagctttaccacttattaactaactggacttgaataagttagttaactcctctgtgcctcagtatctccacctgtaaaatggttacaataatacaattatcttataaggttacagggagaattaaatgaattattcctgaagctcttaaaacaacatctggcatgtggtaagcactacgtatgataaattaagataaaatgcttgctgaatgaccaaatgtttctttgcacctacaataattaatattactcattaattgatgaggtttccttaacaaagacatggtttgtgtctttgctaaactgtgaaaaactctatctcttctttgagataagcagaaagataaataatagctatgacacatatacctatcttgtaagttgctttgtaattatttattacttgctgaaaaactcaagtgggcaaggggaagaacaaggcagtcatgttaacatctaaaccttattaaagtttcatcttcttttaaagtccaggaagacaaatgagctaccagaggaattttctttcctctgtaaggcttatacacgaatttgaacataactattaaagtaaattaaatgggatttagtaaatggccaaataacactgtggtgggagccaagggagcagacagaagcaaactatcaagtttgggtatgaatttcaatgtctaagatgaagttagacctagtctaacttcaagactcctacgtggtggctcatgcctgtaatcccaacactttgagagaccaaggcaggagaacagctggaggccaggagttcaagatcagcctgggaaatacagtgagacccccttctctaccaaaacaaaacaaaacaaaacaaaacaaaacaaaacaaaacaaaattagctgcacatagtggtgtgcacctgtaaacccaatttgatggtatctggaggcaaacagtggagcccctgtgcagagcactctccctttctaccatgtgaggacacagcaagcaagaaggcagaactctgcagaccagaagcaagctctcccacaacacagaatctgccagcacgttgattttggatttcgcagcctccacaactatgagaaaaaaatgtttattgtttacaccacatagtctatggtattttattatgtaagcccaaaataagacagaggcaatgaaaaaaaaaatcacacaaaacacttttcttgctctaacactatgactgtttgatgcagaatattctcaaaatttacaattaaactagataatttctggctctttatgcagatgtgattggctttgcttgatttgtgttacctgagttaacaaataaaaggttaaaaaaccctaaaaatatactgttaaaattgttcatatttcagaatctgaaaagtattttgggagtacaatttaagaaaattaaatataaaatattatgattctcaggagaagctatgtacagagttgaataaagccacagctgccttcttcatctaggtgagaacagttctttagggtctaggagcaagcatagcaaagctctgtggaactctgcctcatggtcatcaatagatgtgctctctataatacaggggtaaatcaaactcagtatgatttgcctcatttctttacttctctcagtgttgtcttctcttctgccccatgtccttttcctattattggtcactatgctgactttgtgacatgtcaacttggctacagtaaactacattttctctgaattccctttgttgtatatttcagattagggtgagccacaagaaaaattcttcagagatacgagtcgtgggcgtaaaacagcagctgttgtgtagctcacacaagttcttgctaatctgctggtttttaaactcgtgatctgacttgtctgagagcatgccttgtggacttcaagccccagcatgagatccagtgataacagccttgcagagactacttccaacctccacaattgtataagccaggtccccgtaacaaatctcatactggttctgcttccctggttgaaatttgaatacagtcactctattgaccaggacgaccctgttgcagtacatggttgtctgcagtcacctggctggtagattcctccaaatctagggggaaggactaaagggcccccaagaggctatagtgatgatgtgataattaattttatgtgtcaacttgagtgggctgaaggatgcccagaaaggtggtaaaacattatttgggagggtatctatgaaggtgtttcaagaagaaattagcatcaaaatctgtagacagagtaaagaagatctgccctccccagtgtgggtaggcatcattccatcacttgatggtgcagaaaaggtaaaaaggtggaagaagggcaaattctctctctttttcagctgagacatccaccttctgcagaaaggcataggagctcccggctctcaagccttcagactctggaacttttaccagtggcctcccagttctcaggactgtggacttgatctgaattacaccactggctttcctggttttccagctgcagatggcagatcatgggacttattcccatgtgagccaattcccatattaaacctcctctcctgcctctctatatatcctatagtttctgtttttctgaagaatcctgactataccaacaacttggaaacttagaagtaacaggtaataacaatgatgctgcggatacaaacatgacaggtacacagcatgtactaaatgtagggtcccagtactacagactcatttttttctcaccaaccaccctataaaataggtactgttattttatctccctctatactctgaggcacacatagctgaaataactcgccagtaagtagaaagccaaaattaaactcaggtactctggctccagaatctgtgctcttcaatactattgcaccattccaaatcaacctaaatgtaatgctttccatcctctggctaccctgacttttagaaatttttcacaacagaaaaatagtgtgctagcctgtgacagtgcagccaggaaacttctgttctggtcctgatttcaccactgactggctgttgttaaagcaaactaagtatggcctgagaaggaccgcatacttctgtatctgagtgattgtggatgaactgtaacctagcttaacaggcagactaataggcctaataacaggcgaatagactaataggccaagctctaaccaatccagccatctgttcctcacttccaatttctgtacgtcacttccctttttttttcccttctaccatgtggctgcgctggagtctctgtgaatctgctgtgatagtgggggctgcccgattcgtgaatcattcattgttcaattaaacacctttaaatttaacctgggtgaagcttttcttttatcactgtgtagcattgggcaggtcaggctaacttccttacttgtaaaatgatctcagtgccttcttccagctataaaagttcacaattctatggtgttaaagttctgattatgatgttaaaagatccttggaaaaaagctgctctgtacaataaaattaggtaataaaacctacaactgtatatttgacttccttgcatttatttttcagcctcttcctacctcaaaaattattctgtagctccctaggtaattataatagtgattttttaccctttccaattgtgaggaccctgttaatcacacacatgcaaaaagagttgtgaaattccatagaagaaaaatataaaattgtaagttgagaaaaaatacgatagaaagacatgttacacttgataatgcttttaagtaaagttaaatttcactaattataacaacatctagagacatttgaaaaagagtgcatattcaccgtacaggaaaaactttatggagttactgacctacaggattcttaacagttacctcttggttctcagttcccactcagggcgctcctcactggtaatcacctattacaattgtatgcaacttgttaaatgtaactatgctaaaaatcaatatatgctgaaagccaaaaggaggactgttttatatgccacagctttattttctttagactttactgcctatttttgtgttgttttgtttgtttctttcatggtttttaaattgacagatttttggtaagtattataaaagtttctgatctggagaagtatcactcctctttgtttttcttttcttttcttttttttgtgtgtgggtgtgtgtatcttcattgtcatttagcgaaagttcccctaattgttaaaaagccaagagtaagcatcaagttagagacagggaaaaagtacagagtgaaaagcaattttaaaaattgcataatcagtctaagaagagtagaactggccacttttaaaggccaaagtccaaacaaggtctttaagaatttggtaacaccaatggcactcaccagatgggttaaggcaacactgcaatgggaaaggtgacaactgctcagtagaaggcagacatcatgtaaacagtcgtactagctgttttcttgtgtctgagtctatgcctagaaggggtttactttttccacaaaaggggaaacatactatgatacccctgaatatacatcctagaactcactgcttaaagaacacatagaaaaaaacaaggtcatgcaaccatccctaggaagttaccaaaattcattcttagttcccatctgggggcaaccctgatgagatactgcaagggaagaaaagaagattaaaggtaaacaggcgtagttcaatatcaacactttaggcaaatctttcctgattatcctctactttttttttttttttttttttgagacagaatctcgctttgttgcccaggctggagtgcagtggaacgatctcggctcactgcaagctccgcctcccgggttcacgccattctcctgcctcagcctcccgagcagctgggactacaggcacctgccaccacgcgtggctaatatttttgtatttttagtagagacggggtttcaccgtgttagccaggatggtctcgatcttctgacctcatgatctgcccgctgcggcctcccaaagtgctgggattatcctctacttctaactctcaaccacgagctgaaacaccctcactttttctatattttgccacacttcagttatacacaaccatggtttgcactataaatatatggtacctctctgtctctcccattagaccatgagtgagggtagaggaactgggtctcattcattgatctgttcctagttcctagcacggtgtctaacatatgggaactgctcagtgaatgggaaatggaattaaatatatctattagtttgctctagagatccaaatttcaggtaggaatccaagggaaatttttccaagtatgcataacaattatcaaactttgtgtttctcacggattgttgataactgcctttaattgtatttaaagataggtagtattcttttgaaatgtcagaaaaggcaatggcaaaaagccttcaatttggctgtgatcccaattaaaattcttcaacccaaaagaaatagctttgatctgatcaaaatgtatgagtttctttttttgtcaccataatttaaagacagaaaaatggtatttaggatttacatatacatgtggaggccaacctcattatgatgattgtactgagaagccaggaagttctgaatcataaatgtattttcagaaaagaattgtattttcagagggggaaaaaaaagagctacaacaatagctctaatttaactggagatgttcactacacaatccccgaagagcaggataaattgtcgagagcatcagcagactgtctattcatttggcatattagcatgaaagggggctttttgcccagtggagcccaacctcttctctacaggatcttgcttttgagatctttgaaacaagtatttcaaatacagcatactgagatttgctctaatcttaactatggcattagaaaagtcattataactttatgcataagttgttggtgtatggccaagtcagaaatcttgccctgaggaccaacatctacataataagagaaaatagatacgtgtgcagccaattattagatacctctggtgatggcaactagaaactacgtgaagtcatggataattcaacataataacaatcactatatggaaaaatgttcctggctcatgcctgtaatcccagcaattttggagatccaggcaggtggatcacttgaggtcaggagtttgagaccagcctggccagcagggtgaaaccccatctctactaaaaatacaaaaactagcctgacttagtggcgggtacctgtaatcccagctactggggaggctgaggcacgagaattgcttgaacctggaggtggaggttgcagtgagtagagatcacgtcattgcactccagcttgggtgagagagtgagactctgtctcgaacaaagaaaattttgtaaaaaagtaaacgatgaccccacactaaaactatgaaaatcaaagttaaagaaaaaaaaccttttaaatcaatttattttaccttaatttattaaaacatgtacatttgttagacatttatgaaagacctatttggtgccagacaagggtgatcatctctaagactcataaacaagaagttgtaaatgttacctaatgtgatgtgccatctctaatgccctctggaacccatttgagtgtggagaactctgtggctgtctacacaacatccatttcacctcttgtatgtgaatatataaaagtcataggattggtcactactgattccctcttcacaggtagctgccctaatttgtcttatctaattaaggttatgttatcccctttgtcaaagtgattgggaaatatatcccagggataaaccaatcagtacatggcttttttcccagctacaagagattggttcagggaagagtatttaattgattttaggtccatgaaggtatctgggaagtgaaggctccctgggagcttttgtaaaggatagttctgcatttctcaggaactcatgtgagaaatttcttgggtgatatgttaagtagatttgtagattggattgatgacagccatttatccaccttgaaacaagccatcttaagaatgatgttaactcatggaaagagaaaagccaagaaaactacacagaaagatggagcctgagccttcaccaaattgcagcacaagctcaacctatgtctagacttctctgaacatacggcagcttgagccgagtttttgttaccggcagccagggcatcttaattattataactgtaacaggaactgtggcatcagagctgatttctgaaaggaaaataggatttagacaggtgaatggtaggtatgggaattgagagagccctttctgggacaggaaattatgggagcaaaagcaaaggggtaggaaaacacacggtatgttcaggggcgagtctatcacaccggatgagaggtggaaggtgaagctgacagtaggttgggggtggtgggggactttactgacccttctggaaaactaactagtggtggaatgggagttggagcagaggaggagaagcagatacaggtggttgttaccatcatctgggccagtgctcacaaggacccttgctcacaccttggcagtgaagatggagtagagaggatgagttcaaaggccatgccaatgacaagctacacatgatgtggtgtcgcacttcatgagaagcaaagagagtaagaaatggactatgaagtttaagtctggggacatctggtaaaggctggtgccgttaatcaggaatgataattcaggcaaaagagttaaactaccttaaataatattttttttctttttttttttttttccttgagacagagtcccgctctgtcgcccaggctggagtgcagtggtgcgatctcagctcactgtaacgtctgcctcccagatgcaaatggctctcctgcctcagcctcccaagtaactgggattacaggcgctcgccaccatgcccggctaatttttgtgtttttagcagagatggggtttcaccatgttggccaggctggtcaggaactcctgacctgaagtgatctgcccgccttggcttcccaaaatgctgagattacaggcatgagccactgcacccagactggaatattttctatataatttctttaaaaagtcatagaaacaacctaaatccaaactaacaaggagctgaatgactggataaattatggtacatttcctgaatgagtgaaatactctgtagtgagacattaacattttcccatgtgtgactcacttgtctgataatatttccatgccagacacacccccataataaaggttcctcactccatgtggctgcacaagggggtgggttacacgtttatttttcaacaccatctctttctttctccaccacaaataggtcccttggcactacacagttgaaaactattgtttgggaggatgtcaagaaaaattctttagacttggagaaaaatataaccaaaagaaactgttatctgagtattgaaaatttagaagactacatacacatggaaaaaaaagatacacacaaatgtgcttacagtaattacttctgagtggtaggatctagagtatttttttcttttacttttttatagtttctatttactttctaaaatgcatatgtatcaactttataattttacaaggacatcaattatattgggttcttcagaagcagataatgaaatgagggtttgtgtgaaaatgatttatgaggcagggaataatttttaccagcttcctcatttgtttaatagtgatgatgtgaaaaagaaaccagtgagtgagtagggaagtgagaatcatcaagggaagagccccagcaaaggtgtcctattaagcaaagtcccactgagggtaacttgagatcaacttctgctgacctatagaagctggggaatttactggccctcctctagtcagtcactattagagagctgcccccataaatacgtcaatgcccaggaacttctggttcttcttgcaggtaggaaaatgtggggacagagaggctgcccaaagagacacaggtgctggctgctaggagtaggcatgggcatggtaaagggatctgagggaatatgcacggaacaacgaccgcatttgctggagatgcttacaaaatcttactgctgtaattaataaatatggaaacctctgtttactaactgtgttcattcatattaaaaacatttacttaaaagaaagaggactaaatagtaatacattgttggccagcacttcttactgggaaaggagatttgaagagtcttacttttgtaaacgctttcctaagtgctacctgcaccttaaatgtcacaccttatattgctttatgttctcagagttcacattctaaaactcatacgttaggaattaggaccagtggatagaaaaacttgatgacccctggggacaccaaatgttgattgctgcttgttgttacagaggcaagacaactgaagtttggggagaaaaatctcccttcctgacagcaacatgccagaccattaagaacttttgcaaaaatcaatattggtctgaattattcaactggtgtgcaacaggatatagtggaatgtaaactattgggcttccaccaaagatttgtggctggcatccactataaatacacaaagtaactactctctagggaggaaaacagcgagaggagcaggaaatgccaggtttcagaaaattagccaaccaagttcacccagcataaatgctgatgcactgccatatttgctaatataaagggtggaccctctgatacattacatgttgagaagatcctcagcttcttgccatgtttcaacgtggactaaacaaagctattctatcctctgagcttttaagctcccttttcaataaataaatcacaaactaaacattttgaaagtcatctctttctcctgtccctgagagtccagtcataggtctacacagatggctgtcaaggtggtatgatttgaggtgtgctgggaaagtcctgtttgtccccaaatatctcccctctattggcctgtcagtcatgaggaatcaatcaagatagggcatttcaggaatcagaggatacagtagagaacaaaggttctgaccctggtggaatttatgaacagatttcaggagtcctggtttcccaaaaattatttgagaaataccatgtgtatacacatgagtgcatttccaggttagagaatccagggctttcatggtattttcagagtaatccatgacccatgaatggttaaggatctcaggactgagtcaggagatctggttctctatgcctgtctggctactggctggccatgtcatctcagaccgagactctccctgcacttgcttcagattcctgcatttttgaagactgcctggttaaagtcttggtgctccaccatgtctctgtgtgtaaagggccccctttccaagactgctgaggaaaatggccaaatgcttcttttgtacctgcttcctatggatccccctcagctcagggaatagtaatactttaagacagcattactggagaaaggtagaggaaaggggaataacagagaatgttagagaaagaagggggagagaggtgagaaagagggagagagaaatgcctctcactgatataggggtgtctgtgaggcaaagtcaaaacaccattgacaaaggtggtcttaggatcagtcccttgccccagcccccgcccattcattccctctcacttccaagtacagctgcaacattcaaatgtttgaaaattcattttttagaggttttcaattgaacaaggacaggaggagaggaattacttatgcgtgtatattcatgtttagtttttactttttaaattatgaaaccatcgtgtcttccaacaagtaataaagtacaagggaataattttttactggcttcctcatttgtttaatagtgatgatatgaaaaaaaatgaccttttaaaaacacttaaacggttaacttttgatctcaagtcttctccccacagcttaatttattaaaactaaacacatcttgacattataaattaggaaagttgagagggcagtacactataattagaagcctgggccaggcattctacagaacagataactacaactattacaagccagcttactgaaaattttattggatgtcattcatgcacaagtaatgaatgaagaaccaccactcatggaggggctgataatacgatgggtagggtgggtagaagagggaaaatctttctggcccctctctgcattctagcctccgggcttgagactcaccaccaacactgcttataaacatgaaagggattctgtttgttcaagtgctgtaagacctatttttttttacattagttaaatttttatttgtattttattttttctcagtttttttatttcaatagattttggggtacaagtggtttttggttacatggataagttctttagtggcgatttctgagagttcagtgtacccatcacccaagcagtgtacattgtactcaatattgtagtttttggctgagcatggtggctcacacctgtaatcccagcactttgggagattaaggtgggtggatcacttgaggccaggagttcaagaccagcctggtcaacatggtgaaatcctgtctctactaaaaatacaaaaattagctgggtgtggtggtgggtgcctgtaactctagctactcaggaggctgaggcaggagaatcacttgaacctgggaagcagaggtttcagtgagctgagattgcaccactgcactccagcctgggtggagtgagatgctgtctaaaaatatgtatatatacatagtagtcttttatccctcacccgcatcccaaccttaccttctgagttcccaaagtccattatatcattcttatgcctttgcatcctcatagcttagctcccacttacaagtgagaatatatgatatttggttttctattgttgagttacttcagttagaataatggcctccagttccatgcaagttgcagcaaaagacattattttgttcataagggcctatttttattcactatgcaactaatgtaccaggcataatcccacaggattacttaagagctcataatgggcttgagactagagatggtcctcaagacagagtccatttctggtcacccttcagggctcagggaacactgggccctagctgtgatcaaatttggtcatcactgctgcactctaagactttcatggggtatttacacttaaaacataccaaatagaaagacatggggttatgacctgtaaatccttgtagttggttaaatctattctaagagcaaaaagtaatatagaaactgaataacagtaaaaaaaataactagcaacaagctaaatgttcaataatagggtagtaaaatgacttatgattgacaggatattatgcagccattgaaatgacggtaggaatcattgtaggtatcattgtggtaggtacttatgatgaaatgttaaattttaaaaagtagtaaaaacttatttattctttttcaaagatctgggtctctaatcatgccacaagattataattaagaaaaaaagaaaaatatcccataaagaaaaaaaaaagttaacattttgccatggaagagaggtgttaagaagtgatacttttcttcttctttttcatttatttgataattatattatcaattatattacacttgtcttacttttatactgatacatatatttataattaaaagaaacattaatattacattcacatattaattaaaattttaaaatattttctcctacattaattcatttgctacataaaggaaaagtaagaaaactaaaagtcaagttgctagatttggaaactagagacagtgagtgaaagttggccaagtccccacaactgtcagaaacagagcaaatcctcaaagacagggttgttaatacccagtctagagctctttagcctccaaatcaaaaggctatttctggcagaaaaacaattacatctactagagaatgtattcagggaaagaaacatcttctgttattgtactggacctctgctgtttgtacctatccattccagcactatcagcatctccctgtgacttcctttggtggaccactcttcccacattcatggtccattcatacagttttaggcagtgcctaccctatgtcccaaggccatggttatgcaatggcccatgctggacaatcagtgtagtccaaccagtttcaagcttatccaatgagagtgagccctgggatgttggctggaatgacattctttccactggggcggcagaactggcaacacagaaatctggtgttcctaggtgaccctttttactatctggagagatcctgcctgagaataagataaaccagggagaagcacagctaagaataaggtaagatgattcctggtctcatggcctgaaacctgggtctagcaattcctgagacttgataacactggatgttacattttcatgagtcgacaaattccgttatctccttttaaggcaatttgaggtaatttttattacttgcaatcaaaatactcctgactcatatttctgccatttcccagcaaagtgtatacaaacattttctggttaaaaaaataattattgatgaaagaaaccattgtagttctatatcatgtagtcacaattgcctgtgttcattcatcactgttgtgatctatgtcatattcttccctcgggcaaaaatattttagcatcttacaagatgctaaataaaggggcaaatatgaaatgaagcaattacaactatttgttttgtctcaaatgggtgtgttatagttcctaattaattttggtaagtcaacaaataactttatatatgttcattcacatttgacaatctgaatatgtatgatgcttaaaaataagttttgataaacatatcttaattgacagagcagaaaaggaggtttcttaacttgccatctatatccaatctggatttagacttttcaataaacattaaacatgaaaacatttttattagcggtaattatacataatttagataagtgattctgaaactttagtatgcatcagaatcacctggaaaacttgttaaaaaaatttattgctggccactgctcactctctctccaggtctctgattctgtggggctgaggttgggcctgagactctgcatttctgacaagttcccaggtgatgtcgacactactggtctagcaaccacagttcaagaatcactgatttagactttgtttttaagttttgcattttgctgtaatttttatttggtgtaaactgtaatatatattttatgtctccgattaaaaacatgagcccacgttttctgagatgccgatataatttagacctgaaaattctggacacaaagataatgatgtgctttaaaggtggatgggaaacaacagagttaaagtaatttgggcaaaaccttgattaaaataattcattatggaatccaatcaaccttaatttccaacagatgacatgaccactcaggtattccgctacatcaagcaaaattcaggctcaaatgttctcctgctgcactgattagcaaagttcaccaggccaaagtaatcaagtataccacaaattcctaggtgcctttttatctctgcctaacacaatgcaactaagtggtctctgtctgccaacgggagtaactcttaggaagagcaacgaaacagtttgctaaaacctggttagtctgcaggaagtcattaaaatgatagaataattcaggaatctgatgatctccaagtacaatgccttgtcattttgtgattatttgataattccaatccacttcattcaagtaagaggttctgggactttaaaatcaagtagggtctgaacctaccagggtctgaactgagttttacaatgttaaagcacaacatcttactgtcttcctctggacatacccaaatgggttttctctgttggtaaacaatgacatttctccctatctttccattcaaggcttaaccactaatgaagtaagaatctctcatattttaacaactaagattagattatgacagaaacttcattaaaagtcacatgtaaaatatcctctttgattgcatatcaatttgaatatagtccattttaacataccttgtcaaaagaagaatatacattaaatgtaaaaatgtgccaatgttagctgcaaggctagtaaatcaccagttggcaataaggatatttatttctgtatagtgaggaagtgtgataacatagatgcaaagagctgagagaaagcttacaatctgcccaaacccctctttacacacaggaaggaaataagctcagaaaagaggaatattttatcaaaggagttcacttggctgtaaaaatgatgttgccggtcataaagtttttcattttcccagtggagagagtcaccttttcaacacatctgcagcagactcagagcagggtggacagcacagatgttgccaacagcttcaggttccagaaaggccctgagagccagaagacaccgatgacaatggaatccacccaaccaggtaaaacttaactgaagtcaacatgctgccctgtgatcaaatcagaaacaactgtgtaagaacaaggcgggtgaaaagaccttaccaatgagagttcagaaactgcagacatgagtacgtagcctcctggggctgggtgaagtgtgaccgcacacttggtctgctttaagagttgtgcagcatgtgtagaggggacagaggaatgagagtttgctctgctcttcactgctcagatgggaacttgagttgtgtttggccagatgccacactcataaggcatatggagaaatgaggtcattcagggagatggatctgaatggtgcagggacttgaaccgtgtcttataacgcaagagcaggaaaaacagtggttatctagcccaaagaagaaatgttttgggggcagggggaatatgggagttatccctgggtgagacaagttgtcagggaaagagggattcaattgttctacatggccttaggaggcagatctagcactcatggatagaattagtgggagacaggctggagagaaacacagagaagtaattctaaaaatgagagatattcaaagtgaatgacagctaaatacaattttatctaacatttttattgagtccttattttgtgccaatttctgtgttaaggaccttaaaattgtcatctcatttcatccttccaacaaccgtgttaggtacattaccatactgatttaaatatagagcaatgacagctggaagagcttgagtaacttgtccaaggccacatagctggttagcgcagtagcctggattagaactcagctatctgctaagcttctcgacctcaccacgatgttgctatgggctactttgggaagtagggagtttcctgtcactagggtgtccaatgtgggcaaacatggtcttgtaatactttaatattctcttccagtaggaagaaactactgttctatgctttgtcctgaaagagcgacattttgagcacgtagagctatctttatataaataagagaaaatgactctaaggacattgtgaacatgtcataggattttctcttggcccaaccccagccaagaagtcactgctttcctggaaccaagaggataaatgagggactgtgggcaaagggaagaccttacccaggcagcagagatgggttcaggagttagagaggctctttggattccagaggcaaagccataggataatcacctatggatatgatggagaaggccttgtgctctgggtcccacaacagagaaaagacttctagggagctttgattaaaactggccccaagcgggttgagttggccaagacactccactggggaaaggctgtgctgctggtcctcaggggacaggagaagggaactcttggatgacacactccctacacccagataagttcctggggaattatggtcctagtaaaggagctacctgaaatttctttccatagtcccacttacatcaacaaatactgggggatcccacctgctaaggtgaggcgggggcaggggtggggtggggaaatgatcataagcacagtcaggggtttctccaactcctttgcttggaaggaagacaggacagatgaacaaggggatgtggccacagtggcagcaacgaaatcatctagttagctgaaaggaggatctctgtgcccttgggaatcgatggaagtcatatcccaacagctggatgcgtgataagacactaagagcccacagcacgaatcgatggaagtcatatcctatcagctggatgcgtgataagacactaagagcccacagcacccagtgtcaacatccttaatgggtcacttctcttacaaactgggggaaaaattacctcaattttacctagagataataacccttaagattttgctattcactctaagaagaaaaagaagtgcctcttattgtaccacaccccatgctagatgttcaaaagatgttactttttatttaatccatttgcatatgtattattgcttccatcttttagatgtgagattgaaacccagaagtacatccccaaacttagtgagaggaccaggagttgaacccagggctgaaggattcaaactctttactcatttctaccatgctgcctcagtattacgaaaatgtcaaaacactaaggtgatgtccagcatcaaaacagtaagctctctctacttcttctggctataattggtaaaggcaagtcccattttcctttgtcaggaaattcatattcgtgtgatatttatcacaagagatttgcattttaatacagaactcttggacagggaggtggatgtagctaaacatagaggaaataagtgaaatggaagaattatagatgatgtcagaatcagaaaggaggggaagggaggttggccatgtgatcccccctcaggttgcctggtaatcaatttccaagtctgctgcagcaaaagcgtcaggagatgaggttccataagatattctttgagaaagaggctgtcctctggtagagccaatatgagtgaccttctaaggcacccagaggaaaacaggcaattgatactgtatctagagccatctttagggtgaagatccagattcaattcagtggtaatgagtaatgacaatgttttgctggtctttggaatttataaacctataggtgacagcggccctcaaaaaactatttatctttctaatagcgttgactatactctcactgcccctacatgtcccaaaaacatcttaatttctctgttgaaaagctgacaaggaaatgaaaacttaacaaaaaaagtgaactccacttcatgaatgttttatcaccttcataagtttatatatgggttgggtgctgtggctcacaccggtaatcctagtactttgggaagccgaggggggtggatcacttgagctcagaagttcaaggccagcctaggcaacatgacgaaaccctgtctctataaaaaaatacaacaattcgctaggtgtggtggcttgtgcctgtagtcccagctactcaagaggctgaggtgagaggatcacttgagcctgggaggtggaagttgcagtgagccgagatggcgccaccgcactccagcctgagcaacagagctagaccttgtctcaaaataaaaaagtttgtatatgaagccaaattattacaggatgtatttttgaaaagtgagagttataaaacattagatcaaaatggatgaaaaaagttgtggtgtttcttaaacatacatataaaaaattcagtctcacagggatatgtcatttctatttagaggatcagggttgttttgaatagtttcttatttgtcatatgctcaatgtgcattcaaatacaggtggcaatccttgaagaaaattaaacatgctgtgacttataaatcaaataggaggactataagaacgataaactttcaggttgttaatatgaaaattttttgaaaagtttttattttgggtactaaaaaaagttaagaagacatcctgtagattagttaactcttcataaaggtcattaaatggctttgaatagtatagctgatttaaaaataagatatgctaatttatgtactgatagagtaaatggaaactagcaataaagtaaaataagtgagtctatcctgggctttgtcacttcttggtttatcagtattaataataaagtgtaattttaaaataaagtgattccttcagcagatagtacacaattccctgcagctaaagaatggaaaagagattaattccatgacaattatcttggcttatcatccctttagcagggcccctctgcttgttttaaacctttctatttgtatgtgaaatctactgcctgggaaattaaaacaaatgttacaattcaacccagcgagctctgtccaataggaattcaaggtgaaatgtggctcactgtctcagccctccaggagcccaccgtagagaggacacttgttttcttttaaagcttaattcccagatatgggaaatgaagaattcacaagatttcacttcgggagatttcacgatagagcattcctttgctggtttcattgtcacctgccccaggtaactcatgaagtcttatgagaattgcctcttattcttcgggaaggattactatataccttctgctatgaaattaaccccagtgctgagatacacaaacttactacccaaactcaactcaccctgacctgagatgaatgggggattgcgaagtctttctctgaaccaacttctcagcatcctcacagatgcctcttggatgctcaagggaatacagggaagagaggggaactgtgaaaagtttctgtgggcagacttagataacaataaacggtaatgatgacagttttttttatctagccaaaatagatcccacttcatttactattttctatcgatgtaccctttctctgtactcttcctggtgcagtggtacaagcggggcttcaagggaaaagtgggcccctttatgaatggctggttagggggggaagcttggctatatgtggatttgcagctcattgcaacgtgattcatctcagttggttatgtgcagagaacagctggcagcaggtacccaactagttgcagagagaagttaaaagggactgttgcctgctgagagtgcagaggaattgctttaaggactccctgaagcacagcctgcagcgagcgaaggggcacaggcagggaggcagagaaccagcagcggctgacaggcagttagagaaaacagaaatcggccattcagagcaaaggtttggggccctaatttgagtccaaaaggtggaatggcaaatggtaacaagctcttggagagccccaaaggagaggctgtatgaaagaaatagcaccaccctccaagccccttaattcaatgccagagatgaaatgcaccagtacagaaggaaatcttggccaatgggaacaaggcctcgtggaagccccggcttctgagatgactacagagccaggtacagcgctccaccccttctcttgccttttccccacacctccactttggcaggtaggtagcagcccatggacacaagtaaatcaggtctaaagcctaaaacaccaaaagattaatacatggtgtttggctgattcactatgactgatttgttctgtggaaggaaagaaaaattcaagtaaattcaaagaggcctgtgaacttttggtacagtaactcagaagcaacaaagatccagagaaatgaaaagaaaagaaaagaaaagaaaagaaaagaaaagaaaagaaaagaaacatggtgaggaagaaggacaagacccaccccccaccctgccccatccagggataagaagaagcaaagaagctggtgaactggtgaggcctgggggccagtgatgaaggaaatcatccagaagcctaggaataaaatgtcatttaggtctcacagtctgcaatgaacacgtccttatttccgtattctgaggctttgacatctgggaccttgctgactctggaggggcagtcccttcaaggttggccaattgctagagacagtgaacaactcactcgtgagcaaattttgcaaatgcaagccaacccagagcccacaccacctccaaccagctctctctcactctcacatgaagggcccctgtgccccagagcctgctgaaatcattcaaactgccaactctagacctgttctccctgccttgcttgctgctccttcccacagaaaccacagtaaggattcctgcctgcagtttcccctctgccccttcctctgtctccagacagaccctgagcttcaccttgaagccccctcagggcatggcatccccctccttctgaaacctgtgagaataagaactatcttttcagtagccctcatctcctaagctactggctttgccatacctacataaagtaaaagctatatttaaaaacatggctcccaaaccatgtgtcgctaaaaaaaaagtccattctgatacctcattgaaaactgtcattttgtaacaggtgaacatggaataaatacattaacgtttaggctgggcgcagtcactcatgcctgtaatcccagcactttgggaggccatggcggacagatcacttgaggtcaggagttcgacaccagcctggctaacatagtgaaactccatctctaccaaaaatacaaaaattagccaggcatagtggtgggcacctgtaatcccatctactcgagaggctgaggcaggagaatcgctggaaactgagagatggaggttgcagtgagccgagatcatgccactgcactccagcctgggtgacagggtgaaactccttttcaaaaacaataaaaaagaaaaagaaaaagaaattactttagtctgttcactacacctttactcctagattgtatcttactaaaaatatttttgaaaaagtctccgttttaaaattgtgaactgaactagttcaagatccacataagatgatcagataaatgtctttttatatttttctccaagaaaatattatcagtgaatttactgaatttatatctggctggcatcaagaggtttcaatattacataaatgttataatatcattattattcttcaatatatgattattaaatctattgtaataattacatggcgatgagcatggcttagattccatgtgatgatccatgaagctcttatacctttgcaatgaggcccctgggatcagttttcagacactgaggatggggtaaggtcataaatgggatgtgcattcaagaatttacattcatctcaggaaataccccgacaccacttttggggaaaaaggaaaaaggctgtttgttttcttatttgtctttctctcataaaactagactgcagggagattttttggtgatttggatttccaaggaacccattttatcatacgaacttagaaacacctgcacatcatatgctgtttgcctgcagttgcttctcattttaagctggaattacctacagagttacctcccccaagctactacactgtatgggaggcagtctcctctaaatgaattcctgatcatcttagtattttatgagattaccaaaaccaatttgacttggccccaggaacctaagaagcaaaaaacaaaacaaagcaaaacaaaacagaaacagaaaaaaaaatgatgtcacaggaaaaggtatttttcctgtttctaagaaaggtcttgtggatatgattacaaatgagacaaaggtaagggaaaagactctatcttgggaaaaatgatgcaaaatttccaactgctcatgttccttgctctgttcttaaaaatatgtcttctttactttgctgggttgagatgctgttctctcaaaacaaaccacggacacgtgttacaagctgtatcttctttagaaacacagtcgaacctgctttctagaggagcccctgtccaccgtgacagctgagcagcagcacttactgactctgaaagggaggctgagcctgccctgggtgtgctgtaactaaggcgttccaattccaaaggcaaaaatgctattaagcagccaaggatgtttaaatctagaaagttcaattcataaattaaagatgtatttcagatatttctgaaacaggagtaattaccaaaactaagactgtagagactcttacaccatgacagctggtgtttataatctctcctcccacatccacatcttaaatctctggtcctttatcggacttgggtcacactgctttggttataaagtaaaactgcatatttcccactccctttgtagtgaggctctagggttggagctcatttgaatgctaatgaattagatcaccctcaaaaggttgctatcagaaatcagactacgtggatattttacagcatttcatagtttcagggtgatcgtgttcctgactcagcaagtcaagccaatacctatataacaagggcatttttctggaccccattctagagccacaatttttcccccaaggctatgtaacattttctcctggcaaactattagagttaatagaatgctgtggttctgttctggggactgctcatcaatcatactgctttttgaatcacaacttgtgtaatttttattcatgacacttcagtaagttactttgaagcatcacatctaaaacaacccagggactcactaaacaaaaaaacaaacaaacaagatttggggttttgttttccacttctactcatgatatactaggctttaacttactttgtagagtaaggattaaaatgcttaattggctataactaagcaaactgaatcctttagatgaatcaagccagccagctttcagtttctgacatcaaaatttatgctctgtgaaaaaaaacaaggccatggctacataacattaaaccaacacacaattaacaacactttgttctaattatctctgggaacatttaatgttgcccctatagttcatttttcttctttgatagctcttagaatatttatggagattagtccttgatgcattggccttctctgagatctggggttttcttagaagctcccacacaaatctgagccatgcaaagtaacatatttatgcagattaattcttgacatattggctttttctatcatctaaggtatttctaataagcttctacctaaatctggccctggcaatgcagggcagtcacagaccccccccactccttggcttacctcacactaagaatgtttttttctttctctcagcagttggtcataactgataaaaggttatgtcttgattgaacaagcttccaggagttggaaggccaaaagggctgctgtaaaacagcaatggagatgctaataaaacccaaggtaagaggaatcttcggctgcctattactgagaaacctaaattgcagacaagttcagcttcctcacatcaatagtgagagacaggccacaagaaaacgagcactgatcaaaggcttttgatgatggtagaacttcaatttatggaatgcacgtatttttctacactccaaaggcgtttcttctgaagtcactgggggcattcactttaaagtcataaatattctctccatagctcaggatggtttgcagcgccacttggcgtgtttgtttgggcatgtgatttgatgctctacagatggattgaagcaccacgaggagcttcactgtggaaagtgaaggggctattagttaagaacacctctaaactgattagaggcttgctgaggcaactgcatgagttttaaacatagatgttgttagctcttcatactgatgtgttggatagataggtagttccatgtactacctatctatccaaagagtgtgaacaagctaagtaaccaacagtgaggattaaataaatggcacttgcacatataaacaggccgagccacttggcctcatctctggccataggtgccctggcccttgacaggcccatgttctgagggctccttgaggctgtttcaggcttttctgcttttgtctaggcaattccctctgctcttcattttaccatctttgcctggagaactggcataaagcctcaaagactcacagttcaagtgcaacttctttatctctttgcttcctccaaaactaattcagttagatacttctgtcttggtgctccactgagccttgtacacaccttacatttttctaaaattttaatgtgctttatttttattaccttaattaattagtatatttttaattattatatttttgtcttctttccaacaatgtgagtatctcaagggcagaaaagatgctctgtatctctttgtaattccagcatccagcaggaggccaggcctagaaatgccaaaggagggagaggaaggtgtgctagagagaagacagacaggcagacagagagagagagagagaagagaaaaagaaagataatatgccacagaaggggaaaaaaaaaataagcagtaacattctttctgggtggtattaaagtaattctgacatttaaataactaaaacacaagaattttgccaaatctttgatggaattgatggaactgctggttgaaatgctccaccctccagaggccaagaggtgggcctacaactgaagtcaagccaatgagatccctctctctggactgtaggagctttgatgggatgactaggaaagagacatggccttttcacggtgctgctgatttggtgccatcacatagaaaaggcctgcctgagagaggaactagctcaaatgaaagcagaactgagagttggagaaagctttctgacattgtctgaacccttgcattcatccatgtcttgttacagctgattgtccagttatatagccatccttccttttagttaagtcagtttgagtagtgtctctatgacttgcaactgaaagagtaatcacaaatagaataccttgaaggaatactaagatttcccacagtataaagttttcccaagattttaggtctttgaaattgtttcagcagcccacggaccctctcaatattgtatcctatactgagtgacaatggtggccccttggagcatgtgggttgggtgctctttgcctaactgtgctgcctccatcagcttcatttctgggattcttgattttggttcttaaataagaaatctaactgtctatggacatgactgctttaaaagataatggtatgctttaaatattctatcacaatatgtatgtataaagacttaggcaccaggatgctcataagaacattataatattgaaatactgtgaacaaggtaagcagccaacagtgaggattaaataaatggcactcagtatccattgaataaatttctacatagccactgcatcatatttttgaaaagtattgaataatgtggagaaacaggctacttaactgtatacagtgatatttcatatatcctaatttgattaggtacaataataacaaaaagactagaaatatatatgctgaaatgccaattccagccatttctgattagtgtaattacaattattttcttatgatttttccaattttctgtaatgtgactatttactacttttataatcagaaaactgctagtacaaagttacataatgacatagaatggaatttttctaaaaacttcaagcccctttaccaaagaatagtttttgtctcaaatcctagcttagtgatgttgctaggtgacccacagttggatgtaaaacaatcaagagaaagataaatgccagatactttaagacagggatgtctggtgttacctgtcagcaaactgtcatagaatctaaagattagaaggaaacaattatgaatttctattcagaataccactggcacgttgccttaatttcttttacattgtcttaagataggagaggataaaagtaagaagaacaaggtaagaacttaaagccaattagaaagggaaagaaaatagcccgttcctctcactggcaaggagacaaagccaaacttggacatatccgtggccatgtcaggggagccctcaaaggtggcatgaagccactgaagagcactttggatgatgacctttccccaggcttcaaagcttgtggcactgggcacatgtgggaagggcctctggatctaagtctgaagacccagggaaagttctacttaagaggaggcaggggcgcagaaaggttagattacaaggtggttaagatcagcttcatccatctctgaaaggacatgaattcattcttttttatggctgcatagtattctatggtgtatatgtgccacattttctttatccagtttatcattgatgggcatttgggttggttccaagtctttactattgtaaatagtgctgtagtaaacatacatgtgcatgtgtctttatagtagcatgatttataatcctttgggtatatatccagtaatgagattgctgggtcaaatggtatttctgcttctagatccttgaggaatcgccacactgtcttccacaatgattgaactaatttacactcccaaaaacagtgtaaaggtattcctatttctccacatccttgccagcatctgttgtttcctgactttttaatgatcaacattctaactggcttgaattgacatctcattgtggttttgatttgcgtttctctaatgatcagtgatggtgagctttttttcaaatgtttgttggccacataaataagatcaatgaaagcagagagtagaatgttggttacagaggctatgggggtgtgagaatgcagacagggtggtcaaagggtacaaaatctgttgataatagagtattacacatctcaaaattgctaagagtccatttcaaatgttctcaccacaaaaaatgttaagtatgaggtgatggatatgttaactagcttgatgtaattattacatgttgtattatcaatcataacatcactctgcatgccataaatgtatctaattataaattaccaatttacaatttttaaaatgaccagtgaaagcttgttgggtttagtacagaactggacctaagttgttttgatagctttaaatgtcactctaaaagtggtttctgtggttctcaatcctggctgtgcatctgaataatccacagagtttcagaaaaatacagatggtcagtttccattgtagacttaaaagagctgggatttcctgggttacattctagacatctgagtttttaaaaagctctatttcttctgtggtttcatctccctagcctgcttgcagatctcattcttgcattcatacttctctctcccgcatcatcgatttcgccctctccactagaacacggccattggcacacgaatgtgccataccatcagctgccttttgaagagtttctcttgtaccctatttctcttcagttttgactctctccatgtctgacccacttcaggcctgtctatacatgtctccacatgttttcctccacgcccactcccatcagaaactgttgttaccgaggtcatagctgaccatgccttgccagagccgaggatggattctgtgatccatcttgctggtgctcttagcagcactcaacaaggatacccttggagcactttcttctttaggctgctacaacacttcaccttccattttcctcctaccacaccagacactctccccaggctcagatgctggctcctcttcctctgccagacctcgaaaaatggggaaccttagaactctgtcctctgccctcttcttgtccatttacagttacttctgatgggaccttaattagtcccacaaggccgagtgtcatctgtatgctgatgactctcaaatccatatctctagccctgacctgaactttgtatttccacctgcccatagaacatcatcacttgaatgcttaataggcatctcaacttaacgcgggcaaaaaccaacagacaattgcatgctaattttgctaagtcacctttcctccaaggcttgcctctctcaggaatttggtacaacctcacactcagttgctaaaaccaaagaactagaagttatccttctcacttttttccttgtattccacatccaatggatccgtaattcctaatagaccttacttctgaaatatattatctggctatttcttactagcatagtatagtggagctatacattgggagttcaaattctgactctctcactgactacatgaccttgggcaaaatttccaaccttctggggctcactttcctcatctgtaaaatggggataatagtgctaactactgttggggctcagaaaaaatatccccaaatgaaagcctcagaagccaaagtttttctctgatcttgtcctcctgtctcccagcttcattttcccctagtctagtcatagaaactagaatccctcttccccaaggcaggtcaaagaaaccagaaagctagacataaaacctaaaaaatattactctaattttccttctgcttttctatgtaaaatctgaccataaggaaattatctgacctgtcttgtttgctataggtcataagacccctattctagaagaggttttgccccacacccagaaggaaggaatgctgcaagcagaggccaagaagaatctagacaggcaggcctcacagggtttccacactcagtctattaccattagatcatactctttttttgtacagtcatctttctacacggctctctatactccgctgaacctaagcataaaaatggacaatttctcctgtgtctttgagtccccgttctgaaggctcctatgtatacacattgaaaataaatgtgtatgccttttctcctaccaatcagttggccttatgtcaatgattttctgtgaacctctaggcagccaagggctcccgctagtccccatactaccataacccacagggttacgaacatgaaaatagcatatataaacataaatggtaatcagaacagtgtttgggatatactaagccttataggaaggcttgccaacatggttattattattcccattacatccctctagtccaataacattaatatggtatgattatcattccctattagtcctaggcacctaccctagactagtctactaatattgtttgtttgaatctaaaaacaacaacaaaaaataccttctacctggtctccctgcccctcctatgtcccactattagcccacaaagcagaaggatttgtctttataaatgagaagttacatcattgcttcttcccagtttaaaattctctaaatggcttccttttacatttatatcattttcagagtctttattgtgaccatggcctatatggcttaaccaggtctggcccttgtctacctctgtgaactcatcttcttccattttttaaatcttgtaccttgtgtcccaggacagacttcttatttctgttccttggacttgccaagctttccagcatcttcaggtggcctttcacctttgcagctgcctcctcttgcaatgttcttcctctgatcttcacactgctgtctcctttttattttttatattacacacaaatggctgatgtcagaggtcttctcaagtaaatacctctcctacccctagctcacattctctctgctactacctcaataaacttttcttatttacaggcatatagttgcctgtttgcttatttattatttcatttaagtatatgcttcctgtgtctgcccactggggtggggaccaaaaaaactgatctaatccctgtgcaaagaacacgtttggcccatagaagatatttaatatatttactattattaaatattatattatttatatataaatatattaataatatattaataaatatattattaatatatttaatattaatatatatctatcgactaccagttctacaggtaattgtgatgcacagccaggtttgtctattttgaactacctaattttaaataggaattaatgattaacaaaatgcttatgcacagcactgtaattgtcatcatttcatggaaaggtataattgagtagaaaaagctgttattcaccttaacacatttaattgccatatttttctgcacaaaataaatcattcctagaagcggccaagttctttcaaccttgaggctatctagctaagtcatcagcacatgcttttaggcttaggactctcaggtggtggcgggcctgttctccccctggctagaagctgagtatcagagatgccatgggagttgggagtgagccaagggaacatccagcttcacttttagtcaggtgtgcagttggtccctgagtggagagaagggccacgtgggagtgtcaggagtggggcctgcagacaaacaaatcatgtctttcaaggaacatgccatgagcaaatctggggcctgagtggggcaaatgcccaggagtagggaacagggaagactccagatgaagccagtggatcctggagggcaggtctgggaagatcccttgaatcagtggcttctggtggggtggcagaaaggagtgatcctttcgtagaagggacctgagacatggcagtgctgttgagaatggtgagctttgttctaagtcaaataaacagtctctgaaacagcagccttgaaaacccaaacttttaaaatacatagaaaatgctacagtcaggcactgagaagttacataaaatgtgcaagtggcatccagattgtccatgtgtgccctatgacaccaatatacaccaagtgatttctcctccaggcaccaggaccctaaacacaaattacaattgaagcccaggggaagcagtggctgggtagtgagggtaaacggtctactcttcaccatgaaaagctggcaacagctgaaaccaacgtactcagtagagaaaatcaggctaaaaagagaaagagagagagtgtgtataattataatttttataattttgactgttggccctggaggcgtttttaggaaggtaaaggtcttaattagcacaatattttgctgagcaggcggatgatatggaatgagcccatgacatggcatgcagagacctagacagctctgcaaattaaaagacagaacttggctgtgggagaaggtgtctgagggagaggagagtaagtgggacagagctggccacgttctaaggcgggatctgggaactgaggagaaaggctactgcgaaacgccctgcaaccaaaggactgggaggaaacagaactatcaaaagacagagttgaaggcccttagcctccagaatattctgccatgaccccatatccttcctagggttggattttggaaaaatcaagtaaagggggctctgtttcataagaggttggtgcgtggagaagaaagaggaattgattgacgaatgtgagtcggaacttaccccagaaatggtcacaagagggaataaataatacaggggtggcagctggagggtgatttgcttagacaatattaacttaattttcaaagtcaggggctcctcaagttgtttttgaatattactgtcacagtaatcaagaacgtaatatagaagtcatctctgcatttcattttccacaccttcttagaacctgttaggggagcaggaattaaagaagactgctgtccaccaccctgaaaatcattcctttctgtgatccacaacaccaggggccaagagattagggcatacaaatatggtcatttcaaaaatacgctgatggggtgctggtggtatattggtgagcctagctgccttccaaaaatatgctaatagaaaaattctttgtttttttaaaatcttgttgtatatcaaatttttccaaagtaatttttgacacattataattaattcccctgcaatcttccaggggagcatttcattaaagcataaaaatccacatggggtctgtgaccagctctgactgcagtctgtcaaaatcagttctctattttcctacaataatgtttaacccatgcaaagatcctagacactgagaatatggagcaaatattttaaaataaaaaaaattaagtagcatataaaattcatatgaaaattgaattacatgtatgacaaaatgacatctatatataagaagatatatttatatatatttacaaacatatatttgtatttcttattttacatactttattataaaatgaaataatcttcttattacctgttcaagtagaagatagtaagatgtgaaggcaaggagaaagttcatttaatattgaacaaagaattttaggaaacaagcagtgacactatgactataggaaaattaaaaaataaaatagttttatgaattaaaatagtgggtcttaatggcacttacagatatcatctattgcattcaactaatgctggaatcaagagttgttgcctgaagtgtaaagaactctgtggaaggaaaaaagatactgcttctcttttactcactacagtttaagaaacattcgctgccaaatacattttttaaagacctcttagcttaatgaaataaaatgtacttttcaatgttgtctctaacaacaacatgaactaagattaattttctctgtagtcataaacaaaaactaacaatttaagtacactgttctctgggagtaagaaatgataatatcagctctttcctattgtgaatctagttaattcaacctcaagataaagttatgagtttcttaaaactcaaataggaacctcagtttcccttgagaaagctttcctatcttttatagtgactatctttaaaaaatgacgaaagaatgagaacccttggggagacaagggtgattcctagctctttgcccagagggagttgctagcgattcctttagttgatatttgttctgctctgtgtttgaagctacttgcttacctgtctgccttcggtcacacctgtgtggagtagcccaactctttcattcacagtccttatattgttaatcactgtgcccaggtaagtaggaacaaaattaaggaaaaggagcaggtttggtgtggatgaatgaaagagactatgcaccaggcatcattttaaaaataattacacacgtaatcctcgttacttccctgtaaggctaattactattactatccccatgctttcagctgagggaacagaggcatggggagcctaagtaactttgatggtttcaaatctagaaagtagtcgaacagggattcaaatcaaaccccaagaattgagcttcaaagtgcataatctcaccattctgctttattatcaccgaggaaattagtgtaaaatggatatgctcattatagacaatgtggtagatctgaggtagaattgcagaaagcaagcatagaaaacaaggcccctccaggtctttttgtttttttgtttgtttgtttgtttgtttttttgagtctgtcacccaggctggagtgcagtggcgcaatcttggctcactgcaagctccgcctcccaggttcacgccattctcctgcctcagcctcctgagtaactgggactacaggcacgtgccaccacgcctggctaatttttttgtatttttagtagagacggggtttcaccttgttagccaggatggtctccatctcctgacctcgtgatccgcctgcctcggcctcctaaagttctgggattacaggcgtgagccaccgtgcccagcctccagctcttcttcctttatgctagtagagttttcaggattctgtagactctatggtagaactgcgtttttagatgttgggtgaaggccctttataagcttatcgaaaggacgtaagtgaactcatagaaaaaaaaaatctttgctgagtctttaagcatgtgacatttcaatcaagaactagtaactagaatggtctttgatgactgctataaaaattcatgaattaacacttgaaataatgtcgaatgccacgaagtaacagacgggtgttatcatatcccggtctggaggtctctggaggatgtcagtgctccaaaaatctccttaagtctccttagccagtttcagctcactgttagatgctttacacatttaattcctgcacgttttttttaaagatatgactatactgcttataaaatctctgtgtgtgtgtgtccaatcatctttacatactattaaatattttgcttagtcattcattcattcattcattttaccagttactggggaaaacaaagtaaaatatcacatagcctcttcccccaaggagcttgcaattttaggaactaatccagtttgagggctgaatttaagttaaaatcaattactgccctatgtactccttttaaaacaacattaggtcaagaccctttcagtgctaactttttgctcattgtagacaaatctcagcaggaaatcgtagatcatattagtctgggagaactcaaaagggaagatttatactcactcaaaaccagtgccaataaaagaagcagaatactgttatttttcttgaagagtgtaaaaattgcttcatttcttacctctagagctttcaatctctctaatagcaatttggtcttttcttttccctcatctgtactgctgctttcactcctcgaatcctcatcaaccaccatgtgaagatcttccaaagcttccttatgttttctctcttcctctgacagcttttcctgaagcaagaaagaattactgttttcaataatctccagtgaaaaataagcatgagtgtgaggctgaaaaggctggaatcattctcctgcgtgtgcattcttccggggctgggagtttgctaaacaaattctgagaggggtttattttaaaaaatgaagtagatatttttactgacccctggaaggacaaggccattgggttgccatctctcaatgcagttgtcctttgcacagttggagaagtgactaagccagcaaagccataggtggagtcatgtggttaatccaattttatctgcacaatgaaactcagctatactgcaaactgtggaaaaatacatcaattttgataccttcatttgtgaaaggcatagctcctcaagatagggtcattaaagtcactggacatgcagccatttaattaaaagaatataaaatatcacaaaatactgaaataagagtgatttcagaattcaaagctcacacctattagttctttcagctcaataatgacacaacttttaaggatccctcagtccctttctgtaacactgttcagcattcgtactatggccttgaggcagacataaaaagttattttgtcttgactcactgttggaagcccctcactcaaccttgtctctggaagctttttgaaagttgagaagtactaagttaagcctcatgaatagctcttgttttcaagggaaaaagaagtatcaagagattaccatattaaaaaaaaaaggatccattttgtgcatggagactcttgctccccacaatcaggtgacatccttccattacactatttaattctaaacacaatgctgcagaaatctttgctttaatgtagctggttgtcaaccatctgaacaaaactggattatcagtggtaaaagacttctctatattttaatactaaactaagatctatttgcaaatacagaagcacaaaacgtatcattcttaccctcaaggagctcatacaatctacttagaaaagaagaacataagaagaaaaaaaaaaccacggcgttttcaaactgtgctcatcaaggtactttgaaggttccaaaaatatttaagttactttttgaaaacaaattatgaattatgtaaaaatatgtcttaatgtatatgtatacatttatacatatatatgtatcagtgtatacgtgtgtgtatatataaatcactttagaccacaaagtcagtgaattcatccatgtgaacctgttatgtacagatttcaggatctaatttctcctgtcatctctgtatatataaatgcatagttgattagaaaggttgtagttctttatgaaatcaggcccaagcatgtgtaactgtataccatgtgcaggtgtgagttcagctcagataaatgccaggcaagtttaagatgtacatccacaggccaggaaacaagtccaggtcatggtagcatttttatagctttgattttttagggtttggtcacctgtcagacttacatttccaagataaggaatatgaagtttgtagatactgttcctaaacaaagaagtacctttacttctcttttgtggtttgggatgactgtaagtaaacactaacttaggttgatgaagcaagctgttttaaaattatcttcattttacttttctgtatatagtttttcattcatcactcagcatatgccacttatattttatacatatacatatgtatatatgcacacatacatatatccacacatacacatacacatatacacagtcacacattccttaggagatttcatcattgtgtaaacatcatagagtgtatttacacaaacctagatggtacagcctactacacacccaggctatatggtacctaggttagaatcctatataccatgttactgtactgaatactgtaggcaactgtaacacaatggcaagtatttgtgtatctaaacatatctaaacataaaaaaggtacagtaaaaacatggtataatcttacgagaccaccatcacacatctttataaggtacatgactctttgtgtgtgtgtgtgtgtgtgtgtgtgtgtgtgtgtgtgtatctgtagaagtatcctgtaataatcagagcccaatagctaattaaaacaaagaaaagccattggggtggtaaatgaaaagccaaaagactttggaatgtgacagccagatttcaggtctaacatttatttagcagtttggcaaatgatcttacacaaacttcctttatttttggaaatggagactcgctctgttacccaggctggagtgcagtggtgcgatctcagctcactgcaacctccacctcccaggttcaagcaattctcctgcctcagcctcctgagtagctgggattacaggcacctaccaccatggccagctaatttttgtatttttagtagaggcagggtttcaccaggttagccaggctggtctcgaactcctgacctcaggtgatccaccctcctcagcctccgaaagtgctgggattacaggcctaagccaccacacctagccttggacaaactttttaatttcaataagtcttgatgtctttgtctcctaaactcctaaatgaggctaatgtcaacatatatacactcacataccatatagtgaattcgtgtcattcacaatggttatgttctctaaaattttcatgaacagtacaccaacttaggaaatgtgaaattattgttcctaggggacatacagagttaggttcctgtgagcctctggtcacattttcattaaccagccattatataatcttgttttatgtgtatttctatttaaagacaccttacatttaacatatactgttgattcattcacactgacctaacagccaacagcactgtaactcatcctgaaggaagcttatccgacacacatgtattttatctgtagggcgcatcacagcctgcatgtggttaggaacaccagacagcacttaagcactacactcagggccatgtcaaacagtgaaatcaccaacaaaaagcacaaaatacaaaaagcatatcactaaatagaccacaaacaggatactagtttattgcatgaaagctaaaacaacaaggcacagtcagtgctgccttgctccatctcagctagtaacgtgaaccttgggtgactaatttttcaccattccatgtatgttcacgaatgaccacaaaagtgacacaagtatggatttttgggttgcaaatacatttttgtgagtagaaaatttgcaaatgcagaatctgcaaataatgaggagccactgccctatcgtacacacacacacacacacacacacacacacacacacacatacacacacacatacacacactcttaaagtacctagatacagtgcccaagtattatgatgtagaaataattaaagacaatatggattatgtatcagtatttagattacataaaacgtcagggtcactttacataatttgaagaaagggcaatcaatgaaagctgtgagacatgattctatggaaactgaatgtgactcatactctaacacagtgatacaacttaaatagttagagaggcatagggtcggtgtttggtgaaagagaaaattttaaaaggctcctagtcaagagtaagttttgtccttacaggtttataaggaaatcagtttgattataatagagaaaagctttttgagagaatagttgaataataggattggggagaaaaggagggggagaggatgcttggaaatgagacaaaaattcagatacaattcactcatttgttcatccaacaaatgttttgttaaacatggattactggccatttgctgatctagctaatggagtatggaaaacaagacaaagttcctatattccatgaaattatattctaatgttggtaaacatgacaaactccaaatcaaatctgtaagtaatataaggtattagtagctggtggtaaatgctatgaagaaaataatatcatctgatagagagtggtgtggttaggggcaatgttagatgtgctaacaacagagtgaggctgagtgaggaggtggccattacagcaaaggccaaatgatgaggaggaagtagctgtgcagtggtttggggaagagcattcccagcagaaggactagcaaggcaaatactcgtggcagggccaggcctgccttgctggccagctgagggagggtctgtggtggagcatagtgtctaaaagaggaaggctagcaggaaatgagatcagaaagagagctggaccatagagggtctttctaggcataggaagaagtttggattttattctaagtgcactaaagaggaactgaagtctagacgtaggggagtggtaggttctgatttacattttagaaacatcatcctgactgctgcaatggagaatgggctgtggaaggaaggagctaggagactagttggaaagtctttatacagaaggaaataaaaatcaggaatattttgaagggattgaatcaggacttaccaaaagcagtttttacggtggttcagaaactaccacagatgatgggtcagatgccctgaattcagtgcttagattttacaactttggaactttctgggaaaatcattccaactttttaggcctcagtttcccccagagataaggtgaggagttggactcaatgtctcttccagtgttaaagttctaagaattcaattaagatacagttttcagaaagaaaacgttgtcaaggcactcagtggtagcagaaatgacaagagaacagaaaaaagcacctctacattttgtaataagaaggttgttagtgggaacttgagagctgtttgactaaagtgtgacaatggtacccaaattgtcagtggttaagcaaaaagtaaaaagggagaaaatagaggcaattttctcagatgctcatttgaaagtttggcagggaaggaaatctaaagaactgtagctgaagggcattgtggaggcaagtggaaacctttttcaagatagaaaaaaatgaggttgtctgaagaactaaaaagaagagggagcaccagagagagtagcaaaggtgggaatgtacgaagagatttctaaagccaagaaggcaggggatgaagggcactgatagaggagccaaggtttggaaaatgcagctccctgtaaaatatcactgacttatttacttatttattttgagatggagtctccctctgttgcccaggctggggtgcagtggtgcaatctcggctcactgcaacctccgcctcctgggtacaggcgattctcctgtctcagcctcccgagtagctgggattacaggcaggtgccaccacaccaggctgatttttgtgtttttagtagagatggggtttcattatgttagccaggctggtctgtaactcctgacctcaggtaatccacccacctcagcctcccaaagtgctggattacaggcatgatccatactgcgcccatccccctgtaaaatatcacttacagtttaatttctcagttagcatttctaaatcattagtgtctagcctgaattcttagagaacaaggaattgagtacaagcagctcatttgggagatgcaggaaacaccagtagggaggtagggaagtgactcaaggaaaggaagaattatctgaccccagggtgagagagctgaggtgttggtgtcccaaccctggaggagtcattagttgaggccagctcttgaggcattcatttcctggctcttctagcctgctggaggcagtgaggctctgtgtagttctcaagtaaaagtgctctctgacacagatccttgcagctggaagtcgcagggccactttgaatggtcctggggtgcaggtactgctgatgtgctcgtgacaaagagagtttaaagctgctctgatgtaacgccacccaggaccaaaagccacatccgcatgctgctcacagactagtcactgacctaaaggcatacttgcctgtgctctacatgacaaaatgccctgatgcaaatccagaaggtggggttctctcttgtttcttaatcatttaagattaatcttttgtttcttaatcatttaccagtgagagcattagaatataaggtaacattgagaaagagagaaaatggaagggacgtatttagagtaagtgaatgagcaaaagaaacaaataggtggagacagaggtagaggaaagacctgagagagcggagagaaacgtggctataccctatccacagatcaccatagtccattttagatagactagcagttggatttatcctacactcataaaaacacgacagtattttttaaaaaatcaagtgtatgggttctatccaaaaataaataacttattttaatcagaaaaaatatcacaaattttaggtcctttgccaattaagaatctgagatatacacagcaaaaaggatatcagacagagaggtcaaaaatgtgtagtgctaaatactgtgtatttgtcttacgaacctccaaaaaggaaataagaaaaattagccaggcccactcatgaggatgtcaaagttgaagagaataagttgattctagaggtgacctgttttcatttttatggagtttaatcaagagtgaattctataaaagtgaagctaccatacaaacaactttcactccccacatatttcatatatgattgagaccataagcttgtttacctcaacaaataccagctagaactcagaaagctaaagatttaggagctcagtttgcatcgaagggtttatattaaatttcaccttgtcgctacataaagcaatccttagagctgtaagtttccctaagtggtatctagggtaatgattcacctttggcagagcactcaccttttgttctcaagcagtcaacatcatcaggcctatgtaaaataacatcaatcaacacaaagttctggaacgcatcaagtgaactcagatgacagcccaggaagcttggttagtcctaagagaggacagcatggctcttcatggatggccagctgctgctcagtctatacccttccccaaaatgtgtaaatgtgacttctccatcttctagtcactggctttccccattccaggacacaggaggactcaatcaatattccataaggttattttgtaattcattaatcaagctattcaattaatatttgctgagcagttcctacatgctaggcgctgaggaatatgccaggcatacaaaagtgaaaaatacacgtgtggcccctgttctcatggagcttacagtcttgcagaagaagatagctattaatcaaaatgtcaggagcaaacataaaatagcactgtagtgtgtcctgtgaggaagagtttcaaggtgctttgagaacagataatagagcgatataaatgagaggttgggagaggtttcccagaatgaggtgagatccgagggcacagtgagaccaggaaataaccacgatgtgagaagaggggagggcaactgagaagtccaaaagtaggccagggtctctggggagggagatgaggctggatgggcagatggggctaggccacttgtcaaggagttttgtctttaccctcagggaaatgagaagtcactgaatggaatgccactgactattttcaagtatggcagcagtgagggtaacacagtcagatttgagttctgaaatctctctctgatatggtgtggatgggttgggggaagttaacacagatgtcagaaaaacaagatgctgctgcaataggctatgcgggagttgaaggaaccattattaaaacaacagtctcacaaaatgagaacccacagtttgtaaggcgttccataattctgattcttcagtatgtacttcctctaacagtgacaagcaacatttccttatttcaatgtttctcagagagtgggccatcagccaccagcatcagagttgacaggggctgggggaggagaagaagtacggcttgtttaaaacgcagattcctcggtgcactctggccctagtgactcacaatacctgggagtggggacaggaatctttcattttagagaacactacaggtaattctaatccaagactaagtgcgtctggacaaacacacttgagcatagaacataaatcacttttactttagataagcttttgaggttgcacatttgatttaatttctattattaacaagtaaaatgaacagataattaatcatccaaagcaacattccctggagagtaagagtgggtgtggccattaatagtatactggaacagtaggtgtaaccaaacaagctgatacacatttacctatagcttgctaaccctacttcagtaatagatgtcctatgcaaactactctaccttcaagtgatgagagacccctcaaaatttatatttgagttctgagactctggggctcactatcttatgattgttccttttcatagaagcagatggtattaacagcctgtaactactttcagtggcttctagagcaaagggcattgaggctccaagagacaggttctatgtttgcaacaatgaagggaaacatgtctacaactctcttgcttagaaagccttagtaatttaggctgggcgcggtggctcacacctgtaatcccagcactttggaaggctgaggcaggtggatcatgaggttaagagattgagaccatcctggccaccatggtgaaacaccatctctactaaaaaaaatacaaaaattggccaggcatggtggctcacacctgtaatcccagcactttgggaggctgaggcgagtggatcatgaggtcaagagatcgagatcatcttggccaacatggtgaaaccccgtctctactaaaaaaaatacaaaaattagttgggtgtggtggcatgcacctgcagtcccagctactttggaggctgaggcaggagaatcacttggacccaggaagcagaggttgcagtgagccaatattacaccactacactccagcctagcaacacagtgagactccatctccaaaaaaaaaaaaaaagctttagtaatttaaaaacaatgcctgcttgccccttgttttaattaaataaagagagaaatctgcccatcagtgtcccaaatgaggtagaaaagtggcaacttgttgtcacaataggctcacaatttctctcctaagaaaaataagaagaaaagttggaacattttcatcccaactccaatactcagttccactgggtggatataattgcctagttttgtgtacaaaggcttaacctcaacacggtggcccttctgccttctacaccgtcactggggagtgactctaggtctgtctgagtctaggactgtgaagataactaaagaatcccaaattatggcagaggggataggcagtatatatcacactcggacacaccttggtatttcatttgacagtcaaccttcttgcggatcatcaagcaccgtctcactaggatctaaaagtctattcttctccagggtagagacatctagccccattttcagtaagccttagaacaagtagaagaaagaaatctgcattccctcctagctctgccactagccagctgtgtaattttagttatcacataaattctctgtccctcaatttcttcatccataaaataaaatgcacaaacatagactcactcaaaggtctcttctcactttaaatttatacaactttgatcatctgtaaaaactcaaccttgagaaataaatacttaaaacactgctgaagttcaggggtttttaatacataatttcattaagattagacctgcctagaagattccctgcataataaaactttcgtgcttcttttccagaagtgtatttctatcttcccatttcctcaccttcttggaaaaaaaaaaacacaaaaaaacaaaaaagaaaaccttctctttttgctgtgtacttttcttgggccctaaggttaaagctacctgtaagaaacaaaaggccagtgagagtttagtgaaagatactcctaacactttccaaaaatcatgcctaatataagccctttctaatggcatttgcttatgggaaaatagtcccaagtagctcttggttgcaaggccttaaaaaaataaagacaattcactcatctatttttattattactaactctggtggtggacacaaagcatccatgtagtaacactgcacctatcctgacggtaataacagctaccctctgtttccaactcactcattattttctgatggggactatccttaaatcttagcactgtagggggaaaaactctaaagtacttagttttttaacttgatggcaaaatgaaattacagggatatgaagaaacatccaactttaggaactagtcatttgtagaagttaaaacagaacttgttcattttgaaaatgtaaccatgtgtcaaatccacctactaattcatagcaacaatataaaaagctataatttaggactgttcacatgaggcagagatcagggtggtgttaaaatgaaatatgctctttccagaacacaaaagacataataaataacgattcatatttgtataacatctcagggttaaaccaagtgagttcagacatacaattttacatatggcaagggcgatatagggcaaatattctggactccctttacagacaaggaaacagcctctaatgggttgttaggtgacccgtttaatagtaagtggcagagccagaatttaaatacagttccgattttggacgtcatgctctttccacagactcggtgacctcttttggactttgacatgcatgtacagatctatccctaacggtagtaattctatctgagaatctgtgatctttagccaagcgtgaaccatgctactggcagcgtttctcccaaggctcccaggccattcctctacggagttggtgtttgtatcagaaatgtcagatctggcctcaggtgactactagcagaatagttttaacaaaccaccaccacttccatagttaatgatgacacaattagttcaaaacataaacacataccataataggagctaaatggaaatgcagagaggccagccgtctggctgacagctgctccagcgtgccctggttgtttcagcttctgtgatttatttactcatttgttttctggtggtgaggagggtgtgcaaaatatattgtcactttagatagcacttcagcaaataccataacaacattcccagggattgctagcagcttttgttcagcacaagcatactaaattttaaagagggaaaaatagcgtcagataaatcacaggattttaaaagaacatcccaatttgttcacagtttaacagtactactgtcaggcaaaacatataaaactcttctttttcatctctggatttgacttacaaagagaactaagcacatggtaaaatccccaagattaaatgtgtatgatggataagagaacaaagtgttttctttatgtctgtaatatgaacccacgaccactgacatatcaatccacatctcctccacattactcttcactcaaaaccctcctcaacattgccgattgtcttccatattgaacagatcctgtggagttacactaataaattttcagatgatgcttttattgcctgctccatctatcggcaacacttatttccctaaaaaaatagcctcaattctaaaaccactttacataaagggaaactctactgtggaatagaatggtgtgaaaagttcccctagaatttcattaaaggtatgctccaggtggctggacatctaagaaaactaataacagaaattatgtccttgtagcccacgggtagttgtttgagtataagctgggcagatagaaaccaaaaacagaaagtaagaatgccatgtagatagggaatttcagtgggtaatagttaaacttacatgcttaagagtcagagaaaaaaaaaaaaacctcataacttaaggttgaaatttgcaattcaaattcaatccccctttatcctgttttctaaaggaattcacagggtagggaagctgagctcatggacttagcaagggccatcccagaaggaactgacaaccccgtcactgagttgtaaatggtaggtgggtggctagagtattgctgtctattgtactcacttacagcagccatgtgtctgagattccctggcagaattttaatcaaaataaatttaagccaatataaaattttctacccattttgtcacaaatggatgaacctggaggacattatgttaagtgaaataagccaggtacagaaagacaaatatcacatgatctcaactacctatggaatctaaagaagatgaactcagaatcagagagtagactagcacttagtaagggtttgggtggaagcagcggttgaggagatactggtcaagggatacaaaatttcattcagataggagaccagatgcagtagctcacatctgtaatcccagcactttgggaggccaaggcgggtggatcatgaggtcaggagttcaagaccagcttggccaacatggtgaaaccccatctctactgaaaatacagaaaattagccgggcatggtggcacacacctgtaatcccagctactcgggaggctgaagcaggagaattgcttgaacctgggagtcggaggttgcagtgagctgagatggcgccactgcactccagcctgggtgacagagcgagactccatctcaaaaaaaaaaaaaaaaaaaagaagaagaaagagtaagtatacttaacaatgtatacttgaaaattgccaaaggcatagattttaagtgttctcaccacaagaaatgataagtatgtgaggtaatgcatatgttaattagcttgatctagccattcacaatgtgtgtataattaaagcatcatgttatatataatatatatacaattttattttttcaagtaaaaattctaaaacaaaataaaaaaaattctatctctgttctctagatgaccgaggtgctcaaatttttgtttcagaaaacacggtcaatatcatatcatttttgtgtgtgtgtggcaattgctggcaaataaatagttatatatcttctaagcttattaaaatgaactgattaaaaagcaactgcttctataaagaaagaattctttcagtgtttaaatgaaataacaatgataataataatacatagctcctatggagaagggaacttctcagtccaagttcagtaagtagatactgtatgcaattcaacaggtcacaattataatgtaagactctcaggggcaggaataatgttttctatatcacatccctatcaccacacactgcacaacacagaaggcattcagcaaatgtccaatgctggtgaatatgctgatgctttacctctgatgacactgggagtgagagtactgctgaactacttaactattcttaagtactttcaacagaaaacattttttaaacaagtattttggcaccatagacataaagcaaaaaaccaataggatatttgcacagaagataaaagcaccactaaattgattttctctcttagaaaatgagattttgcacgcttatcctttaactgacaccccctgccacatgcatcttctcacataggagcaaatcaacttttaagccataaatagttgtcttccctaagacaccctgggaatttctggtgactcaaagactaactcccaatcaaggtactctattcctcccaccttcttccaaccaggggttacctaaaagaagagctcgaataagatgcattaactatactacttttgaaagtcagacataaattacatagttaattctcttgggagctcatgtcagaaaagagagaagctccacctatttgcacctaaatggaacttaaggataaagcaagaagactacacttcttctagtacctgctgtctctagtcaggcaaaactcagtgcatagggtagggctgaattgcttgaggatttgtactgaagacatttttgctagtaatactgtcctggtatacttttcgacattaaaactattatttttatccctaacccctcaaagtggcaggaagctatcacttgaggtgcttctttgtcacatagtgggatgtacattctgacaaaccactcacagcctcagtgggagtagagaagcaaagagctacttggcgaagacagctgtaatcctgccagatgattcatcttggtgagagaggaaaggaaatttagacaaattaacaggaaataagtatgatcctcaaaggcaattagaaaagtcagaatatgtatgtgaaaaagcaacagaaaagtgcatccaaaacctgggtaaccagtttcttcatgcaaaatctctgtgtttaaagaataataaactggccaagctgtggttcccatgacaaatggctctcccggaaaagctcttccaaattaatccaaataaatagtcttctagatttcaccagtagccatcttagtgttaggcaaccaagtacatcttctgttgccacaatcatagggaggggaaagtagaaaactgagcatccactgagctggatgctggttccaggtctgccactcgtaggtggtatgactttggtaaagctactgggacatctgtgacatcatttcctcataggcaaaatgaggtggttggatgctggaggtaatatttagctctgagagtcagtgacttcaaattacctgtcttgtcttctattcctcctcctgagcacctaagacttgctgaccatcctgatcaccccacatggtgactgacccgcctgtgtcacactacagctctttccttagaaaccagacagaagctggccacatggtgcacatcaacatgacaatagtcgggaaacatggcctgtggtcttggctacacgaataaatgtgagattatccaacctctctgaagcggtcctcgtctctaagatcctggatgatcactttatagacttctgcccacaacaaccctgaagcattctggcaataactcccactaagctgtaaggatgctgcctggttctccgtgtctctttcaacccagcaaacttagcagtcctgtgtgtcaaagattatgccagacactgatgggagagtcagaagcaattatggtttgggccactctagaaactcagctctacacgtaaggctttgaacttgtggggctgagaagggttcactgtgagaatcagccctgcggcctcgctgcccacatcctctctgccaagcttccactgaatttccagggcctgtcatcatgtcaagaaaaaagtctcagtttcgtaactctctaacacttgctaattgttcaacttttaataaaggaaaataggcctcaagctcagttagcaggcaccactaactaaggcgaatttagagtcctgtcttttttttcatttaggccataatgtcctcccactaatgcagatgaaatgattttctatttctaggaaggtttttccagcagcagggttttcctccacactctgcttcttcagacacctctgctatttctcacccacccagtccagtctagggtgtctgaacagggcccaccccatgccctagtcacttttctgagtgacccactgaccttgctgccccatgcctacttcctccccagcaacgagcttcctaccaacccatgcttcaaacatttctgggaactcctcagagccccgagaggttaagtaattccccaaacatcaggccgcttgtgagtggctgctcagtgatgatctgaatctaggctgttggcctctgaaggctttaaacttatccaacattctctgcttcctctcaccagaatacccatagtcctctgctttcttgcatcacagtgcccataaccctctgctgtctctcatcagagaacccacagaccaaaggatactcccatttatctgaattttactccttcaaagaccaactcgactcccatcttctccagaagctttgcatgtctcctatgcagaatgcataggctggccactctacagtagaggctggtgttgggttagtgaaaatgagatcacagccatgagaccacagccacaggaagctttcacatagtgagcaagaaaaatcagccaagccttgcagtacaatgattttttttttctttttctttttctttttctttttttttttttttgagacagggtctctgtcgcccagactgtagtacagtggggccatcatggctcactccagcctggacctcccaggctcaggtgatactcccacctcagcctcccaggtagctgggactacaggcatgcaccactatacccagctaattttttatatttttttgtagagacggagtttcaccatgttgcccaggctggtctggaactcctggactcaactaatctgcctgcctcagcctcccaaattgctgggattacaggtgtgagccactgcacccagcccgcaatgattcttaacccaggcttcatattagaataggcctgcggaaatttaaaaaatcctcatgcccaggccacaccccagacccattaaatccttagggtggaaccagcacattagtgtttttttgttttgttttgtttttaactctccggatgattccaaggcacagccaaatttgagagtcactggtgtagaaagtaattaatgccatgcttgcaagatatgggacttggaatcaaaagatcaagtccactcccagcctgactcactgtatgacctgaaaaagtcaactgcctgtgtcaaacaggttcttcaccagagagatgaacttgcactttctgccctttctatttcaaaaggttaatgtgaggttcaaatgagatgatgctgcaagagtaccctgtaaactgtaaaacactttattattactgtgtcaattttcactaccagtcccccagtggtgatgttcaaaagctcagaagaaaaaaaaaggtaataaaaatgcacagaaaagaaaaatacaataacagtagggttagaataattaaatacagtgacccaagagaaatatagcctattttatatcttaagggtatgtttataaattatttttataagtacaataaaaaaggttgtagcaggaaaggaattgtattcaggtgaccacttatagcagaagcttattaatacagaacaagggataggcttggccttaatggggagaaatgagtttcctgtgctaatttattaatttaatgtggaacaaaatttattaggggctgaggtgggaaacctaccaaataaaacacagaaaaaagcacctgtacattttgtaataagaaggttgttagtgggaacttgagagctgtttgttacaaaacaatggaatcatcatgaatgagattcttggctcttcgtttaaacaaatgaagtgaaaatataagccatcataaaccccaattcaacaggcttgttcccaaagcccctttgaacctggtttgacacttggtgcatcccacagaaggcatgcagcaaatagccctgagacagcaggccaggccctcaacattgacttaagacataccagcctcaggtctggatcctgagaacatgagggaaggaggacagagaggatccacagtttctctctccttttgcatgcatgtggcatgtgacaagccctaaaatgagggttataatttgtaatttgcatttacttgcttttttcctcacttctgtatccctatgctaattcctaacagctctttcccccggttcacccagggaaccattaggaattagtctattgaataagtctaaggtttcacccagacttattcaatcactgtagaggattacaagctcctaaatcactttagggaaattattttcctgtctccttccccttcgaatactatgtcctaaattcccgttttctgagatgggttgatacagcaaaccctcagattaactggttcaaactaatatgtgaatgatgctctctgaagtatctgtcatcttaatttcttttgctttggaatgatgctttatggaggagatttcagaaaaacatatctaagtgaaaaatactggtagctggagtatggaaacaacagattgtgcagtggaagaagacagcaccaaaacagcgtctcctgcctaggaatctgaccctgggtttggcactcctgaggtgtctacatttctcacagcttcatgattttctccaatgctaaagctttaggcttacgaaaggcatccgtggcactggccatagaagtacagtaaggtgaggcaggaagaatttggctatgtgaaggggaagaacagttaagtagatgggggattagctgtataataatgataatatctactgtttattgaatacttaaaatgtgctatgcacgctatcatacattatctctgattgttaaatgaaattatgtctaaggaaccactgggaaaacagaaatctttccctttagcctcactatacccactacatagaagaggaaagtgcaattccagctaattaggttgccccaaatgacaaaaccaactgagggagaaagctaggattcatttccaggtctgcctctccctgaaactttttctcatttaaattcctcttcacaaattccccaaccagcacctcttatacatgtggtctttaagatgtgagggactgctgggacttcatagcagtcttttaaaaaaatataatttcagcttttattttagatccaggggatacatgtgcagatttattacctagatatattgcgtgatgctcaggttaggggtatgactgatcccatcacctaggtagcaagcatagtacactatagcttttcaacccttgccccctccctccctttcccctatgggagtccccagtatcttttgttgccacatctatgtccacaattagccattgtttagctccttcttataagtgacaacatgtggtattttgttttctgctcctgtgttacaggataatgtaggataatggcttccaactgcatccatgttgctgcaaggaacatgatttctttcttttttatggctgggtagtattctgtggtgtatatatacaacattttctttatccagaccaccactgatagggacctaggttgactccatgtcttttcatgagatgtctttccaattgtttgtgtcatctctgatttctttcggcagtgttttgtagttttctttgtggagatcttctacctccttggttaggtgtattcctaggtattttatggccattgtaaatggaattgcattcttgatttgcctctcagcttgactgttactgatgtatagaaatgctactgatttttgtacattgatttcatatcctgaaattttactgaagtcatttatgagttccaggagtcttttggcagagtgcttagtgtttcctaggtacagaagcatataatcagtgaagagagatagtttgatgacttcttttcctgtttggataccttttatttctttatcttgcctaattgctctggcaaggacttccagaactatgttgaatagaagtagtgagagagggcatctgtttcttgttccagttctcagagggatgcttccagtttttgccctttcagtgagatgttggctatgggtctgtcatagatggctcttattatgttgaggtatgttccttcaatgcctagtttattcagggtttttgttttaatcatgagggatattattgaaagcttttcctgcatctattgagatactcatttaaaaaatggtctacaatttccctttcatcagattatttcttccctatgttaatctagctattgcatggagaaaagaagaaatactgagtattgtttgcctctgtgtttgaatggatggctgacagactgacatgggagtcgggaggaggggggcaacttcaatagacttctctactatctccaccctttcagggcctaggagctgacaaagtcctgtgcagggggcacctctggatagtttcacagctggcacatgcctaaagtgatttaggattagatagcccttcccctcccaggccacagcaaataattattagtggaagaagaaacaccctttgaacttccattgagcatccacattctcccatgacctgtaagtcaaacttccttaagaatattctatggaaaactaagcatggtggctcacacctggaatcccagtgacgttggaggctgaggcagcaggactgcttcagcccaagagttcgagaccagccagagcaacatagtgagactctctctctctctaacaaaagaatcttctccctgtgcccttcctcatagagttgagctgtccagaaaagatcttcaagatcatggagttgactgatactcacaatcatagcaatggtatttgcatcacctggggaaaatgtttaaccatactaaggcccagtctcagctgccggagactctatggaactgttctgggttgaggcccaggtgggttgtgaaccccaatccatcacagcccaatcccttgtcttacaaccgaaagctgtaaaggggaagatggccacctttctagacccagaaactgctccagagggcccaggaacaagcttctaagccacaaaggttgtggttctgcctcctcagatatgcctgtcaggccaattaacacctgaatcttgcaatggcttaaatgccaacagcagacccctggccagaccattttcctttcaccccacacctggcaatttctcttcatcgccatgctgtgctcgccgtgcagacaaaatcaataaggacaatatagctaaaaggttaccatatagcagagatctcagtaatgaaagtgtatgtttttttccagcaggcctgttccacttctttcttaactatttcctcattccaaaactatatttcctgtcacagcctattttctctccatttcacaaagcattaataagccaagttctaaaaaaacaaaagacagttttttagccacaagtgaataaaagtaaggtcaaagttcaaggactgatatcatcgtgattttgctctgttcaaattcatttgtttcttagaccaggaaataactgatatacctggttaatgatctagaatgccccaagtatttgctcaagctgcacacttactaaagggcaacatcttttggatggtagccacagaacctcctgacctgaaacaatattgggtattcaaaataaaggctggctctctgctgagatgagctggggaaacagcgggtacatacattggcaataaccagctcacctgtagtaagagaaggtgcttttccagggcaccattttattcacaggttatatttgttttaacagagagaccatattctgcttttacttggttaagaactcggttcagggtcaaaacgtctaataggaaaagcattcgtgtctgagcacagaatttaggtagaaattgagaacaagaaagtagagtcagaacccattaaaccagggattttaaattccggagaagaatgtacatatctatttcaactcttagtgatgttatttaaaactcttctattcctttcaaagtatttaacatgactttggatgtacgagacaaatactttttagttagtgtgccagccagcaggtgctctcaaatgaaactgttttgaaaacttctggatatctgggaaatatttctgtaggatgtagaataaaaaaattcaccttatagaataatttcaaagagaaaaggaagattcatcttgtttgaaagacattatttttgactgacctgaatctaagcacacactttggttatgagaaattccgccttctgtatctgaacttgttatatgaacagtggatgccacttaaaacaaaagaggaagaaagaaatctgcttcctcaaggaagagtttcagccctttaaatcttaacacacaataaaaatactcccattaccaccatcacccacttcagcagctattcgaagttcataacaattcatagaaaagaacaattgcttaaagcagaatcaaaaacccttgagacttctcaagattataggccacagacataaataaaagctctcaataaaaatactttataaccttattgtgtattaaaatgttataaataactgtgcaaagacttagccactctatcaacaaacagaattttagatttcttttcccagcctgtgtgcactcagtcactcaatgtactcactgccgatctacatatttacagttgtttaccacattttgttaaggcttaaaaaaaaaataaggaaagagaaaggaagcactttctaaagaactgtaaattacaattgagctctcttaagagttcacttatcttcgctgattaacttccagggtacttactgaaacaggtgttgtgtgtataaaaatcagtatagatgaatatagcatgtgctggagtgagactttgggctgtgaacttcacttcaactctattttaaccttttcaaaatgagggaaaaggttatggtgaaatgaataggtgttgatgtacctcactggttcctagcacagatctacggacaagaggaatcaaaatgatctgtcaaacctggaaacaacaaaaccaagcagagtaccagcccgcatcacttgaactcagtagatttaaggagatgcccatacagcagattctgttgcaagtccctcaggtgattctgatactcagtcagggctgagatgaactagtcaggaactttccagttcttgaaaaccacaaacacttcaattttgccttgtgtgtacatatgttcatgaaaataaaatctattatgttagaaatttggcaaatatacattttatactaaagatattgctatttaaaggagatttcttttaaaaaagatatcttttataattgatagtttaacaatataatttttcaaccctaacttttctctccagtgtatttaaattttggagtttgcttaaagtatacttaaatcattacaaggaaagaaggaagttgtatggcagacaaacctgacagcaataacttaagcataccctgagaatgaccctagggtgtaagaggaatgtgtgtttggagttccaaacttatgaatccaggagtggacaatccagggattcattccttatcaatgaggaacatcagaacccaggacccatcctatggaacacaggctggacaggtgatcgaggccctctgttttgggttagatgaaagttgccaggtggaggttgctaggcggagggtgctaagtgaaaatgctatataaactgcatgctttttgccagcagttgtggttctcctgtccagcctgcagccactagaccaccctgtatgtaagttccctcaataaatcctgtgtgtcctccactggctctgggtgtcttctttgtcttctcgaacatggtgctgtccctactgaagttaataggggtctggcacaacaaaggtaaagttcaaagtcaaaaatttcctgccacctctgttaagaattatagtctgtggaataatatctctgccaggcaagtcttgggcttcagtcaggaaggtctcaggccatgtcatgtgctttccacataccataaaaggaactggatatatatttcatgattgataaacttagggataactggaaaagggtctctttccccatgcttaattacatctaagagtatgtttaaagaattatttaaggaaaaagtaattatgatgttcagttagatcactttaaatggaaataacttggaaacatactacattgctctagatgcagactaagggatcaatgactgaaaaaaaagaacatctttggaaagaatagagctgggcccagaaaacacaacagctcagggctctttaagaaggtgggataaagaggtagagagaaccaaaaacttggacatcactgaaattttgctgatcactatacttaacctctctatgctctccactggggcaatgactcaccaagcactccatttttatggcagtctacccagctaattaaaagggtgcaaaggatgtcgagtgacctaacattggtaatgtgtaactttgggccaactatttaatttctctgtgcctcagtttcctcttctgtaaaataggtgaaattacagtaactctttcaaagcgttttatgaaaattcagtgagttcatacctgtagaatgatcagcagcatagtgactggtacactgcaggtgctcagtaagtgttagatagtattaattaggtcagataagtggtctatgctatacctcatgtagtccaggccttatagcattgggaagagtagtgccaaaatcccagcattctaagagcaagaggaaacccttgaagttattgttctgttctaagggtttcacttggtttagcacatgtttcaatcattctacatacgtaatcccagcactttgggaggctgaggtgggcagatcacgaggtcaggagatcgagaccatcatggccaacacggtaaaacctgtctctacttaaatataaaaaattaaccaagcgtggtggcacacgactgtaggcccagctacttgggaggctgaggcaggggaattgtttgaacccaggaggcggaggttgcagtgagccaagatggtgccactgcactacagtgtggctacagagcaagactttgcctcaaaaaaaaaaaaaaaaaaaaaaagccatcacttacagactaagagatttcccataaaacttgaaattgtatcttcttgaaacatgtggcgatctttctgcactggtgtgtttctgggttgtctgaatctgctgccactgagctgtggctgcttcccttagggcagacagaggctctccagcctgccataggccccaccagtccctcctgtttctctggcattaaatcaggtgtgggttgttatggcatggctttcaaaagcaaggcttttgcctagtaataaaaaacaaatgacaaaagtgctctgtatttatttctttatcaaaagtgaaaaaaaggaatgtaatcccctagagggtacttgatttttctcatatctggcctactttagctatttacattaattggtgactctaaattcccttcttttaaaatatgaaaaacaaagaacccagagactttaagtgaccatctgaggccataagtcttggtagtcgcagaagctgtatccatagttgggtccttttccccccagttaccatttccacttgtccattcaccttctttctaaatgagttagctaatgtgattcaattcatattccatacagaaaagtaggaacaagaggaagcatggcggctacaatgaagaagtgcagaaggtagctatggacatacgagccctgtaaagggggtaaccctttgttagttctgtgattatttgcatcttactcaggctgtccgtgtttaaatattttggcagatgaatgtgatggaatgatgcccctctccaatgggttgctctattttctttatgcttaattgccccctttcatgtctaattgtaatttttttctaacataagttccctaatttacttaattaaatgaaatggtggtgtgagtgacacaaatatgaaacataacacatatgaaatcctaaaacacctagagagaatgagctggaaagacaaagcagtggggacccgggaggtgcttttccttccttgagctccctaaagttaatcttttcaggtcttcccttctccctaatgaaatgagtctatcctaggggcatatgtcaccttccctgcacatatgacaatatttctgtgactcatatgcttgtcacttcctcagggggaatgagaatcgaacattttatagcttgttaatatatctcagtttactttattattggatttttaaaatattgagacagtgactttgtgacctgagattttagactgtgcctactttccaccacaccatcaaaatattccacagataactgctcagtttaacttcatatggaaaatctgtgattaatttatagttctaccacttggcatttgcgagttcatcctcaaaagatacccacatcccagtccctgaagatttgagacctctacgagctttgccataaaatgagcctgaaaatatctcctttagtggctattggaagaaagaaataagatccacgttgtgtaagtgctttgcaaactgtaaagcaccaagcattgagttccatgttccataagtgctttgcaaactgtaaagcaccaagcatatgtgccctgacaatgagacatggtcccagaacactgggaacacaagatgctctgagaaaggcaggccgtggaactcatgaggaagctcatgactctcatgtccatttcaagagacaaaagagactaaaagagaagtggattattaaaaataagcctgagttaggaagcagagtctccaaggagaacagtgggtttcatgacacattcctttgtgccctcagaatgtgtggaagcttatattttggcttctattacgttgttgaatatatatgattatctacctgccttccccactcccgagcatcctataaactgagcatttcaggaaaagacctgtgtcaggcatctttgcatctctggtacttagaccaatatcttctgggtacttccagcctgttaagttaacatgtgctgcttagtgtgacagaataatacctatcctcaaaacatgttcacttcccagtccctcaaatctgagagcacatgttaccttattttgcaaaagggacttttgcagatttgatcaacttcaggatctcaagatgaggaaattatcctgaattatccagttgggctccatatcatcacagggtccttataagagggaccctagagaggacaatgagatgtgatgatgaaataagaggttggagagatagactggaaagatagaggcaagggccacaagctaaggaatgctagattctggaaaaagcaaagaagcaattttccctggaggcccccagaaagaatgcagcctgaccaatactgttattttggacttttgactttcagaattataagagaatgaattgtgttaagccaccaagtttgttacagcagcaacaggaaactaatacacttagataagaaagtacatgaaaaactggcatttgaatgaatgaatgagcaaatgaacagaggaattaatggaaagagctctagatagaaagcggaaaggcccaggttcagatctcagcatagataataagcagacctatcatttaacttggggcctatagtgtaatctctctggaagtcctcagcataagagctaatgctgtggaatcagactgaccagggttcaaaactcttctaggctacttcttgattgtacatcctcaggcaagcacttgcctctctgagcctatgtccacatctgtaagacagggatagtgccagcacctcctgcacaaaattgttgtggagactgaatgagctacagtctagtcacatttgatggggctctgaactaggtaaatttgaaactgtggtcacatgaaaatgttattaatgtcacttcatgcacaaaacttgaaatcatgcaaattccccaattaaaaaaaggtcaggaatggcaaagctggtaaattgtaaacctctgattaccacatagtgggaccgtctcagttgctgaacagaaaacacccattgtcctttgagagaatccatgttgaattatgcaagctataaattacacaagcaacaaattatgaaaggcctttgggaacacaccccctgaacaaaatatgactacctttaatgcatgcaaagcaattagcaggggcctggaacacagaaagctattactctgctattattatattagctcaatgataaaagactcagaacaaacactgctaccgcagtggaaaatgaaagtaactccagctttcccaggggcctaagctttacgtgggcctctggctcctttcagagaaatcttgcaagttggaaaatctgagacaggtgtgctaatgacaccccatattatgaagcaataaatttcccagctcttgcctgaaacgcagaatttggccgcagggaggtgttaactatgtgctccactagtatcaccacgcatacatcatgcataaactattttgccgctattagccttatttagaaaaatagaatttgtgagatgaaggggatctccctgggacttggcgccacccagcatcacctgcccttctctcttttctcgtttcttgaatgcccagggcacaaggctgtccctagtgcatatgagaagttcagtaagtgtttgttaaatgcacagtgacctttacagttcatgtaacccacctccctttcccattttacagataaggagcctgaggccaattaaaggaatgactgaaatatccctatcatgtgacattaattcaagttaatgactgtcttctccctacagggaagagttcatttcccaaaacgaatagactgggttatggagaggtaatagttttaaaacacgtttcttaaagcatatctgtttttctaagcagctttccgtttcgcaaaatgaatgctgctgatgatgttaagtgtctacaccacagatgtggctaataattgtttaagagctcagaagagaataagcaaaagaaaatatgaatctgaatgaaagagatccaccatgaagaaatcagatgtagcctaagaatgatgcctgattatttagttttaatgaagccaggtgttacatgtgatggggaacaaataatttacttcacagattcatatgaccctttcaggctgcatcgaaccattcaatgcagaatcgagtcgcattttttacttacacctcaactttgtaccaaagcagttataatatctatgaagaattcagagctaggaggactaaaattttttccctttctttaggtggccacatatcaggaaacgctgagcatgcattccctttgtcaagaccaccctctcaagaagaatctaagccctttccctagaaattgatcttagtgatttttccactgtctctatgaagctaactttaatttcttctgaggtagcttaagtcaactctttgcattatattcactgcacatgggaaagaattcttactaccttcttgaagtagccctgtgtagatttcaagggtcaacaatttaggatacagcctcgcctcttaaggttaactgtggccagatttcttaacttactttgatacttttacttgtattaacatattcctcccaatcccttttcacaaccagttgggttgcagagcccacaaattcaggtaagctaatgccacattatgctaatcagctgggttcctatgcttgctttctcaaacccactggctttttagccagcaaaaacctagggctgcccagtgatgacctcacatttccaccaatgtccttgctttttaaagcttttcatacatagttgtgcagtggatgctgggtctctatttgtgatttgaagtgattttcagtagaagtcctaaatttatctatatacagtgtctgtgctgtttctattgtatttcccttttccaccataccacagccttctcatctgtacaggcaatctggaccatactcagattagatgtcctgcttcctggcctggcagctttgctggtgttaaaggacagtgggataagggctatcagaagaagacaaagacctgttatttcactgactgcttactctctttggacctctttagactccttgttgcctgagatgcaaggccagacccaggaggactgcatacaccccagaccccatccagctcttccctgtactctcagtctcactgtaactttttatttccaggacattacttaattatctggagatgcttattctccacaagcctgctgtgaagattcacaccactgcactttacctaggtgtcccttctacctggaatgcccttcatggagttctctattccacaggcccaccttaaatgtcacacctctggcaagtatttattcctcacctcctcagccaagatgaggcattctctctcctgtgctcccagagaatgttgtacacacctctcttttagtcctggccacagagtactgcaatgcctatacaagtctctctcattcaccacaaacttattttttgcatcttctagaatcaaatctacactctgtttcacagtaggagtttatgaaatgaatgaattgaataaacgtgtatgattcctcaaaacagaggtgactaggtggcttttagcactggggtctggaacacaccttttatttatctctgggttagagaggacaaacctagagaaatacaagaaaaacaagcagaccagtacccagccaagaataataaacatggtgtacctgatagaccattatattaacagtttcttcttttttctgctctggagatccttgactctgcaatagatttcgtactgtttcttccatcctgagaaacaaaaatattaagaatttcttaaagaaggtttctaattaacacggatccactcgagttgtagaaatcactcttctatgcgtatttcccaagcttcaacctggaaatctcttttctctctacttcatcttctatcagttatctgtcatgaagtcctttgcaaccattctttgggatgcctctacattctctttctctaccattcaggtctgcctctttatacttggacatctaaactcatgcacctatctcccaatatccctcttcatttccaatcacttctttttaatttgatacagtatcactacatcaatcttcccaaaaaaccactttcatttttaaacaccaattttcaaagttaacacatattataggaatgcactcttcccattaatctactgtcaggtctttctgtgatggtctttctatgacagcacgtaaagatttacttcattcttctcaactacagtcatgcattgcttcataacaggaatacgttctgagaaatgttgaaatgcatcattaggtgattttgtcattttgcaaacagcatagagtgtacttatataaacccagatgggatagcctactacacaactaggctatattgtattacctattgctcctaggctacaaacctgtataacatgttaatgtcctgagcactgtagaaaaattataaaacaataatatttgtgtatctaaacatacctaaatgtagaaaaggtacaggaaaaataccatataaaagacttaaaatggtgcacctgtataggccacttgccacgaatggagctcacaggactggaagttgctctgggtgagtcagtgagtgaggagtgagtgaatgtgaaggccaggacactactgtacactgtgaacactgtacactctaaacactgcaaacttacactgcactaaatctataaaaaatatttttctttcttcaataataaaccttagcttactataatttttactttataaacttttaaatttttaaaaaactcgatgcttgtaatgacatttatcttaaaacataaacatgtataagttatataaaatattttctgtatgtccttagtatataagtttttaaaaattgttttaaaaaacattttttggctgggcacggtggctcatacctgtgatctcagcactttgggaggctgaggtgggtgggtcacctgaggtcaggagtttgaaactagcctgaccaatatggtgaaaccccatctccactaaaaatacaaaaattagctgggtgtggtggcaaactcttgtaatcccagctactcgggaggctgagacaggagaatcgcttgaacctggaaggcagaggttgcagtgagccaggatcacaccaccgcactccagcctgggcgacagagactctatctgaaaacaaacaaacaaacaaacaaacaaacaaacaaaaaacatttttgtctgggcacggtgggtcacccctataatcccaacattttgggaggctgacgtgagtggatcacctgaggtcatgagttcaagagcagcctggccaacataatgaaaacccatctttactaaaaatacaaaaattagccgggtgtggtggcaggtgcctgtaatccagctactccggaggctgaggcacaagaatcgtttgaacccgggaggcagaggttgcagtgagctgagatcgtgccactgcactccagcctgggcaacaagaacaaaactctgtctcaaaaaaaaaattttttttacattattttattaaaaactaaggcacaaacaaacacattagactaggcctacgcagggtcaggatcatcaggatgtcaccggccaacaggaatttttcagctccattatagttttaagacaccacagttttgcatccagtccacagttgaccaaatatcattatgtggcacatgaatgtgcttcctagtatgtcatgttgagaatgtaagttacttaagattcccctacttatgaaatttaaattacttcaaaatttttgttattccaaacaatcaacatctttacacatacctctttatacacatgtgtatttctacaaattatatactacatgttataatcttgttttgttttaaatgtatacctccagtgattccccattagctcaaagtaaagagtaaaggaaacacacccattcccatttccagacatttgcttatgctggtgatacttcttagaatgccccctccatttcatcttcctatatttcaaccctcttttcaaatttaccttaagtttcacttcctaagataactcctcattgatctcctgcttctttgaattcttatagccctatacttcaaaccatttactctatcacttaaaaatccttcactttaatgctcaaatattttgtatatgcaggtcttatcttctggaataaatgacaacatttggtataggactatgccatatatttctaatgtatctctctcaactgtagataaaatacatactcactagacattattgtatgaatcctttgctaattcattttttaaagtgtgaagtagttactctatgccagacactcatcctgtatgttcagactgtgtctggatgaccttgtcattggggcccaccatgaagattcatagacccaaactctgggagcaagaagcctgaactcaatgccctgaacacgatgctctctgtccagaacctgaactggttatcttttccaggcccatcttgaagcatgtatttgagtgactcagtatgacactggttgaagagaactgtgaagaaaagcaggctgatccagcttctccctcttactaagggcttctcgtatgacaaattaagggctctaggagaccagtgaatccgctgatgtaggaagcccattgcagtaggcaggataagacagttcaaaatgccacctttctaatatggcacgtaactactcagcagcagagtgaggaaactgcagacaactgggacaggccagacctagattattaattggagaaattctgcctttacagaggatggcacaaggactcatttgggttttcaggaagatggtgggcgctggttacgagtactctaaaaatgatttgtgaccacacatttatacaagccacctctgcatgtatccagctgagaaagcagaagctgttccctatattttcacaaatcttatgttattaataataactcaatctaatagtacttttaacttgacaaagaactgtctcatctgttcatcattataatttacttttaaaaaatcattctatctatttggtagatgagaaacctaaggtacagaaaggttagatggtttgcttaagagatcatggttagttggatagggagtttggatgaaatcatttttactgactctaaatacagcagcctctttctacttgaccttattggtattcaggaaaatggttttaaatgagtaagagtcttaactcctaactaggagttaccttggagaacaactttggtggatgaacccaagaaggcaacaataccatttctgacctggggagagcatgagaaaaactaagcttatgtgaaaaaaaaaaatcggtgcaaagaagtcacaaattctgaaataataagtgatcagaacccattgctaatacttgatttcattttatataaacaagctcttgagtggtatcagattttccatcatgtttgccgaactatcataaacaaggaagtaatgacaatggtcctaagacttgcccaagatcactcagcttgttcctggcaggtaaaggcctggtatcctggttttctaaatattagtctactttcttcccaccttagcacagaagctggatgtcttcttttaatccttattgcattcatttttaaacatctgacttaaaagtggccaaatagttagaactcggttaaaatgaaatcatattattttttactaagttaaaacacaatcttgtctcaatgcatatcttgctaaattatctcttctgtaaaattacaagctataaacacaagttgctggatcaaaaagaaaaatatctattcacctttcccccatttttcttggctttatacttaaaaaataggaaaaagtgggggtggacaggaaattgttaaaacaatcttgagcagttcagaacccttagtaatatggtaaacactcttctggcactactttatgattaatcaaaaccaattacatttcccacccaagtcttggaacagagtcacagggccccatcctaacccttggtaaaaaatcaagttgtcctatctttttataacctctatgaatcatgtcacagagaaaatgttataaacctgataagaatatgccattatttactccctgatgacatctttttttaaaaattcttatttaacaaacttctctattttcccaaaaatcaaaaatcaaagactaaagcatcttccattgttgtttgacgcccaattacattttgcttcattttattatttcgacggctaatgaatgaaagtttgcattactagccagcacatagtacagttccaccatctgtctccccaatatgattaagaaataagccaattcctccctctccctctggttcaggcttgggcagagttttgtgtgttttgtttgtttgtttattaaatagctggttgcaatttatccttaaacactcaccttaattcatgtcttctagctctccatctccttcccccacctgaaactaagaccattttttcccctaaatattggtcaagtagctgccataactaaaaatatagaaaccaaaattatacttaatgagttgtaataaattctaacgtacatcaagtgaactatttttaaaaagttaactcctaggacagccagaggaaacaaactaaatacatatatgcaaacagtatgtctcaggtaacattaggtataaatgcaggcattttattttattaaaatagattccattttttaaggtacacactatgtaatcaataaattcttattacactgtttcctctgggagaagcaaaaaccttgcttaagaagggcactaagttaaaattagggaaattgcatattaaaactaatgcatgagaagagtaacaattcaaaagcaccaaagagcaggatcagtgagccattttaactaaattctctcccagttcccaggggaccacctttgtcattgacctccttttaaaatacggaccactggggtacttgtcactggatctgtttccagtgtctcaagagctggtccgtctagacaccaaaggaagatctttctgaaagaaaatgttaaaacacagtggttttctgaactctttcatggtaagacaacacttgataatatcaaaggccttctttgtaatcagagactatggattggactttgaagacctggacttattcaataatgaaagcagtgttggaaaatatggctccaagctacattagaagctgattattccaacatgtaaatgactgtgggctttttcacatgctttccctccaaccccaacccaaaatctagccctctgttttgattaatgacactctagggactgatccaattattacaccaaattgttctttttcacccctatattcagttatttagttgagactaacttcatttttgacagaaataaaaaagaacagaaaacaagaagccactcaagaagttattctccccaactcacactgataactgatagggttcattcaattgaaggctgaaccaaattaaattttgtttttagaaaatattttaacatgtttacttgctgattaatcaaatacctacttaataatgaaattaaccatgaaattattcaatattccttaatattcttttagtcaggtgagagggtgcaagaagtgcccgccacattccctttgattcccccatgccatgaagtttgtcaagagctgctgctgaaacttgcaaattgcttttctttgtgtttcattgtatttgactcccaaacttctcactttgagaaattgtgtcgatttaagaaagggtcccaccatgactgaacttcatttaatgacaggaagaaagaggctgcagttaaattagaaagaggcagggggaatggggtccttgaagcatccctcccttaccctaggcttccctcctaggaaacctgacacaacacagccccatgtagagaacaatgctcatcttctagagccaatggcaacaaagaggaccagcatacttcccatattggctggaaaagaaggaatacttgcaataaaatactagctccctcatattggatgcctatgtagtagggttaaatatcaacacatacttcactttggatgttcaagacaaacaaaattcatttatttgtatataaccaaactagtcgttgcttgaacctccacaatatgactagcattaattactgtccaaaaccctagtttaaatcctaaccctagtctcttatgatggatttctaaaatttttaaattttttaattttaaaaattcaaaacaggtgtccatcaacatacaactatcctatgcatttcctgcagtggaatatataccagcaatcaaaaggagtaactgatgtatgcagcaacattgaagaatctcacaaactatgctaagttaaagaagccacacacaaaagacaaaatactgtatgatttcatttatacaaagttctagtataggcaaaattagtctatggtggaaaatttaagaatagcaattgccttgggtggtggcagggattgactggtaaggatataaaggaacttcctgggataagagtaatgttctgtaactctatagggatttggactgcacaggttatatgcatttgttggaattcagccaatgttacatttaagatttatgtatttcattgtatgtaaattttatcaaaaaaagagaactgtaaacacatatggaactccagttattgatatatatgtacaccttgggaatatgcctttgacttactttttttttttttttttttgagacagggtctcactctgtcacccaggctggaaggttgcagtggtgcaatctcgactcactgcaacctttgcttcccaggctcaagtgattgtccagcctcagcctccagatagctggaactaaagacacgagccctcaatgcctggctaaattttgtatttttcggagagacagggttttgccatgtttcccagactggcctcgaactcctgagcttcatgcctcagcctcccaaagtgctgggattacagtagacttactttgaaatgcatcaaaaatatttcatttcaattatttaaaaatgcatacattgaggttccatgagaataaggaactcattcaagatgatactcccagtaatagtagagctggtattggaactgtttgactccaaacttgtaatctttttctactgtgccacatcagcattcactcaaatatttaaaccaccctggcatttacttggctgggtatcaacattttctgctatactgttatcacgtggtaacatctggattgatgggttctcgttacttgcaaatgctgcacagttaagccctccgtatctgtgagttctgcatctgtggatttgaccagttgtacactgaaaatattcaggaaaaaaaaactgcacaaagttccaaaaagcaaaccttgaatttgccatgcactgagtactacattgaatccacatgaatgaagtgtaggcgtcgtattaggtattaaaagtaatcttgagatgattcaaagtatacaggatgatgtgtgtagattatatgaaaatatggtattataccattttatataagaaagctgagcatccccagattctggtatctgacgaggggtcctggaatcgatcccccatggaaactgagggatgactgtttttgcattagtcaatcttttctcccaatcagatcaaaattcttctagatccaggctttatgcacagtgatacagtagtcttcttagccatgggggatatgttccaagatccccccagtgaatgcctaaaaccctggatactacaaagctctatgtatactttccttttcctgtacatgcatgtctatgataaagtttaatgtacaaattaggcacactaagaaatcaacaataacaactaataatcaaatagaataattatgacaacacactgtaataaaagttatgtaaatgtggtctctccctctctctcaaaatatcttattgtacggtcctcaccaatttttaactggttgaacttcaggtaactaaaactgtagaaagtgaaacctcagaaaaggggaaactattgtgcattataacaactgttatttacctgttgaagcatttaagaccagctattcatggaaatatatgtcctgcccactgggtactctcaattccaccgaaatgccacagaaaacacagagccaagccttgacccgtcccttgcctaaggaaaccctcccttcatgttttcttaacactctgagctctcctcctgaggtcactgactcctccttgttgtttatgctatccataggaactatgcaaagcttagttattgggtagatatttgataaattctttgtggagtgaatgattgaacctaatggattttttacccttgttcattccctgcatctttacattttcacttcccatagacctatgtatgcatgcgactagtcagagaagtagatacagtgagaaatgccagcaagactgaaggggctatgtcttcacatgcagctaagatgcaagtccgctggtcagatgtaaaacaaaccaaatatctaactgttctttttgttacgttgaatgtctgtatgcttcaactcagctaattagctatggtgtttagaacattaccttaatgaggaaaggttctagattcaatccctaacttaccactgtcggctcctggcagactaatctctgccaagacagcccactgctctcctacttgggagagagaggataggacaattaccttaatgaagaacatattttgcattgcctcccatataatttgcttttaagtttctatttctcattctaattccattgccttcctcaacaaactatcctaccttcccattttaattgcaatgcaaagcttccctcaggtttgtgagtctaaaggaaagctgactaattttcaattccaagagcaaattgttcatgtggaaaatgttggtttagaactgggttctgcccaactgcgccacttgttttcttagaaatgagaatttcctcccttagaagctaggacatctaagcacgtaagcaggaacaatccccaggttggttgtcacttggatgctcttaacccaatctctgcttatcctcgctgcaatagttaggaacagtaaatctacagtgaacataactgaaaactgcactgaaacagaaacttactctggataaatgttggaggactggagtttcttacttctttcctagatgatatatatttttaattcagcacaaattttgcaagaataacagcactgcacagaaaccacagcactctaattcactcatgaggatgcaagagcattcataaacagatcgaaagatgctagtccaatttgaattactgcatcatattcactccagggccatctctatgtgaagagaaagtgacataaattttctcctaggcaggcttgcactgatcctgcttggggagctaactgcacggagagaggccgattgggagagggcagggaagcagagatgggcactcagagaagtcccgttttgcacatggagtagaaggaactcccctgaatgttagcaaacaaatctcaagtgtttttgctcaacagtggcagaatacaaaattgcatttatggattcatgtgtttgtagagttcacactcatccacaaagagagggggagggagaaagaatatctcacatgtgcaagtaaatgccacaaaggagaaatacacctcactggcttttacttgcctggttaacagtttgaaatcaggattgacactatatccagataatgcacaacaggtctacaaaatgggttatttccctaaatacagccaggttttaaattaatgtaataattataattatttatcaggggaaccagcctgcaatatttcaatgtaggttcttttctattttccctaagtgttggccgctctgagaaataaagagaaagagtacaaagagagaaattttacagctgggcctctgggggtgggcatcacatgtcgacaggttccatgatgcccacctgagctgcaaaaccagcaagtttttattagggatttcaaaaggggaggggtgtacgaatagggagtgggtcacagagatcacatgcttcatagggcaataaaagatcacaaggcaaacggcagagcaagatctcaaggcaagggtgaaattagaattaatgatgaggttccatgtcccactgggcacgtattgtcattgataaacctcttaacaggaaacagggtttgagagtagacaaccggtatggctagaattcgccaggctggaatttcctaaacctagcaagcctgagggcactgcaggagaccagggcatatttcaccccttatcttcaaccgcataagagagacactcccagagcagccattttagagacctccccctgggaatgcattcctttctcagggttattccttgctgggaaaataatttagcaatatttctcctattccctttctgcaagaagagaaatatgattctgttctgcccagccccgcaggcagtcagaccttatggttatctcccttgttccctgaaaatcactgttatcctgttcttttctaggatgcccagatttcatattgttcaaacacacgttttacaaacaatttttgcagttaacacaatcatcacagggtcctgaggcaacatacatcctcagcttacgaagatgatgggattaagagattaaagacaggcataggaaattataagagtattgattggggaagtgataaatgtccatgaaatcttcaaaatttatgttcagagattgccataaagacaggtgtaaaaaattattaaagtattaatttggggaactgataaatgttcatgaaatcttcacaatttatgttcttctgcctctgcttcagctggtccctccattcagggtccctgatcccgcaacaattattaatgtgattaattttattaatacatagtcaatagttaatatcatttcccatgttcagtctcatgagctcatctactcaacttcagaacctatccttgtcaaatgtgtccttaaaaaggtcttcaaaataataaaattccacaaatacatggagcattaggtctgctttttattttcttgagtaatctgaagcacaaacattctctgataccacgcaaaaaggactctgaattgccaagacagctactttaaaaataaatctattattttggggatagatctttacagcttagagttcaaatcttgggagaccttgaagacaacagatggctgaatttattattggcccccatatttatctttattggccactgtgtttaggaataatgaaaataatttatagtgaggatacaccttaaattctaattagaggccgttctcttctagaaaactaatgtaataacaacctggagcctcttttcccccatttgataaagattagtattttacaattttaccttggtgaaagaaaaataaaatatggcctggacaatcaaaatttcttctcttggctgggcatggtggctcacactagtaatcccagcactttgggaggctgaggcaggaggttcacttgagctcaggagttcaggaccagcctgagcaatatgatgaaattctgtctctacaaaaaataaaaaaaaattatctgggtgtggtggcaaaggcctgtagtcccagctacttgggaggctgaggtgggaggattgcttggactcaggaggtcgaggttgcagtgagccgagattacactactgcactccagcccgggtgacagagtgagactctgtctcaaagaaaaagaaaaacaaacagaaacaaacaaacaaacaaaaaaagatttcttctcttaatatgcaccatgcttttaaaagtttgaatctaatgttaggtatgccaaatgtagctcactttgcatttcacataagttaatatttctccacagttgtaactggctcttcatcagatggttacaatccctagaacacttactaaacaggccacatgctgtctgtcatgtttcaagatctgtatgggagtttgactcagagaaaattaagaattgaatgacttgactaaacttgattctcactggcaaactcactctaaatctgattcccattttctacatctcacacagtttttattttattttattttattttttttttgacacatgtttagtcattaaagcttggagaggtcaaactaacagtcacactggatctgaataatgtccaaagcagcacagtaagtagccggtgttaatctgttgctaatttttttgatggaggtgtaaaagaaaggcaagaaaatctaattggctgtatttgggataaaattatagtgttatattttctggacaagaagatggaacagtggcaaagagatgctttaagaatccacagtactggcccatctagccgtatggatgccaacagcacattcttcactgggcctgctatttaatttgcatgcttcttgtgacacttgttccatgatatttcagagtagcttctcttaaagaagcagatattgtaaaccacagcacatccagaaaagtcgctctaccaaatcctctttcagcctcaactcttggggccataatatggtcagtgtaacctcaggccctgtgctccctaaggggcgtaggtggagctcagcggaggccctctcaccactatgcaacttaggacagatcacatttcctgagcctcagttacctgtaaaatgaatacatcctcccagtcctacttacttcagagagatgttatgaggatgcaataagacaaaataaaaaatgctatatatgttgatacttgtttttattatggttttaaagatccaggctatctgaattgtaaaccttttggtgctgatgtgagaagggcagaaaattggcttcttggaagccccatccaatcaagttaacactttatgaaggcccctacctgctttgtctctttttgagaaagttcaaggggtaaagcacctctctccaagtttcagctagtaattggtttagagaataatctattatactagttgggataggctaggttatgctggagtaacaaccccaacctctcagtgactgacttactgaatttcttattgacataaagtctgggcaacttcgggtctgagcagcagggtagtcacttttcttccatgggtagggggtctatgtcctggtttcccaggacagttcagctcaagcttactgtcctggcaaattattaacaacacccctttcagtccaaaaatcgtcctggtttggatgataaagattataatcttcatatcaatggaatgactcaaatatttagcctgccccactctctcaatatgaagttttctctatggacaggaaaagataaactggagaatgtagtatggattttcactgcctcattcaacagctgtcacttcagtttaagggccactggccaggactagtcacatggcccaactcactgctagggtagctggtaaacttagtcttctgagtgcccagcaaagagaagagaaccagatattggtgctaatatgctgtcttctatgtgtgcattgtgaggactgaagatatatatgggactactactcagtgactggcagcccagcctcgctaacttttcaattgtgtccaggtgactcagggccgaaattcaagcagggcaagtaagtgttgctcttggtggccttttcccattgggtgttacttttttcctccgttggttgactgagctgtcactattgaggctcttctctcacctcccagctagatattgattgtcactctcctttccctcatgccaaattgatcgccagcctacacaattactttccctgagatctctgaattgtccacatatgcattccctctggtccggaaatcttcagacagacaccttcaaagtctgttttgctttgaaaaatacactatcaagccttcagtaagacagttaatagacatgtttttgatgcaggctattttatagcaaatatctataaacatggaaaagcagcctgtacttgcaaaaaactttataaccttccaagattcactggcaaggaaaatggaagaggtgatttctgtcctggtttcttgtagtgttggtaaaaggatacttctaatgtttcactacttttacccaatatttattgtttaaaatacgcaacttaagacacctcaacaagtagcatgcttgatctttaggaacactggagtatgaaagtctgtctagatatttaataggtcaaactaaaaactgggggaaaaaaagtcaatttaaaaggctgcctctatgttagattgaaaacaaaacaaaacaaaacaaaaatgaaccctgagagtaatataatttacactggggtctcatgaatgtggattttgccaatcatcaaaatcatctggtatttggatagaaatttttctgccagcagctatgagaaaaatgagattccttctcttctccccttgcctatccaaacatcatgcatcctccaggttccagcttaagtcccatctcctgtattcctgacaattgtggcccactggagtgtctccttagtcctgaaatatgttttccctggaacatttgcaggaagacactgaggactcttgctaaaagtctagattcctaggtctacttgagacctagtaaatccaaatatctgagagtagaggccaggaatctgtgttttaaataagaatattcttggacatgaactatgagaaactccattctaatgttctcctaacttattcatagactaccctggcatggttacatacgaacaaaatgatttcatgtatgggtttcttagttaacaactattctataagctcattagggactcttatgcatatctcaagttttttcctactacccacatcgcacagttggttaactgtttatcttgtgtagatggaaattccctaaattaaggagctatatattgatttacctcatttgaggcgtattagatgctgaaaaataaaaggaaaagatgaatctaattttacttccaatgctggaaagcttaaaaataacaccttatgtaatatgaataattgtttcctgatgtattcattcattcatgtatcccctcatccatttatctgttcctctatttgataatcatctgttgaatgcctatgataggctttgtgtggtaatgagtaacttgaatgaagaaaaactgccaactgtaggagacgggcagacccacaatgaccccacaatgtattaatgtattaagagccagaagaggatgccaggggcatgaagagagttgagcatcaacagaggctctctgggccgggcgcagtggctcaagcctgtaatcctagcactttgggaggccgaggtgggtggatcgtgaggtcaggagttcgagaccatcctggccaacatggtgaaaccctgtctctattaaaaatacaaaaaaaattagcagggcgtggtggcgggtgcctgtagtcccagctactcaggaggctgaggcaggagaatggcgtgaacccgggaggcagagcttgcagtgagccgagatggtgccactgcactccagcctgggggacagagccagattctgtctcaaaaaaaaaaaataaataaataaaaaaaacaaacagaggctctctggagatgctgatgtactgaagttttgaaaaataagttggacttagcttgatggaaagggaattttcaaacataactaatgatcttattcgcaaattttaaattgcttattatgattttcttcataagaaatatgctttaggtatgtgtaaaatagtctctctctactgaaagtaagagcgcttcattttagtttggtatacatgctggcattttaatcaaacacaaagcattatagatcattgtcagcccacctacttaaggttcttccaatggaattacatgcacttaaagttatgttcactgctacatacatcctacatctcaatatcaaccaggcctcaagataatgctcctccaatgtgtacatatgcatatttgcagcccctgtctcattataatccatgtatttgtgcatgtattcccaacatttttgggtgctcaggtttcctttagtgtttggaatatgttcttcttgaccttggatgtctataaggatataaagaataaccacatcagaatatctgttgctaagaaagaactgctatgataaaaccaataccaataaccacaacattccccaaccacaagattgacattaaacaatagtcaagtgtcttcaagtattttttatcatggaatacaagcttttatacagcacttttattgtacattcctgattaatgaaaaggattttggaaatacattaactttaggccaaaatagtgtccatttattcttaaattgtcaatggtacaaaaaagaaaaaagcaaggatacttgaggggaaagggcagagaatctatatactgaaactaatttttaaaaaaatgtctttgatatttaaaagcaatagaaaaagaagcacaattctcagataatagtataaaataaaaaataaggaaaattaagcattgataaacaccaaattcccaagtgataggatttttaagatgtaaagaatgagtgataatatactacattgattaagctgctacagaataccatgacactatgcacagatacacacaacattattttctatcttaaagctgtgctgcgggatttttagatccaggattgtaagtttttccccccatctcactacacaaacatgagaaactgtgcagacctttgctttctttccatccacagaattttactgtaatattgataaagacaatagtacctacgctatacagatgttaaaaatcaagtaataagcaagataacctgattccagttatcactgcctccctcaaaacaaaggactgcgctgaaagaagagcagatttaattgtaaagtgcaaagacttgccccagattggaaaagagagggaaagggcctgttttgcagcaaccagttagaacacggtcccctaggacttaattatctatatcttgttaggctataataggggcttaaaatgatattgcaggttttctgcaaccaagaaactgattagtgaagttgagtaaatcaattgtcaatcttcttatgagtgaacatggacagcaaccccagacttcaatagagagccttcattatcacacagcagttaataagcatggctatttgaagcacatcaatacagaagaaggagcttgtatccacatcaactggcagtgtgtttggtgttgctcatttcctgattttcagtttggacagaagggatgattatcattctgtgaaccacgttgctgatctccttgctttgacaccatactcttcaggggaattcaatatgttcctgattatctcaatttcaaagccaattagaatatttacagatgcggaggcccctgagccctcttttgcatggctattgctggaccccttgcttccattctctcttttctcttctggacctctgctttcatcctgccctcttcatagctgtttttatctctccaccggatcttctttatcagatggcaagcaagtaaatttatcctaatggatgcctcctttgtctcctttctcccgttgcaatctattcctcttttctcccttctccccactacctgttataaaaaggaatttatatgttctgctttcacgtttttcctcaacaaatgaacctcaacaactaacttcaatctgactttcccctgatcactatacttacagtggtttattattttatttgttgagacagagtcttgctctgtcacccaggctggagggcagtggtgctatctcggctcactgcaagctctgcctcccaggttcccgccattatcctgcctcagcctccctagcagctgggactacaggtgcacgccgccatgcctggctaagtttttgtatttttagtagggacgggggtttcaccgtgttagccaggatggtctcgatctcctgacctcatgatctgcccgcctcggcctcccaaagtgctgggattacaggcgtgtcagagtggtttcttatcatcaatgggcctgaagtcctccccttcaatggctttttctgcatctttctggttatgtatgtgcctgcactggccaccccttccctcctgaagttttgctctcccttgcctccatgactgccttctccagagtcttctccttcctatctcagttcctacttccctcttccatcaactacagatggccacacccctgtttaggatctcagtcttctgtttgccctatctgctcattctgtctctcaaatcatttactgccccctttccttcagatttccaaacctaaatctccaagcctacacctgtctttcccattacctactgggcatactcaacatgggccccaccagcaccttgctctcagcacatctacaggtgccagtcaccatatctcacacaggctctctgccttctctcgtctttcttatgaaatctggtactgtctgccagccctgggcagcattctcaccccttattatgctttccctggtggttcaggagtataaagcctgggaactgcattttctgactccactgtctacattcaggaactgttaataaggtgcaccagcagggttttgaaagctgaaaacaggtgacatttttcttcctctgccaacagtggtgggattagcgtgtgctttggcaacattaggttttggcacagctggctggactctgcaccctcctttttgtcagcaggctgcagggctgctgggctgttgtgacactcacagcagctccacacattttccacctttggtagtgtattagtccgttttcacactggtgataaagacatgagactgggcaatttacaaaagataaacatttattggacttacagttccacatggctggggagacctcacaatcatggtggaaggtgaaaggcacgtttcacatgaatggcagcaggcaaagggagagagcttgtgcagggaaattcccatttttaaaaccaccagatctcatgagactcattaaccatcatgagaacagcgcaggaaagacctgactccacaattcaatgacctcttactgggttcctcccatgacacatggaaattgtgagagttacaattcgagatgagatttgggtgggaatacagccaaaccatatcaggtagcatcagcaagctcctaattcagggaccacagctcagcctgaacttgacagccattagaggccctctggacttttgctccttgaaccctttttttgtgtgtgtgtaggcacctacatcctggtttacatccttctgtgttggaagtgtcttcacaggtctctattttcctgactgacaatgataccaccccagtcacaggatgaatggcctggagcatcttttcaactgctttctctttcccatcaaaatcccaactcttcccaagcactgccaattccttccaatcaacagcttcctctttccttgaccaatgcctctatttcctgtccttgaactgctcttaaagtcttctaacctgtttccctgactagtgagtcactccatcatcctcacccaatagcaggtccatctcttcaaacaacaatttttatcatttcaattatttgattgaaaaccttccatggacccatccttactgtccgcaagacaaagactgaaccacacagcaaggcatttgaaacacatacttattcctatgcccttatgtctccctgttcttcctcatgtactatatgtgcagatagccatggatacttgggattcattcttaaaatatatgcctttgctttcctgcctccagatctacttctcattttccctcgtagaatgtgactcccatccaccaccagtgaagctattcaaattctgcaagaattagtccaaaagccactagaaatctccatctccaaatggattcctgctgcattttaaaacctaatctatatgattcatcccattctcagttttgcacctcaacaggtgtgttgtcccttatggcacaatacaggtaccacttaacttttagttgaattatactgtctatgctgggcttgattttttggtttatcaaactttgaacaccaggaaaaacattagatcaagttcacttaccatgtttgtaatccaaactaaaacttaaccttactgagatctgggtgctgtggtcttatcacaatttcagccttacgttttcaatattaaatgatgtactccagtgaactgcccaagcctctttggcaaatggcggttttatagagactactgcttgaaatcagtggatcatgagatgataaacgttcccatgtataatgttttccattgaaagactttctaatttataagcaagatctaagattctaaatgggtaaatacataaagttgattcacatagaattgctgatatttgatcacaattgacctataaaaatgacagttttatatggttcaacctaataaacacattaaagtaaattttgatgcgtagtatttgttttcacagcagggctcactttatctaataaagcacaatgaacacatacactttataacagataagccagatggtaaaaggctttaataatgacagcagtaatcatgattaatattcattgagcacttgccatataccaaccatcatggtaagaatgctacataaattatctctttttttttcttatcacagctcaattttaatcaccatttgatacatgaagaaatgtgctgcttaaagtggccaagtaatttgtccaaagtcatataggtactaatcggtgaaagaatttgaaataaagaagacctcttcaagagttgtcatttttgaccagataaaagaaccgaactcttttttttttctcctggagacattctgacttttcattttttggtccctatactaggaggaaggatgaagaataaatataactcatggaagagctcaaatcccaactcctccacaaagccttccttgatcacacggctctgatccctctgttcattgtactactccatggtcatgaacatgtctgaattttccaaataatgataaagcttcatcagggtagtgagcatgttgaatgtgcatcatctcctggagcaaggagtggacattgtatttccatccaaacacaatccattcattcgcccactaattattgagtcttaacattgttgggtgcaaacaatcctgagatacaagacccagtctctactcaaaaggaacttactactgcttaatgaggagatgaacaagtgtgtcgacacaatagcatgcagtaagtaccatgaaagaggtagctagactgtgctgagaggagagatgtgggccacctggaagtgggagggcaggggatttacagagcttttccagaactgaaactgttgtggtgaagcctggaaaggtaagaagtcctcgccaatggaaggacttaagaaaaggctgtccaacaaaaacagcaggtacaaaggcacaaaaaagcctgcaatgtttgggtggctgtgagtactggcatggctctaggacatgaacaaaaaaaattagaaaggtgggagagagaaaagaaataggaaggagaaataaagaaagaaggaagagagcaaatttgctcttgaatttagcaaaattcagatgacagtaaaataagtagccccatgctccgcagtaaaaccaaataaaatccgagctactgtccggtggccagatcaatgccaatgaccctgaggcccaggcctacacacaaaagagcttggtgtgtgagagcacatgaagtctgacgatttataacagattttgcaaatggttggtaatacagtgacagtggcacaaaaaaaggtgatgaaaatagagaagtttctatttctacctgttttgataatagcggctctttagctgaacagatggtgcatttcaccaaaatctgatggaaacaaatctttacaggccttccgtgttaagaaataatttcatagccttcccaagagatttggaatgttctttgtctaaataaatataatacaaagaaaatggtcttttggaatccgtaattaaatagtgttaatgctatagaagaaagcgcggtctgacggctatctaaaatgaatcataataaaatgagagaaggttttccaagtctggacatgttcctagcaacattcagtgtaaggaaggatttcattatgtttcttttaaaaagtttgtgtctgaaaggttccagaaaggatagctgagtctggccaatagaacagagctaatggccacagccaaggtgatcaacctcaccaagaagatgtcagctttcctcactaaaaaaaaaatgtattttgatggggaattaatagatgtggcaatgcaatatttatggattgccactcaaatgaaaacaccttttaatatgtaactgagacacataacaaatttataatgccttctacatttcaaaatttgcattgaataatggtaaagggcaaggaaactagcccattgttaactgattgataggcagtgtgaaatgtgttcaatatttatatcctttccacaccaaccttctatttttatttatatgatcatttcctgacaaacataatatgaacgatgtctgcagaatttttattaacaaagtgcaaagacaatacctctgtgtctatacaaaaccatctgctaatgtctcatgtcaaaacctatttatgttattttctttgttcttcctatgttttctgaaggcaactatttgccattaaattaatcctgtccaccttcgaggcatttatgcattcttctggcatttcacattctttgggaaacccttgggtatgcagatttcattacaaaaattcttaaaacaaagcagggtcagggtttagaagtataatatacctttcctttcctaatgtagaaccagaaggctatgcacaaatacagtatttcattttgcaattaagttcaggtgaattattcaaaacttcaaaatgtgaaatatgccatgattatcattattcaaacccctgtaattctccaatatttttgaatggaaacatggctgaaggtgcccgattagtaatgaaaaaacaatggtatagcattcttgcctgtagattctgaaaaaaaaaaattgaacactttaaatcttcctctctttactagactgtacattcattcaattgacaaatcctcatgcatgccttgggacttttctgtaaggcaagttcttccccgcccccccactgtttccttctctccccagtctccccaaacacatgaaagcagtaacacaaaagagatttccctggactgaaatggaggccccagaacatactttataatcaagatcatactttgcaatgggcaacacttctcccctgctacttaatttcttggggttatacaagatggtaaaaaacgaaagagcagcaaatcacagctcttaatggagggcaagcaagggcaaggtgaagagtcttttccaatcttcctcagtctctatctcaagaccatactgccccaggaagctcttattgaccttgcaggtcttgatctttttcatcctagcaacccctcaagaagtgatttgtgctctgtaacactattttatcactcacattgttgtctcccatagctttcctcaaatgtcctggggtgcctattctgtctatatcccaacccaaacagaatggtggtcaacccaccatgcaacctgggcggtgcaggggttctatgcaatgagcgcctagcaatcgggttgtcttaggaagccacgtagaagaggcctgagttcttgagggcacactgccttgtttttcttttggtttaaagttatgacccaccagaatactgacatactgtctactaaggagttaccctccccaagagacaatgattatttgcataaggatttcaacagagaagtagaagtgcaaagtagttaggacaaatagctctggttcagacagtctgggtttaagtcttctacttaaactagatttaatatctactacttagatttcatagccctgtgcctcagtgttctgactcctagaacagggtaagagtacttaacacattcttaaggtggtatgaagatgacatgagttaaaaggacttagaacacctagaactgtgcacagcaagtgctcttattgcctaagtgctccagaaatgtatttatcatttgtttggggatccacaacaattagcaggagaccttgaaatacaggccactaaggcttttatgcagtttgcttttggcagatactcagaggcaggaggaacaccaatcttttgccacagtaattctagggaaattttatctcaaaaagaagccagttcacggtcagcatgatataaagtcacagaacatgcctagaaggtgtgccaagtggagggtgcctaaaagactttctaccctttagccttgttgctatttaaaagtcaaccattagaggttcatttctctagctttaagttcttgcttactaaaatgcaatgactcttggatggaaaccatattaatgaagaaacaggcccaactatgggaatgaagacaaccctgaagtagattcctaattcttctacttttctactgtgtcctatgataccgtggatttcacttccttaaacttctgttttagcaactgtaaactaggaataacttactaagttgctatacggagtggcaattacagaaaactacatagcacagtgcctgggagataggaggcactcaatacgttgcagctctttttttgttattatcattcaactcactggggagtttatcagatttttcttaagcgaaaattaatcaatagggtattttgataagggataaagagaagcaaagaggagggcactggtcagtggtggggagaattggggcaggggaaggaaggaaaagtggggaatgataaaatggaagcaaacttcacctgctttgaatgtcagggcctggcctgcagaggactctgtctctcctgtcatactgttttacaccttaattaaagttccttaattaagaacagggaaacagtccttcacatatttatctctgaactctgattattccttgaacttgtatcccaagaaaaggggatgaagccacataagatttggcagctggcattttcattttccccttattgccatttgaacactagacctaagagtgcattggatgtatctaatcatattagaaaagtggagaaaataacccaaaccaaacctaagagaaggaaccttaagatttgaaaatgcagctaactatagataaaaatcataatggaggattaaaatttaacttcctctgagacaggcaataattattgttaaaaacaagctcacttatatcctctggtttacccttccttagtgaaatctgacaaggcctgtgtgggtcggagcctgcacactgctatgggagagcactggggcagctgcctgccttctcctccaggcggtcactcaccagccatgtggcactggccagttgttacctccacacacttcagtttcctcatcagtaaaatgtgcttgtcagaaaatagttactaaataaatgtcaaatccaagctaattataactgaagtcatttatgaattcaatatttattatgcatctgccacatattaagtgctgctgtagacattggagccaccaaagacgacatcatgggaatccatctttgttcagctaaagacaggaaggttgctaaggaacacagcataaagaacattcaaatgataagctgtagaatttggacttggaccctactgctagatgagaaacaatgagggtttacctaacaaaagaggtgtttgaaaagctgagtcctatggtggtcagctgcaggcaaggcaccaccacttagtccagataagggatgagcaggacccagactagggcagaaaacagaagaggagaataaaagacatgcataaaagatatgttttcaggagtcaacaggacttagaggcaagtacatgaatgcatgaagacaaggaaagccagaagaaactttggggttcaggggaagtggtttcacagtagcatccacagaggaacttcaagaagagatgctggttggggcacaggataatgtgtcttttgtttttaaatttcatttcatcctattaaagcattctgtcctttaaggactaaaaatccgggagaatagaacttgttcaaaataaatacactgtggtgagctgcgtgcaataacgcacaagacacaggctaggaggaaggcggctgtggtaaataattctaccctaccacatcagggacatcctcacaacacaaggtaaaatctaagtgggattgtgaaaggtggagaagcaatcaccaaacggacaaggggagggagactagtccagggacagggaagaataagagcggagcccatggagtggaaggtgtcagggaaatgcctccaggcaccaggacggacaatgtcagcagttacctacttgtggtaatgacacaaatgccaaaataacctccctctctgcccgggaacacacactaaccctccattcagcacaccccctcaggaagacctggcgaaatgaaaactgtagactggcctttttttatttatgttaggggaaacagattatttagccatgacagaagcaaatagtttccatgcactatgcattttaacatttcagaaagcagtacccttagaggaaaagcaggttacggcatgcagagattatattggaaagaagcatagacatattcaatgcctagagagctgggtcccccaggaaggagcgaatctggggatcagtaggaggaaattggatacagtgggcctggagggaagggaggcccagaaatgaacaaaggggtccttagcagggggagtggaatgggaaaaaatagatattcttccacttcaaatttttcctggggctgaatatatgttagaatgcttatatctaaagccttgaagaaaaagtttctaatatatctctgtgaatgatgtgtgtgcatatacacatataagtgcatacacatctactcacatatgtgtcagtaagtgtgtatacacaggcacacatgcacatgatgcttaatccagggatatgtttgctattgtgtaaactctagtttttttattgttgtttgttgttttttcagagacagagtcttgctctgtcgcccaggcgggagtgcagtggctcagtctcagttcactacacctctgcctcctgggttcaagtaattcttgtgcctcagcctcccaagtagctgggattacaggtacatgccaccacgcctggctaattttttgtattttagtagagacgaggttttgccactttgcccaggctgttcttgaactcctgagctcaggaaatccaccctcctccacctcccaaagtgctgggattacaggagtgaggcaccatacccagcctaaactctagttcttaagcaagggaatggacaatggtatgtacacttctgagatgatcccaagggatcattatgatatattttctcctttggcagaggccggacctagcatctggcttcagccaacagaaaacagcacacttgatgggatgtcacttcggtagttacatgaggaaagagtgtgacttccatcttactagtgttggggctaagaacacgtcacctcaaaatatgactgtaggagactaggatatactagccccaaatatattcctctgacatattttgagctggttattctgagaaaatgcagacacaggagtagctctgaaaacctctccttttgtaaaagaaattgacatctacaaaggaaatcttcattagtagaagtatttgtatcaggaagaaggctgctcattatagaactttcattacttgagagcaggaaatgccattccaaaatatgctgctttgaaatgctgattacttcaaactgagggcacctaggaagggaaggtgcagggaggggctgtctctgggctcccctttatctgcctaaagatggatcctccaggggcggctcagctgtcatgaatctcctctctgggaatcttatcaagtagggaggtctgactcatcacagagaaaaccagagttggacacaatgtccaatcacctgttcttcggagtgtccattcctcttttccagaatcaattactcccctgtaagctgcctaaatgcccctcctctatcccctcggaagatggtaatatgcttctagatctcactgggtttggggatattcacttttccttcctttgatgccctatgcatgtaataaatgtgtccaccttttctcctactcatctgtcttacatcaatttaatttgtagctcagccaaagaaccaagaaggatgaagggaagccatcttcctcgcccctacactagcaaactctgtattaccttctctgctggctcactttgatgaggcaaactgccacgttggagaggcccatgtggcattgaactaagagctgcaactggccattagggagtgaatcccaccaacagcaaatgagcttggaagccagtccttctccagtggagcctcgaggtgactcccatcgcagcccacaccttcagctaagcctctgagaaatcctgaagcagaggacacagcttacccatgcctggatcccagatgcacagagattgagacaatcaatgtgtgttttgtttgagggtaaagatttgaggtaatttgtcacaggacaagagacaactagtacaagcaccaagtgttaaacagcttctctccattcaaacttttaagttttctccatattaatgttcaccagcactttttcatactgtctcttagacctgtgaatattttttcatattattttaacatatacatatatttgttctattataatgttcttacatttcttcatcctgcttctgtttctcctttaagtaaagcttggttgcaaattatctttattgattttttataattgtacatttattttagatttagggggtacatgtacagatttgttacatgggtatattgcataaagctgagatttggggtatgaatcccatcacccaggtactgagcgtattacccaatgggtagtttttcagcccatgcctctccctcccttccacgtctagtagtttccagggtctattattcctatctttgtgtccatgtatacgtagtgcttagctcctacttgtaagtgagaatatgcaatattcgattttctgttcctgccttaatttgcttaggataatgacctccagctgcatccacgctgctgcagaggacatgatttcattctttgttatgggtgtgtagtattccatggtatatatgtaccacatttttaaaattaaatccaccattgatgggtagctacgttgatttcatgtctttgctattgtgaatattgctgtgaaaatcatcttatttataatcagcaaggaacttattccctatcagtccttacacccaggactggctctcctgcatatattcaatatatagcctttgcatttgagatatgtatgtatgtcttaactccttctcactgacatgaatgtaaactatataaaaacattaaatagacctaaccataaagtataaacatctatgacccaaatagaattgtgtgtacttcacagttcttcaatgcatattgggattaagtttgcagatatagtacaagctcttccaaagaaaattcaaaggatactcaaaactatctcacaaaaaagaagttaatgtcatcacctactgtatatatttgaaataaataagttgcatgaaaacaaactgtacacagacacatattttagtagactataagctaagaatgacaactatcagacctttacaagatatcaaatgagaataattcaaagaaaagttttactcatatcttacatagcactaaaatgtaatactcattatgcaatcaaattatgaatctgaataagcaaacataaactatggcattttatttaattctgaaaatttagagttaacatatctttcattaaagataaaacatttttaaaagatgttcaaaacctcatttacttgtatttagtacactaaatgtaggagaaagttatacacttattttaaacaattataatttccccatattgaaaacaacagctgtggaagaaagtaattaacatgatttactatataatcattctatcattatatgctatttggaaatatagaagcaaaactgagtagctttctagcttgcgctcataaagaaacctgttttctcaatcttctcctcttatttatcaactttatatgaataacagttttgttaatttaggagagaacattttatgatatgtttccttggatttgggaactcagtcccagctgcctagcatgtgtggctagagccacacaccatgttgcaaagagacccaccacacatcttccaggagtgataatgcatttgactatatgccatatagaaaatatgatgatggatctgaaaagataaccaagtcgtatagttgtctactatttttgactatgcttttaggtgttttgaaaagaatgataataccagatgaattagtccaattaccaccctagagaaacggacaaagaaaatgtgcttcctctcttcactttaccatccttattaccatccaattttctccaacttattcctcctactatcttttgtggttgaagtatgatgttgcaagaagatttaaaactaggcaacaatccaaaactttttcctacattggggaaaatgatttccagtacctagatctctaaacatgactaaatgctagttgatacatacaatgtaaagctactaatcagtcagcatatgtttatttgctttattttggcttcggagaaagaaaaagcttctactttgcatgcttccaggaagagaaaactacgatcatgtcattcaatgaaagttagctcactgatggaaagtacaggtgtaggggctggtgaataaagtattaccgcttatttctgagtggattaagcatctgtgagaggtgtgaaaaattgtcaaaagttactgttgggtgctgtgggtagaagtgagttttagaggagagcctgacactttgttaattatggcatcaacactccactaaatgttagcaaggagcagacctagagaaagacaagaccaagaggagtgaattcagaactttccaaataactatagcctgggattagtgaacagattatttctagcacagattttagtgatatttctatctgagccacaaaagattcaagttcattcttaagctccagggattgtagtcatgatgagactgcccagaaagggtagaacatattattttaaaaaatttttaagatccacagtacatgtgcatcatgtgcagatttgttacataggtaaatttgtgccatggtggtttgctgcacttatcaacccatcacctaggtattaagcccagcatgcattacctatttttcctgatgttctccctccccctctcctccgacaggccccaagcctctgttgtttcttggctttttaatacctgctattctgactggtgtgagatggtatctcattgtgattttgatttgcatttctctaatgatcagtgatgttaagctttttttcatgtttgttggatgccataaatatttacttttgagaagtgtctgttcatgtattttgcccactttttaatggtttgtggtttttttcttctaaatttgtttaggttccttgtagactctggatattagacttttgttagatggatagattgcaaaaattttctcccattctgtaggttgtttgatgataggttcttttgctgagtagcacatattcttaacatggtcatctaaagtcacagtcaactaaatctgttctagtgtttttttttttttttaagaacacagtcaaggatcattgtggattcactctcaggaaacttccctggccttaagaataagaagaagcattccagaaggaaatcataatgaaaaatgttcaagaattcagaaaatcaggcacctttcaacataagcaacattttgctgctattctgaacaaaccataaagacttattgggaggaaaagatgtgaccttcatttaaactggctttattagatttcccttctaggcccaggcatatttagtcaaaggagagcttggatcagagactgaactgtttttgagaaagtctgtgcgctgaagccttgcagggaactatccttggtgctggcctcgaattccttctgccaacacctctcttacatgctaatttgatcctaatctttctatagacaaagttcctatcactgtggtccattgtgctcattgagatacacttctcgcttgatgaatatttttagctatggtccagccaggattcagcgagacctctagcatcacatgcaactcaatgctagcctgtctcttctgtcctgctctattcctgtctatgtcacccaggatacccaccagggcagttcattccaatgcgcccttacaaagtgctgtgagtcatgctgttgagaagggtgagagactcacttccaagggagtaaatgcatcagggagggcaagacattctgcaactggctactgtagctatcctttcaagtaataatggcgtctccctgtacctacttcccccatgacctggtaaccattaatatgactatgacaagaaaacatgacaagcgtcaaggtctgatggttctaacgcagacaggtcagttcatacacatcaccccagcatgtaacacccatgaaccatatgacaaataccctcgtctcttcttttcacttagtgtagctcctaatttaaaggattatagattatatgtcactaaacaatttattggtacctatattccaaaccccattttaagtgctttgcatgtattaactcatataattttcaagataataatttctatgtgtagttatcatacttctccccaataattagatgaagcacgtgagacaggcaggtcaagtgactagctcaaggtcacacagagtgtaagtggtagagctggaatacaaactcaggcaatttggctccagcatccattatccaaactgcttcatgacactaagggtatatagggagttgtaaaggggactcctgtctcagaggggaggctggactagaactgttaggttccttccagtttgaaacttctgtgattccaagaagaaacatatttttcttatacaaatgatcttttccaacaatgcatattatatgctaacatacaatttataaaattataattcatttagaaattatttttggctcaattgctcaggtattcaatttttgcagtgttgcatatgtttatataataatatttgcatagtatcactttgagtttctacttgcatgttaaatttttaaatctcataataaaattcctagagggaattatttaacatacctctgaacatgttttctcatggacccagaaaagttaatataaattcaaaatccaaaacgttttgagcatcgacaagatatgcaaaggaaatgctcattggagtattttgtatttcagatttttggatttggaatgctcaaccagtaagtacaatgcaaatattccaaaatctgagaaaatctgaaatttgaaatacttctgtttccaagcattctgaataagggatacttatcttgtattactgtccttaacatttttttattcttagaggaataaaaaataagatatttcaagtacatggattttccagataaattattagctgcccattcaatcaagcaaacttaaaaagtgtggaaattactttccagaaatgaagcatattcttttaagtcttcttggtatgacctgaagataattttacttttccatgatcatttagaataatcactataactatcaatgctgagcatatatcataaatttcctgtccctttccttaatgtcacttgtatgccactgttattgccataggtacctctaagagtaatttatatccatacaatactcctcttgctgcattgctatgaatttagaaaccttataaccaagttggttagcaatgtaaaacaaggtaggagtacactatttataagtgagaaccacagtcctcaaaaagtaaagcacttgcaatttagtacatggatcctaaggcaactgctttaacaacaaaacctttttaatttctttttagattttgatatagtttagatatgtgtccctacccaaatctcatggtgaattttaattccaaatgttggaggtagggcctggtgggaggtaactggatcacggtgatgaatttctcatggatggcttagcataatcttcttggtgctgcttagcacaatcctcttggtgctgttctcatgacagtaagcaagttctcatgagatctggtcctttaaaagtgtgtggcaccttcccctcgctctcttgttcctggtttcaccatgtgatgtgcctgctccccctttgccttccgccatgattggaagcttcctgaggcctccccagaagcagatgccactatgcttcctatacagcctgcagaactgtgggccaattaaactttttttatttataaattaccaagtctatagtatttcttcataggaatgcaagaatggcctaatacaggttctcggctatgtcctagggaattgaggtcatgacagatgagtgactctcccatacattttacagcaacataggcagttgtaatttttactacagcaatgaggcagataggtatcttatgtcagatgctgtggtaagtatatcactgtggtaagtaagtatattatgacattttcttttgccacaattttctgaggtaggcattactgtccccatttgtagacaatcagatcacagagttaaagtaacttgccccagaccaatcaaaccttgatagaggcaaaattcaaacccaggtccctctcacccagcgtaccactacatggggagcagggggaggttcatttaaggaagaaaaaggggttgctagataacaccattgtggatccaatctagcttgtataagtctttcaaaaatggttcatatttaaaagtagacatgacatctagggtgctatgatcggacacctgcaatcagtcaatatttcctgaaaatctattacatggatttttataagtatctattacaagggatttcccagtcccctgaaatgagcgctacttgccacatgtaatggtataggctaacaattatccccaggcatatcaggctgtgctaggggacacaaaaaagaaaaggaaattggggcagtgaacatcagtggtgccagaagatgctccctgactattcactctcatttattttcctgctccaaacaagctataatcgattttggaaacccattggacaaaaagaaatgtttacaaggatttttctggttatatagctaactcctttagaaaagaaaatatccctcaggccctggtaagattggctgcccaaatcaagaaaatcctctcagttactacgcagctgtcagtgcaaacaggcacttgtagaagctgttggtcaaaaccccctccgacacagaaacagtgtttcagaaatgcctctctagtttacacatgtagaaatgccgtcactggtatagattcggtttcagggaagaaaataagaagtttaatcactgagaaatttcccatcaaatcacagaatcagaaaattaactgtgagatgggaatgaccttgggggtcacaggggccatctcatgatgaagtattctggggaggcacctgttcttagggtgatggatgggcacctcacactcagtgcctgcaagggctgggcaaggaaagcaagttgagggacaggccaagggagcagcccagccgccgtgtttgtctctatctgaccacgcctgctgggcaccatggtgagcctgtgtcgaaaggtctctcagttctcagaagaaggtgtaaatccgaactttatagatatctccatatttttaaatggtggaaaggatctgggggctgcatgaggaccccaggatgaaagcttcacctctgattggaaaaacaagtgactcaaggtaagtacaaagcattctgactggtcatttggatgaagctaggttgacatgtggaaatcttaagacataaaaactaagttattgcaaatattattttttatcataaatagcggatacacaggcacaaagtgaggcttggggattatctcagttcaggctgctgtaggggaataccatagactgggtggctaaagcaacagaaatttattctctcacagttctagaggccagaagtccaaaatcaaggtgtcagtagggccatattccctccaatgcagcgggaacctatcccttgtctcctgcagcttctggtggctgctgccttccttggcttgtggctgcatctctctctctctctcacatcttcacattgcatcctcctctatgaattctgtgagaggatatatgcattaagggaccatctggataactcaagataaactcctcctttaagatcaataatcagagtaagatggtggaatacaaggctttgccgattgttccccctacaaggacaccaagttaacaacttcatatacagaaaaaaaaaacaccttcataagtaccaaaaatcaggggagtattcacagtacctgattgtaacttcatattgctgaaagaggcactgaagagatttttttaaaaatcctgaatcactgacaccatccctcccctacccccagcagcagcagaggcatggtgccaatagcatctcttggtgctgggggagggagaacacagtgattgtgaagcatcaaattcagtgctatcttgatagagcagaaaggaaaaccggaccaaactcagctgctgcccactctgagagggagcatttaaaccagcctcagccagaggggaatcacagatcccagctgttggaacttgagtgcctgcaaaccttgccactgagggccacattgctccatgtctccgagtaaacttgaaaggcagtctgggccataaggattgcaacttttaggtgagtcctggtgctgaactaggcccacagacagtggtctgctggcgggtgggtggggcatgtgactttctgagataccagctggggcagccaagggagtgctggcatcacccctcccctaccccagctgcacagctcacagctacaaaagacaccccttccttctacttgaggagaggagagggaagagtagggaggactttgtcttgcatattggataccggctgagccacagcaggatacggcactggtcagagtcatgaggccccacttcaggacctagttcccagaccacatatctagaaacactctgggccaggaaggatcccactgccttgaagaaaaggacccagtcttggcagcattcctcatttgttaactgaaaagtccctgggtcctgaataaccagcagtgatgcccaggtactatgtaggtaaggaccttggtgagcctctgagacttgctgacttcaggagaaactcagtaccttaccagctgtggtggcaaaggggcaaaactccttctgcttgagaaaagcagaaggaaaagtaaaaagggctttgtcttgtaccttaggcaccagcacagccacaggggagaaaagcaccaagcaggctcttgggtttcccagttttaggacttgactcttggatgacatgtttggaccttcccagagggaagggcaatgccctgaagggtaagtcccaggccaggcagcatttaccagaagttgacctaagaaaccttgggccttaagggaacatttgctagtttggcagtactcctcatggcttgggatggcagtgggtatgggtgaggctcctatggatttggaaagaagagggaggaatgagaaggactaggtcttgtggtctgagtgccagctcagccacagtacaatagaacaccaggtagacttctaaggtttctgattctagtccctgactcccagatggcacttatggacccacctaggggcctgggggacctcaccaccctgcagggaaaaacacaggcctggatggctttgccacctgcttattgtagagccccaagggctttgagaagatacaggaagtagccagggagtggttacagcaggtctcgggcgagacccagtgctgtactggcttcaggtctatatgagtctgttctcacagtgctataaaaaaacctgagactgggtaatttatgaagaaaggaggtttaattgactcacagttctgcaggttgtacagaaagcatggttggggaggcctcaggaaacttacaatcatggtagaaaggcaaaggggaagcaagcaccttcttcacatggtgtaccagtggggagagacagagcaagcgaagggggaagtgctacacgtttttaaacaaccagatctcatgagaactcactatcatgagaagagcaaggggaaaatctgcctccatgatccaatcacttcccaccagctcctcccacaacattggcaattacgattagatatgagatttggttgaagacacagagccaaacaatatcaaagtctaacctgcacagtcttagtggtggtggccactgaggtgtgctggtatcactccactcccagctttaggtggctcagaatagagagagatactttgtatgtttaggagaaagtaagggaagagaacaagagactctgcctggtaatacagagaattttcctgggtcttaattaagaccatcaaggtggtacctctatgagtctgcaagaaccacagtgtaactgggcttggggtgcccccaaaggaagatacagcttagatcacaacaccgaagtcctttcaaatatcaggcaagccttccctataaggatgactacaaataagcccagacagtaaagactagaatgaatacctaactcttcaatgctcagacatcaaagaacacctagtaggatcaacaccacccaggaaagcatgacctcaccaaatgaaataaataaggaaccagagaccaaacttggagaaacagagagatgcgatctttcagaccaagaattcaaaatagctgcgttgaggaaactcaaagaaattcaagataacacatataagcaattcagaattctatcagataaatttagcaaagagattgaaataattaaaaagaatcaagcactaattctggagttgaaaaatacaattagcatactgaagaacacatcagagtcctttaacagcagaattggtcaagcagaagaaagaactagtgagcctgaagacaagctatttgaaaatacagtcagtggagatgaaagaaaaaagaataaaaaaacaatgaaccagacctatgggatctagaaaatagcctcaaaagaacaaatctaagagttactggccttaaagaagaggtagaaaaagagataggagtagaaagtttattcaaagggataacagataacttcccaaacctaaagaaatgtatcagtatccaagtacaagaaggttatagaataccaagcagatttaacccaaagaagactaccttaaggcacttaataataaaactctctaaggccaaggataaagaaaggatcctaaaaacagcgagagaaaagaaacaattaacataagctgaagctctaatatgtctggcaacagactgttcagtggaaaccttacagaccaggagagagtgaaatatttaaagtgctgaaggaaaaacacttttaccctagaatagtatatccattgaaaatatccttcaaacacaaggaagaaataaagatgttcccagacaaacaaatgctgagggatctcatcaataccaggcctgtcctacaagaaatgctaaagagagtacttcagtcataaagaaaagaacactaatgagcaataaatagtcatctgaaggtacaaaactcaacatttatagtaagcacacagaaaaatacagaatattataaccctgtaactctggtgtataaactactcttattgtatgtagaaagactaaatgatgaactaataaaaataataactataacacattttcaggacatagtacaataagatgtaaatagaaacaaaaaaattaaaaatgggggaacaaagttaaggtgtagagtttttattaattttctttttccttgtttgtttatgccaatagtgttaagttgttatcaggttaaagtagttggttataaatagtatttgcaaaccctatggtaacctcaaactaaaaaacatacaatgaatacacaaaaactaaaaagcaagaaactaattcagatcaccagagaaaattattttcattacaggaagacagaaatgaaagaaaaaagagaagaccataaaacaaccagataacaaataacaaaatggcaggcaaagtccttacttgtcaataataacacaatgtaaatgtactatactctccaatcaaaagacatagactggctgaataaacgaaaaaagaagacccattgatctgttgcccacaagaaacatatttcatctataaagacacacatggactgaaaataagggatggaaaaagatattccatgccaaaggaaatcaaaaaagagcaggagttgctatacttctatcaaacaaatcatattttaagacaaaaactttacaaagagacaaaaaagtcactgtatatgataaaggcatcaattcagcaagaaaatataacaattttaaataaatatgcacacaaccctggagtacccagatgtataaaggaaatattattgcagctaaagagaggaataggcccaatacaataatagctggagattgcaggccccactttcagcaatggacaaatctttgagacaggaagtcaacaagagaacattagacttaatctgtactatcaaccagatagatctaacagatatttacagaatatttcatccaagagctacagaatacacattgttttccttggcacatgtatcactctcaaggacagcccatatgttacgtaacaaaacaagtctgaaaacactcaaaaattgaaataatatcaagcatcttctctgactacaatggaataaaacttgaaattaataatgagaggaattttggaaactatacaaacacatgggaattaaacaatatgacccatgggatcactgaaagaattcaaaagaaggaagaattcaaaagagggaagtttatagatataagtggctatgtctaaaaagaaaaaaaacttcaagtgaaaaatctaatgatgcatcttaaaaaactagaaaagcaagaacaaaccaaactaaaattagtagaagaaaagaaataatgaagatcggaacagaaataaatgaaattgaaagaaaaatgcaaagtatgaatgaaacaataagttggttttttggaaagttaaacaaaattgacaaacctttagccagactaagaacaaaagagagaatatccaaataaataaaatcagaaatgataaaagagacattataactcatattgcacgaatttaaaggattattaggggctactatgagcaactatatgtcaataaattggaaaaatctagaagaaatggaaaaattcctagatacatagaaccaagattgaatgaggaaaaaaatccgaaacctgaacagaccaataacaaataacaagatcgatgccacaataaaaatcttcccagtaaagaagaacttgggacccgatggcttcactgctaaaatctaccaaatatttagtgaagaactaatagcaatcctactcaaatgattctgaaagatagaagaggagggattacttccaaactcattctacaaggtctgtattaccctcatacaaaaaccagagaaacacacatcaaaaaagaccacaagccaatatctctgatgaatattgatgcaaaaatccttaacaaattagtagcaaactgaattaaacaatacattaggaaattcattcatcatgacaaagctgtttttatccctgggatgcaaggatggttcaacatatgcaaatcaattatgtgattcaccatatcaacagaacgaaggataaaaaccacatgatcatttcaattgatgctgaaaaagcatttgatataattcgacatcacttcatgataaacaccctaaaaaaactagggatagaaggaacatacctcaacataataaaagccatatatgacagacccacagttagtatcatacttaatggagtaaaactaaaagcctttcctttaatatctgaaacatgacaaggatactcactgccaccgctgttattcaccatagtattagaaatcctagctggagcaatcagacaagagaaaaacataatgggcatctaaactggaaaggaagaagtcaaattatccttgttggcagatgatatgatcttatatttggtaaaacctaaaggctccacaagaactctattagaactgataaattcagtaaagttgcaggatacaaaatcaacatgcaaaaatcagtagcatttctacatgctaacagtgaacaatgtgaaaaagaaaaaataatcacatttacaacagccacacataaaattaaataggaattaaccaaagaagtgcaagagctctataataaaaactataaaacacaataaaagtgattgaagaggacatcaataaatggaataacattccatgttcatggattgaaagaatcaatatcattaaaatgtccgtactatccaaaggcatctacagattcaatgcaatccctatcaaaataccaatgacattcttcaaagaaatagaaaaaatcctaaaatatatgtggaaccacaaaagatccagaatagccaaagctatcctaagcagaaagaacaaaactataggaatcacattacttgacttcaaattattctacagaggtatagtaaacaaaacaacatggtactggcataaaaacagacacatagaccaatggaagagaacagaaaatctagaaacaaatccacacacctacagtgaactcatttgtgacaaaggtgctaagaacatacactggggaaaaaaactgtgtcttcaataaatggtaccggtgaaactggacatccaaatgcggaagaatgaaactagattcctatctttcaccatatacagaagtcaaatcaaaatggattagagacaaaactcaaactatgaaactactacaagaaaataaatattggggaaaatctccaggacattgttctggtcaaacaattcttgagcaataccccataagcacaggttaccaaagcaaaaatggacaaatgggatcacatcaagttcaaaagcttctatacagcaaaggatacaatcaagaaagtgaagagacaatccatggaatgggagaaaatatctacaaactacccctctgacaagagattaataaccagaatatacttgtcccagttaaaatggcttacatccaaaagataagtaataacaaacgctggtgaggatgtcaacaaaagagaacccttgtaaactgttggtgggaatgtaaattagtacaaccactaaggagaatagtttagagatgcctcaaaaaaactaaaaattaagctaccatatgatccagcaatcttactggttggtatacatccaaaagaaaggaaatcagtatattgaagagatagctgcactgttgtgtttgttgtggcactgtttataatagctaagatttggaaggaactgaagtgttcatcaacagatgaatggatacagaaaacgtggtacatgtacacaatggaatactattcagccataaaaaagaatgagatccagtcatttgcaacaacgtgtatggaactggagatcattatattaggtgaaataagccaggaacagaaagacaaacatcgcatgttttcacttatttgtcggatctaaaaatcaaaacaattgaactcatggacatagagagtagaagaatgattatcagaggctgggaagggtatcagggcattgggagggtggggatggttaacatgggtacaaaagaaaatagaaagaataaataacatctactatttgatagctcaacagaaggactatagtcaataacttaattgcacatttaaaaataacctgaagagtgtaactggattgtttataactcaaagaataaatgcttcaggaaatagatacctcattctccatgacgtttttatttcacattgcatgcctgtatcaaaacactgcatgtaaccataaatattgatatatatatacctactatgtacccagaaaaattaaaaaaaataaataaaatcaaaggttaaaaaaagatcaataatcaggtcttttgccatgtaggtaatagtcacaggttctgagtattagggcatgacatgttttttctaagagccgccatacaacccactatagatggggaactggggaagatagcagagactgcaaaaatgtccaaaaacattgcacacatcacaggatcccagttctgggaaacctggggaggcttatacaatttcaacaaatgaattcaatgggcaagacaaggatgtggccaccaacaccagggcaccaatgtgactggctctggaggagaaggtttgagcggctccagcataggagtcctacccacatcctatttacgagggccagaggagccccacagaaataggaggacacagagtgatgggtttttaagtgtctcagcaatgggtgttagatcaccttgacttctaggtaataagccaaatgcaggtgaaaccgatattactgacaaatacatttgataatctattacaaacttcaatagttggccatgggaggtaatattttaggtgatgatatattgtagaacaaatcaagataacttctagtttagtttagctagtaaactggaagtaaagatttattttaagtcatttgcaaacaaccatcagcacatccatgcagcttaaatttccttttaggatcagagtctttgatcttgaatttggagcaatagcccagaggccttaagatctttcacaactaaatgccactacaattgctgcacactctatcatctggcaaggtttggcctaacctaggagatcaaagaccatgagattaggaacacattatcctacagcctgtacataaacacactaaacttttgagattataatgctatgacataaaccaacagcccctccaggaccaggtctggcccatgtagtgctaaagccccagaacttctggctctagccccagaacttctgattctgactcaacaagcactccctaagcaattctgctgtaggtggcccaggaaccacactccggaaaacactaccctaagagagatgggcattagaaaattaaaagaattattttaacatatctatgcataacagggcagtattacatattaatgaaccataaagtgaagctgttgatcatatacatgagctcaaagattttaaaaatattttaaacatatccttcatttggaagatcaatgttttgatattactttctccaaacactgattttatatcctgtatcacctttactcagaattaacatcctaaacatttacagagggaagtatttaaactcctttattcattcagaagcacatctagcatgccttattaacaggactggaaatggaggaaaatgtgctacaatattcctcaaccttcaacttctatctgataaaaatttatctgctaatctccagcctgtaacttctcctttctcctccaactagactgtctagttcttgcgcttttatattaggttggtgcaaaagtaatcatggtttttgctattaaaagtaatggcgaaaaccacgaatacttttgcagtgacctaatacttctctagtatttcttacatcccacaccatgacgcaattatctgtgaatgtcatctaccacattggactacattttctggaatcagagacatggcattatctgaccttgggcatgtcctcagcacactgctataaacaaggttggtataaaataaaagtttattgaattcaatggaaaatatgtatgctctttttaattccaggataattacataattcattatataggtatacagttatattttaaaaatctatttacatcaaccagtgtggttctgataaaaaactgttttcaaaaatgagaggaaaaataataatgtatccaacatattgcaaacttttgaaagaataatgaaggttaaggtagaagggcatcttatctcaggcatctaggcataactagacagcaataagaatgagttactttacaaaagggaattgatttagatatatttgaaacgggaggttgtgcagagttgggctggtctatatttcagacatgcaatacaggcagcattattgcttgcatgcaatttctcttctttctccaggtcatgcaaaattaattaaaagttattgaattttctcctggataatttctgggctgttcattcgaatttggagtagaaagaggttcggaatggcctgagcgcaaatgacaaatgttagcttatgcagaagcaacatcctaagaatagtgatgattttgtaaaatacccaaaaggagttttgcatacttcggaagttttgcacatttaatggactacaaatgtgtattccacatggggtgacagtgaatttttgaactggagatgctctttgcctctctctgatatgctttggaagtaaagctgggaaaagaaaaggaaaactctgttaaagtataaggagtgctgaggactcagtatagcatctctttcacatacttgacctggaagtgaaaaataagcatgtcttctctctacaggaaatcacaaagccagacactataatgaacaaggactgaatgactacttcagttagaattctgatgatgttaatgtcaataggaggaatttcacaagtagttttcatttgttgcacgaattttgagaatattcatatcagaaaattgatttcctattacctatacagattcaaaagacagatactttgaatgatatatttatacaagagaaatatgtaaaaatatttgcatatagcattgatgtggtcattagtccaaggtatatgaattggaattttctttcttatctgagatgaggtttaacagttcaatttcacaaaaggttgccttgcttcgtctgccaaatgaactcctaaaaaattatacgagatgaaatacacacctcaggaaagaatcatcttgattaaacatttgaccaatgtactcaacagtgaacatacacaaggtcctttgttctatattgattaaaagtgcaaacattgactttctaacacctttagccacacaagtaaaaaggaaagaaacaatgtacattttttgtaaaataaaggaggatgcttaaattttgttagaattatttttttctatcaaaaattctcaaatagcattatgcctagtataatttaaattctgtcaatgacaaacacaccaaagaataccatattgctgctatgtgagaatgctatcttgaatagcatatcattgatttgtcctatttttatgacatacttgatgatttgattaatcatctgaggattaaatatcatcaatttttattatgcatggatttgactgagtttttataatagaagacaagtttttattacagaagaaaatcatacaacttaactttatgctaagctgtttttccaccaatttccaagtttctatatatattcaacagcttaaacacagtgaaatggcaaggtatagaaagcacccagtccaaagtctggcaagtggagtgggcattcagtacttccttggtgcctcactgagtagcactgagtagatactggtaaataatgaaaattatgtagcctgggtgggaggatgtatgcagccagccaggatttcttttctagcctacatgttaattggtttgagatgtacttccaaaagaaaggtgagcagacagtaaaacaatttctacatgaagccaaagaatttgtttgtgaaaaatgaatagaattgttatttaaaatatctatgataggtaattgtatctgacaaacttaaacctcttttaaaattgctctatattaacatgccaaaatttgtattcataatagaaatagctactctataaactgatctagatgttgtttgtgtgtatgcacacacacgtgtgctttctaaatttctcataattaaggactaatattaattaagaattagatgaccttactgattcagccatgtttggacaacttgtcattggcattatttaatttaacccccactaaatagaggagtaaaaatcagccatttctttaaaggtggtcttttctctctatttcatcttgtgtcattgctcttttgtattggagaaaccctagattgtacacagatataaataattttatatgattatcaaatatgtcaaaaaattctgaagaatttcatctgatagttgcaaggttatttttttcaatgacctcaaattaaggtcctgagaggaccaagacctgggatttgcttccacattaaccacacagaaagacctgccttccagtgggtggggcttcccacttgaagtccacctggtttggacaaagaattctagagaaccctgacaatgctcctgttgggttcaacattttatgccacaaattattctgtgaaaaagagcagttttctatagaactaatgtaactctaggcagaaatatagatttagaagagtttaaaaatacccaagttaattcagtgccaagtacttatactcctgtttgcccatcccataatcacactctcccttctttataaattaataaattatgcatagggtcaaacatgttcttgaacttctctagtacttacagactaaaaagtacaattaaacagaaataaaatttgcctgaacgtattctttaattcaggggtttccaatctttggcttccttgggccacagtggaagaagaaaaattgtcttggaccacacataaaatacactaacactaatgatagctgatgagctaaaaaaaattgcaaaaaaaactcattatgttttaagaaagcttacaaatttgtactgggccatattcaaaaccatcctgggtcacatgcagcccaagggccacaggttagacaagcttgctctaattgtttcataagagttaacattgaatacctagaaagattaactcctttaagcttctcacaggatgcctagctcagactaagtacgtaataaatgcttgttccttgcttttccccatccgtcatgagggcagagactttgtttcatactttattctcttattgaactccctgcactgtttccagttcaatgctgatcacacagcttggaattctgtaatagtttttttttttttttgattgactaaaagatagactgattcagtgatactgatagtacagcagtatgcttaaaataataaaggtgtagttcctcacaaatggaatattaaatctcattaaggattcagatgctacagaaggaagagcccaaaaacagacccacatacatctgaaaacttgatatgtgatgtaattggcattgcagaccaataggaaaaagataggctgcccagtaaatggggctggtaaattgtttattcacaaatatataaaaagttcaatgcttacagtacaggatatttttatgaatctaaggttgtaaatattccttaagcagaatcgcagaagtacaaatagcaaaggaaaagtctgataaacacaactgcattaaaataaaatattctgttcatcgaaagacgcaaataaaaacatcaaaaatgcaagacacaaagtgaaagaagatagttgcaatgcatataaccaaaaaaggactggtatcccatacatcaataagaacccaacaaacaatccaaggaaaatataagaaaaacacatgaacgggcacctcaaagaagaggtactttaaataaagggcccataaacatgtaataagatggtcagctccatttaatgtgtaaattctaataaaaaccacaatgatatcatgtcacaaacaatagatggaccaaaaaaaattaagtctggcaaaatcaaaacttggcaggatgtggcactctgggaatgtttaagcaatcctagtaggagtataaatcggtgcaaccattctggagagaaatttaataagacctagtaaagttgaaaatgagccaacaacccagcaatttcactcctacttatttatatgtccctggagaagctcttacacatgcgcttaaggagacatgaccaagacagttcttcggaccaggcatgttggcacatgcctgtaatctaatcccagcactttgggaggccgaggtaggaagatcacttgagcacaggaacaaaatgtcaccccatctctacaaaaaatggaaaagttagctgagtgtgttggtgtacatctgtagtaccacctacttgagaggctgaggcaggaggattgcctgagcccatgagttccaggctgaagtgagctaagaaggcaccactacacccagcctgggaaacaaagcaaggctctgtagaaagaagaaaaaaaaaagaaagaaaagaaaaaaaaagaggagagataagaaaagagaaaatgagaaaagaaagatcttagcagcactgtttgtaagagccacaaagaaatgataaacaactgaagattattcacatgatggaacaatgcacagcacagaaaaaatgtgctatctccataaacttcacacacagggtccagccagaaagagaggaacagaggaatacatacagtatgttatcagtttatgatgttttataaatgaaaaacaatactatgtatagacttgagacccatgaaaatgttaaaaagtatatatatctatatctatctatatatatatacataattaagagagactgaatttaagattagattaactctgagactgaaaggaggaaaatcagatcaaagagaaacatgaaggtggccatatttctatttgtaatattccatttcttaatctagatgttgcgaagacaagggttctttccattagtcttcttttatttataggggatgcattccaaggtgcccaggggatgcctgaaatagtgaatagtatgagaccctctgtatgctaagttttttctacatacacttatttttgtgataaagtttaacttacaaataaggcacagtaagagattaacaataattaataataaactagaaccattataacattctgtaataaaagttatgtgactgtagtctctctctcaaaatatcttattgcactggactcacccttcttcttgtgatgatgtgagatgacaaaatgcatttgcgatgagatgaagagaggtgaatgacacagccgttgtgatgtagtgttaggccactatcaaccttgaacacaagcactgaaatactggatgccatgacagttgatttgataagcacgtggctatgcaatgactaacaggtgggtagcgtctacagtgtagatatgctggacaaagggatgattcacatctcaggctggacggagcaggttggtgagaaatctcatcaagctcctcagaagagtgccatttaaaactgatgagttgtttacttctaaatttttccatttaatatttttggaccatggttgtctgtgggtagttggaatcttggaaagtgaaactacagataaggaggcatggctgtatatttagtcttcatacaacatgcacagaaatatttaatttttcaaaatttctgcattccaaaaactcaaatatattttagttttgcttaactgaaaattctaaaatagttttaaattcttgaaacaaatagctcaaaaggagagtccctccaattcagatttttattgttatttattatttatttattttgagacagagtctccctctgtccccaggctggagtggagtggtgtgatcatggctcactacaccctcgacctctccagctcaagtgatcctccgaccttagccttccaagtagctgggactacaggcaagtgccaccatgcctggttaattttttaattttttatagagacagtacctctctatgttgcccaggttggtctcaaaatcctgggctcatgcaattctctcacctcggcatcccaaagtgctgggattacatgcatgagccactgcacttggcccagatgaagtttcatatttcactaaagagaaactacctagcttctaagaaatcattgaaaaaccatataaggcaataggcaaagcattgccaattacgtagatgattttagaaaaagaaaaaaggaatgtctagaaaggaaaagattagcataagggttcttcagaagggaagaaacataaggggtcgagagaacaggttgcaattttcgttggagttagtgtatccagacatccttgaacctgcctttcctgtcgttggttctatctccacaatccaagtaaattggcaggttggcttatcaaaacaatgcatacaaaaaatatttcagagtgatttgcccttgtttccttctttgatcacagaaacccacttaaagagcactattccacacataccttagtaaattcaatgacatttttttctggctgcttcagctgccatgatgattgcaaactgtacactgccctcaccacgcagactacttttcatgcctgctatgtgaacacaaagctttgttttttttccagtcccaagtcccttattcaggaccaaattacaaacaatgctgtgttagacacttttcagaaacctctggataaacgagtctcagcagccccctgggctcgaccccacagaatgtaatgcctgctcatgcccaaaccactgcttccttgtgagctttgaatagtcattaacgttgccaagactggcaatcatccttaaaagtcttcctatgaagggaatctaatttgtatatgtctgaaaaagacaatgaaagaaaacatgctggactatgaactctcaaggtatttgttcctctggctaactgaaatgagaaacttttgaaaatatatgctatcattttttgaaaataatgattgtgactttaaacctgaaaagcctcatctgtcccacctcctcctaattgcctggatgataatgatgtaaatgcagttataattacaaagaacttcaattcaatttaattttaattgtttaaaatttgtaaacactccagaaaaacctcattaagctggctgaactagcttgttttcaagagggaacagggagtcaacattcacagttattcatattacaacatccattcacttacactaaccattctgattaaccagtaatcacacacatttggagcaagcagcactggcaaagcttgttacagcttttaaaaaatgctttgcaaggttgcatatataaaatgaagccccacattcaaaagcagaactttggcatgcatgcacattgaagaagggagaggaaaatcctcacaaaatgcatgcatcaaaaagtttatacttctaaaactgaggtcttagaatcccgaaagattcaggttcatgtctccttttagtatgagatgatgtggtctgcataccttccacagtgtctcactgtggtgtgagtttcacagtcaaaggaggacggcctaagtcctttgcacaaagtacatctttataaccaattgccctgtaagcgtagcagtgaaaagagcactggattggactgggggaacctggcacataaaattcactacttgtgggaactggggtacatgttctagcctctctaaattggttttcttagtaagataagccaaacctgaagagctactgcacagagttttggggacaattaaatgtgcctggcatatagaaggtatgcagtatatgtagttcatagtatccaaaaggctgaaacaaaaagggttcacctttggttaccttctgcataattactaacattctagtgattgatgattgaatatattttagctgaaatcttaagttttcagaactcatcaccaatggtttataatggatacttgtttgtatcatgtgaaggccatatgtggataatttttagaattaacaaaatgttgtcttatgtcacaattctctgaactgtatgagggtttattggacaaattaaaattcaatctagtaatataccactcatattgtcacattttaccagacatgttttcctctgttattgaaattttagcacttcctgcagatatttggaatagaaatagaataacgacaattgttattactactcatttttacaaagggcttttcaatttctaagatgattttaatatacattgttttggcttgtccctatagcttgcagatttggtcccaacactcacagtgactaacaatgttcagagcagtgtaatcattggataaaagcagcagaggcctaagggcaggggtcagactttgaacccttgctttctggtctcaaatctcatgctcttttctggatgttgaattctcccataaacacactacgatcaaccagaactccacttccattcatttataagagttaaaaaagtgaagcctccattatcatctgaagtgtaaagagacatcagatttcaaaatgatggcaacagggaagagcccttgccaaactaactattattttaacaactaaatgactgtgtaatcactgtacttgctgcaaaaacactgaattgaggtttccatttgggtgtttgtatgttctcaagtccagcaaacagagctctgaagaatgtgagcacaggctgcctgggcacggtggctcacacctgtaatcccaacactttgggaagcctaggcgggtggatcccgaggtcaggagattgagagcatcctggctaacacagtgaaaccccgtctctactaaaatacaaaaaaattagccaggcgtggtggcaggcgcctgtagtcacagctacttaggaggctgaggcaggagaatggtgtgaacctggaaggcagagcttgcggtgagccgagatcacaccaatgcactcaagcctgggcgacagagtgagactctgtctcaaaaaaaaaaaaaaaaaaaaaaagaatgggcacacaggcaagtttttcacagtacacctaagcagtcagtgatcatggggtataagtggtagaaaatactaactggtttatttcatttcccttaggaacaaattcatacagtgtaacccagccaagagattcccagagattctcatcctgctcatctccgtcaccaagacgtgtgcttgtgactccagtgctccagcatgcgattgtcactcaacctaaatcccaggtcatctttcaaaatctgagccaaggaagccttaccatgaacactgaacatcaaccatgcctaattccctggcctagtgctagagccaaaaggtgtatgaacctggttccaagaagttccaaaggaatggggacaaaggagacattcataaatacataactgtcagtttggcccactgtgctaaggcacaataagaaaagtgagataatacatccttttgagtggaagggaggtggtcatcacctaccatgctggcctttcccttttctaaccacccattgttcttcctggtaatacaatttagcacctgctgggtttcttacaactcctcccatgttctttctatatctgtagtcaaagtgtaagccacttgaggatacagatgtgtgtcattcttctccaggattccccaaaacacttggcatagtcttagttacaaaaccagggctccatagagacatattaactgactgtgtatagaagattcagtgggtgggaaggggaaaagactaaaaacaaaaaaaaaatgggggagaaaacaaccctgttggaaaaggaatgactaggaatggtatcttggtgagggaaaaagagatggttttatgttaggggagtttatttaggtaggaaaaaaaatgagtaaactttgcacgatttgaaatctgcattccactggctaatataaagtaatctttcctgtttgtaaaatgaaaaccatgaaaagatgataacacactttgtactaaatctacttggggaaggaacaacaacattttctccctttgctcagttcagcctggaatataatagatgaaattgtaattcagagcacattatcaatgctgctatttattttctgaaacattagtctaggtatatttttctacatttttatatcaaaatatgccccttaagattcagacatacattctcaagggagctggtctacaccagttttgtaaaatgttgactaactatttgagtgatgaactgaataaaaggtcacttactttcttcatttatcacccaacagcctttgatggttgaaaatatttgttaacctttctttgtctcgattttatcaccaaaaagaaagagggataaaagtgcttgctttgaagtatatgcgcgactgaacgcatgtgtgaaattctttgagattctcagatggaagtgctgttggaatcattaaaatttagagaactttaggaatttgaatcctttaatactctgaaggtaaagtaatcagattaatggattttttttcttaatcttgtcaagagtatgggttgttcaagatcagatgtttttcacttctctactgaagaaaactgacttgaggcttggagtagagaaataaaagccaacttcctaattattccctctgtgtggtcctcagagactactgctgatctggggttaaacttattctttaactaattaaactctttttctttaattaagcagccctaacgaccttactttgtagacagctggcttcattacaagcagagtaactttcttatactgaacacaaagtaggtgaggaataaccaaaaaggtcttagaaaattacttttaccagaaattatttttcatctcattttgccagatgaaacatttagttaaagggttgctattgagcaacatgaaaggaacgtgggctggaacagtcccaagattcacttggtcaaaattaaagcaggtgctgggctccacaagtcctgggtaccacggaaggcaggcggtttgctagcattcacaggatgccgaacccaggcctgcaacgagttttcatgctgagcacctcaaagcaccaacagagacaggatatgtggattaaagcccatgaaaaaataaccaataatttattttccaatgcactgtgaatatttaaaagaataaaatcatctgctatgcctaaggtgatttatgttttaagatattcaaatatatctcccataagttactatcaaaaatgtttaagcatgggttctagaaaatggtaggctctcaatacatatatgtagaatgcttcatagatgaaaatggttaaaagataacttattgatctgattcaataccctccatttgtagatgagagaagtgaggtctagagagattaaatgaaatctccaagctgacacatgtatttttttcaataaacctttactgacagcctacagagtaccaagaatcatactaaaactgggactacaatgatgaacaaactgcactttctctgtgcctactagctacctctcctagaatatttgtaacaaaacatttgtcattggttgtcattggcagtacaagttaaatttcttggtttacaagttagagcttcagaaaaccttgcttttacttttcatcaatgacaaaataaacacaccattaatccaaatccacctctgtgccatctacagtagccaaattaggaaaccacggactatcatcacgtaacagaactcatactctgatctggagctagtccgcagctaccaagacattctgacaccaaagctgatagtgggcaatgaatgcagggataaagggttggttttctacctttctagagaagtatattaaggtggaggcaggagatgggcaaagagtatgaaaactggagagtttgggccgggcacggtggctcacgcctgtaattccagctctttgggaggccaaggcaggcagatcacctgaggtcaggagtttgagaccagcctggccaaaatggcgaaaactcatctctactaaaagtacaaaaattagttgggtgtggtggtgggcacctgtaatcccagatacccaagagactcaggcaggagaatcgcttgaacccgggaggcagaggttgcagtgagatgagattgtgccactgcactccagcctgggcgacaaaagagaaactctgtcacaaaaaaaaaaaaaaggaaagttcgatgtaaaaaacaagtatatttaatctcagtatgaaaaaggtctcttttcttccttgaattgataaacaattgtttatcaacaatagaatatttgttcaactaatgtagaacattcaacaaatagaataattacattaaagtagtctcttttgaagggtaaaagaaaattctaagaaagcagtaattaaacagaatggtagggagaaaacaaaataaaaaaatactcctaatgttttggcatcctccttgggatggcatgagagggggagataaaaaacatagaaaagtgggaggaaaaaaagcacagtctggaggtatattttagttcccaattgcctgagctataacattcagagtgataaaaccaagtacctgctgcccctcctgcccttcatttggttagctggtaaaccattcttcacagctttttgtctgctcagatccttgaagattctttattcgagagcagtcaggtctaacaaccattcctccaatagctttagttttcatgattagaataacactgtccagaaagaaagatgctgtctcctggaggagggatttgactcctggctggaagtttgccatctctggtcttgttttatccaagatcctcaagaaaatcaaagtctttggtctagtggtaaatggtaactagcattccagggacgtgcttgctatctacttgcgaactatcctaatcacaactctacttccagactctttattttacaattaaatgcttccttctgaaatatagcttggctaaagaaatgcaattttaattgtatgactttgtaaagcgaccttcaaaaattcaaaggttaactttctttactttctgaatcctactgtgccatgcatggccatgcaaatcagcactagtctaatctgtttcccttaccattgctactctctttcgctaatttccactttattttttcaagtccaagttgcttacagggtaagatttcaaagcaagctccggttcctggtgtctctgcataactttggttttagttactaaggaaacacttctttgctgtgctacactgtaaatcctttaattctcccttttcctaattcttaagtaatccatttaaactgcaaaagcaaatactatgagagcatttcataaaacacactgcatgcaatccaataaacaagaaatcatatataatttaacttcaaaatttcatattaattgccattagaaattcaaattcaagtactgtatgcagggtaaatagatgaatagatgcagtgtatgatggatgaagccagcccatgttccataattctatggtgtttatcagtatcaaggaagatggcaaaggcaagtcagaggctggtacaaaatttaaggctaaaagtatctaagcttgcaagaaaaagcaggcgatatctaattatacactaattctaaaatgctttgttccaaagtgtttacccagaaactcaattattccttccacaaacattgatggagatcacaccttgtttaataaagtattagcaatatgatggtatgttacctccccaccccagtagggagagaacctgtacagaaataaccatagaacaaagccaaatatgctaaggactaaagaaaggcacaacgttctatgagagatctatcagagaggggtttactgctggctgaggtgttagagaagctctaatgtagagacaaacattcctgctgggccctgttagcactgcaacatgccaagagggagcctgggagaagaacatgcattccaaggaaccgtgtgagcacttggtttgcctctgagtgtttttaaagaatgtcaagctggctaatgtcctaggggaggtagatggagtgaagtcacaactaggccaaggaatttgagttctgaaattaatctactggtgacgaagagaatttaaagagcttttagtggggttagaaatactaaaaagtgcaaagaggaaattcagaactagaaagtaaagtatcctcacatggtagaatgacatatgcccactcttatcaaatccagtttgaaattttcttggcaatcagatgtccagggggccaccgtggttcattgttcaggaaaatcacgagtcatatgctgacatttattagagttttgacctataagcaggtaggcactattgctccatcaaacaaaatgaaaaccctgatgaaaagtggctacaaaacagcctagcaaaaatctcaaatttacacatatctgtataaggcctcacagttgtctattgatataactcttgaaagtctattttgaacattctgcattttcttgactcaaccattataattcagaaaattaaatggggagaaaggagtgagtagtggtggtatcacaaaggaacaaactagagaaaggtgttgttctctaagagtcttgagttgatactaaaattagggcgtatactagtatactgatccaagagtcaagggagaactgtagtccaatcagccaaaaaggaaatctgagtgaatcatccaaaaaacaaaaaaagaatagaaaacaggtatcaaaagtgatacaccgagccaagaattagggttcctggaagagaagtaggaaggagctgagaacagagagtgagttctagttttaaataacaatctgaagcagttcatttttatcttaaagtatggaatcaaataggtcagccaccttgaaaacgccagaagatggtgtgctgcgagatatcagtttagataaactgtatatatatatatatatagtttatatatatatgaatagtttatatatatatgaaagaactaataccaggaaagaataaataagctattttatatagatttcaacaaaaattattaatgtcaaaataaagcaatataacaatatagacataatgggtatagccaatttaagctctgaaatgcacacacagaggatgaaatgagaatgttgggcatcatttgttgcattatttgatctatctactagttattttgtctccacatctcattataatagccagatgcagagctgtaggaaaacatgactcccagcaatggcacctgtccttttggtgagtaattcaaaaataaaactggtctttttggagagatctctgaattttccatctggccaggctgctcctgagctttgcctgccttgcttagagggtgtttattttatcatgagctttaattatgggaacaataaatgctttcttcttaaaattacttacaagagttattaaaagaatattacaagagagggagaggcacacacttatccctgtgccaatgtttccatctgtccctcctctccctactttcctcaacattaacttgtaggtcaggcaggaaagttatatgattgaatattccgtctgatgtggattattttgtctgtaccactttctcgatgacctgctcaactgaaatgcttgtttcttttatgcctatccagaacatctctgtcccctagtgtccaggtcaactctggattctgcctgaaaactttccccaaagctgtatcctcttcctaaattccaacattcatcatccctattttaacaatttacctttccttataatccaacatattattagtttcaaatgatcttattatatagttccatatttttctattgctctccactgcacccagaatggtatataatagttatttaataatatttactaataaattgtaaaatttcttctttaaaacattaagagtcaagtttttaaaatgctgatttgcttctcttactgcaaaatcttaaagtgtctgtcttcactaattttcattttcagaggagacctgtgccaattacacatgaaatgctaaataaagctagatgcaggactgtgctaaatacgaccaggatagttaaaggctacatgggcttcttttattctttaaaccaacaagtatttattaaacacatattatcaatgacaagcaggaaatcttttccttggatttttaagttacaagtactatatgggagtgcacatttgataccgtcataacttttttgaagacagatcattcaggcaattttgtttgaaaatttttgtcaattacacttagatctgtagctccaaagttgaagcacgcaaccatgccctgttttagtgtacatcattttattgtgctttgcagatttttttttaaacaaatcaatggtttgtggcaactgcattgataaagtgtagtagcactatttttccaacagcatgtactcacttcattgctctgtcacattttggtcattcgtgcaatatttcaaactttttcatttttagtacatctgctatggttaactgtgatcagtgatctttgatgtgactattgtcattattttggaacaccacaaatcgtgcccatataagacagctaatttaatcaataaacgtgtgttctgactgctccaccaattggtcatttccctgattcccctatctctctctcctcaggcctcccaattaattgagacataatattaaaataaggtcaattaataaccctacaatagcctctaggtcttcaagtgaaatgaagagtcacaggtctctcactttaaatcaaaagctagaaataattaatcttagtgaggaaggcctgttgaaagccaagacaggccgaaagctaggcctcttgcaccaaacaggtagccaagttgtgaatgcaaaggaaaaacacttgaaggaaattagaagtactacttcagtgaacacatgaatggtaaggaagcagaacagccttactgctgatatggagaaagtctgagtggtctgtatagaggacaaagcagctacaatatccccttaagccaaagcctagcctgcagcaagaccttaactctcttcaattctatgaagcctgagagaggtgaagaagttgcagaagaaaagtttgaagctggcatagagtagttcatgaggtttaaggaaagatgccaataccataacacgaaaatgcaaggtgaagcaccaagtgctttaggtgcttttatatgaaaaactacagcaagttattcagaagatgtagctcaaataacagataaagatgactacactaaacaatagatttttgatataaatgctgatagaagatgccagccaggactttcatagctagagaggtgaagtcaaagcctggctttaacggctcaaaggacaggctgactgccttgttagagactaacgcaatgtgactttaggttaaagccagtgctcatttaccattctgaaaatcacagggcctttaagaattaagctaaatctactctgcctctggctctatagatggaacaacaaagcctggataatggcacatctgtttccatcaaggcttagtaaatgttttaaacccagtgttgagacctactgcttagaaaaaaaaaaattcctttcaaaatatcactgctcactgacaatgtactaggtcacccaagagccctgatggagatgtacaaggtgatttaaattgttttcacacctgttaatacaacatccattctgtagcccatggatcagagttatctcaactctcaggccttattatttaagaaatattttttataaggctatagctgccacagatagtgattcctctgatccatctgagaaaagtaaattgaaaaccttctggaaaggattaccattcttcatgccatgaagaacatttgtgattcatggaatgaggtcaaaatattcaacattaacaggagtttggaagaagtttattccaaccctcatgaatgactttgaggggtacaaaccttcagtggtataagtaactacagatgcggtggaaatagcaagaaacctagaagtgaagcctgaagatgtgactgaattgctgcaatctcatgataaaacataaacagataagttacttcttatggatgaaaaaagaaagtagcttcttgggatggaatatactactgtgaagatactatgtagattgttgaaaagataacaagagattagaaatattacataaacttagttgataaagcagcagcagattttgagaggactgactccaattttgaaaaatgttctattgtcctgtggataaaatgctatcaaacagccttgcttgctatagagaaatattttataaaaggaagagtcaactgatatagcaaacttcattgatgaatttattgaattatactaaataatttaaccttgctcaagtttcagcaaccaccaacctgatcaatcagcagccatcaacactgagacaagactctccaccagtaaaaatattctgatatgcagccaggggtggtggctcaagcctgtaatcccagcactttgggaggctgaggcgggcagatcacgaggtcaggaaatcgagaccatcctggctaacacggtgaaaccctgtctctactaaaaatacaaaaaaattagctgggagtggtggtgggcacctgtagtcccagctactcaggaggctgaggcaggagaatggcatgaacccaggaaggggagcttgcagtgagccgagatcgcgccactgcactccagcctgggcgacagagcgagactccatctcaaaaaaaatatgtatatattctgatatgctaaaggcccagatgattgttagcattttttagcaataaaatattttgaaattaaagtatgtatggtgggccattacagtggctcattcctgtgatcccagcactttgggaggctgaggtgggcaaatcacttgagcccaggagcttgacaccagcctgagggtgggaccctatctctacaaaaaaattacaaaaattaacaaggcctggtggcacatgcctgtggtcccagctactcaggaggctttggtgagaggatcgcttaagcccaggaggttgaggatgcagtaagctgcaatcatgccattgccactcgagcctgagtgacagagtgagatgctatttcaaaaaaaaaaaagaaagaaaagaaaaagaaaaaaaaggtacgtacatttttaaaagacataatgctattgcacatttaatagactatagtatagtgtgaacctaacttttatatgcatggagaaatgaaaaaattcacattacttggtttactatgatatacactttattgaggtagtctggaacagaacctgcaatatctccaaggtatgtctgcatcagaaatgactgttttactttgaccaaattacaatttctccagaaaaaaaaaaatgagggaggaaagagaaagttccctcaccaacaaaatcagctgaattaacctggtgactaacatgatgacagatattgcagccagagagccctaagctcccaggacaaacaatgggatgccaagcttaagataaccccaagtaaatgcataagaatatacattcattctttctaagacatcagtgggactaggaaaatcatctcaagagctgaactttaaagctattttagacagacacatttaatagcatatttttttaaatcttgtgtatgtcatgacaagttcttttctttcataactctaaatatcacatacaaaagtagcaggtgtgaaatgtgttttgggtaagaaaaatatcaagcttctatgaaagacccttttgggaaaagtcccatactaaaagagtcctagagaatatacccatcatgacacatctcttcaaagctaaaaaacagcttacacaaaatcccagatatcaacaagtataaacactatgaaagaaaaaagtattcaatgtcaatatattttatagctgcatgtttatgtatatattttcatggactagattgatcaaaatataagaggctgtctctctcccgttttctagccgtccctgaaatccacttcactgccaactctaatccttgccccctttttatttaaatgccatcaagaatctgaagtagtaaaattgaatggagatttcaacggtgggccaattttcctttcttatgagctatgaagataaatgtacacacacgagtaaagaatataagctttgcccaagaggtacactgggcagaataaagaaacgtctttcttttcttagaagggaagtgaagatttatgaggaggcagcatattgggcagccttctgaatatcttataatttttttgtgacatgctcttcccctagtgggcttcatcattcaggctgctctcctcccctcactgatcagagcttataggccttctgatgaatccatcctctacaagctatggggacggcctgcattcttgcctacgaagctgcagctaaatagaaaaagcacatccagaatgaccactaaaaagagaaaaagcaaaagcagtttccagatccatgaatcccaaaatattaaaaaaaaaacaaaacaacaacaacaaaaaaacctatttatatattaaaaatttgcttcattactagactgtagagaaatttgattttacattggattcaattcaagttccaatgcatttggacaaagaatttagagtattacataaacttagttgataaagcagtggcagggtttgaggactgcaattttgaaagaagttctactgtaggcaaaatgctgtcaaacagtattgcttgctgcagagaaatatgccattgacagggcccccacgctaggcaccgtactataggcatttgtaaatattatctcatttaatcctcaaaactcgcattctagaagaagtttttttctgcatttcacctgggtgatgaaataacatgtacaataaacccctatgacatgtgtttacctatgtaacaaaccttatcatgtaccatcgaacctaaaagttacagaaaacaaaaagaaaactgagattcaaagaagggagtaatcctccacccaagtcacagaaccagatcaagagcacagctaggacttgaacttaggttttaaacattaactgaggcaagaaccagatgaacacattgtctgacggaactgccaaacctcctctttcgatttgttggggaaaataaaaatggaggggagaaaaagaaagatacaatttcagaagagagagacaggtcataatcaatcataagctttcttggagaactgagcctttgccattagtacctggtggctattgggccactatggcttccccaccttagatcaacacacttgagcccctcaccacctcctaaacacctttctccactccccaaccactaggtttcatttaaaactgacagtgcaacatgcccacattttttttggtaagttcaaatgaaaaaaaaatgtatcttaagtcatgcttgctatgcagaatatttttcaaatctcttactatgctttcattttctgaaatttctctgatgatgagtactaaagataaaatgtaaataattctagagatggaacaagccaagtgctatccatagccctagatgtaatgctcctgtaaggaattataatggacatggtaaaacctttaaaacaaattaaatgttcaacttcagcctccatggtaaagacaaaaaagccaaatatttacgcttggaattttgatctctggttaaaaaggaaatatagaacaaacaaacaaaaaccaaaaagttaacgtatcactatatgaggcttggccttgtgtctcctgttagataagagatgaagcaacactctttggcgacatatggtgagtcatttaagtgtattatgcagatttggagtagagatattaaacagcattttcaaaagaataatacaaggactatgactgaagaaccattgacaaaacacaaaagcacagcttgaaatgtgaagactcagcatcatcttaaagaaataaatacttctatattcttcaattgagctactcaatagttgtgagaacaaagaaaatcctggaggtaaaaatccatgcaataattctggctggtcctctttgcagaggtactcaggtgtgtgatctggtagatggcctgctataagtttaatagcagggttatagatttaaaaatatatttaaaagatagttcacatttaattttatttctggtgagattaatgtgttacaaagttagattaattaaaatgctctgggaaataattttcttggtgaatcgatctttataattcatttacttacaatgtttacatagaaatctttataaaaccaaagaagattcagtaaaaagcacccataaattgatttcatgggaaaaaaataacgagattaaattatcagtgtttttctgcctaaattacagcataaggatgtgaatgtattaggcacattgtaattggcccaatcctggctgctcttctcttcctacttcaaagtataaagaaagcactagaagaggcaggcaaaacccagctcccatggaaggcactagctgtacatattatttcagagaagcaaagcaaggttgatgcaatccacacaaaaagagagatctgagtaactccagattaattaatcacagcaggaggaagctgagttgccagaaatgttactaagttgccccctacagaatggatcaagagtgactcccttccttaggaatgaaatggagacatgattccaaacaccacactttggatttataatcaataattctattgtcatatcatttacaataagtgtgtttattaagctggcattgacagggcactcaatttattatctctgaactgtttgaagttacatatacactaccagcatgtatttatatatggcgaatccatctgcagcttctctttttctggtaggaagagttcacacagcttaccaaggagggcctgaccagatcataaatcaaggtgaagcaatttctgataactgaatatgagtttcctctaaagctttttatgtgacgaaaagctgagaagctctgtgactagcacaaagaaaaactcatcacatttttttttcccaataactgctggcctctttgttctagaataatctgtaggcttttcttggcattttaactcacatttgcccttatacccagggaggcctctgcagcttaactttctctctagtcattgctctcttcatatccaatattagctgagcaaagtgagttactaccaacttttgactcttcctggccaagatgttttcagtttgttcaaaagtagaaaaacttaagatatttaactgatatatttgtggggaaaacttgtaacatttgagagctaggaaaaaaccgttaacatctgccatactacagactaaaggaatggagactagaaagatctagtgaaccccttgctccttcaggaactgtccatggtgctgcaaccctccaaaacatcgtttcttagcagttgttgccacacaaatcagacccaacctcagcgactcactagtcaagattgctatttgacttctctcctcacagaggtgctgaggaaaaggagaaaggagaaaattctgacatgatcaaaaaatggtcgaactcacaccatctttgtcttggcatgggttgtcatcaccagctataaaactataaataaaatgtcatcagggaacaaaactgtatataaacaaatttgcaatgttctatcaagttagagtgcaaagcactgcctctcagaaacaacactgattataactggaaggtggatctttaagtatactgatagtttaagtgcagtgtttgtttcattatggtttgtgtaggagaagaaatcttcctaaaagggtctgctaacaatacaaaaatcacatacgtgccagaaagaatgctgaactgaaaacccagttttcctctaagcagataatgccatgttcacatgattatacaactgaaaaaaaaaacagattaagaaaaagtgttaaagagctttcttgtactgcagcaaaagcatttcaaagagaagataaacttacagagctattacaaatgttgtaaaaagcctaaggaagcctggtaaataagaaagttttaaattactgctcatataaaaataaatgttactgtccatcgttgctctgggtggggatacgcttggcataaggaatacttaagacaatggaaagaaaaaaggcagtgactgtgattctaatccaaacaccatattgttcgcaatagacagttaatttgccatctaatctctctctctgagcatagccccttagtaaccacattcatataatttgttttttcatttaaaattccactggaacttaaaagtttattaaagtgaatggactactccatctgagatgtaactgaggatatattagcagaagcaggctccttagcatctgattaaaatctcagtgttctaagcattggaagtaatactttttccaagcagcaacaaactggataaaaattatcagacccatgaacagagtcatttagcctcattctcttgttttaaagtgttgattgcctgtaagttagtagaataatctcctctcctctctagccaccagagtaagcaaaaaggaaacatctcataagtccacagcctgacaacagccatagttctaatggctctttgaataaggaatacttccacattagaaggaaaaacgacgacaactatgattctaaaaatggaaagcacacacacaaaaattaaaagctcaaatggtaaaaacagctgcgcaacagccatttctatagttttcctcttcaataaaaattgttggccaggcatggtggcttatgcctataatcaaaacactttgggaggctgaggcgggcagatcacaaggtcaacagatcaagaccatcctggccaacatggtgaaaccccgtctctactaaaaatacaaaaattatctgggcatggtggcgcgtgcctgtagtcccagctacttgggaggctgaggcaggagaattgcctgaacccgggaggcagaagttgcagtgagcccaaattgggccactgcactccagcctggcgacagagcgagactctatcttaaaaattttttttctctctcattaagttagtttacaccctcagggataaagaagtgtgattcagagaaagggtggcatggttcacactctaccagcaggcaagaggacccctatctcagtgcactatatggtcccaatgactatggccacgtcactgagagatcagcctcctcaaagcggtagtagagtcttgtctggcattttacttgtactctgacaacaatgtgagatcacatatgatataacgaatatttggtagaaaactgttgacaccagtgcaatatatagttcatgtagctattacagtttgattcattctccattcatcttaatgggaactgctaattctattcatcactaatgacacaggttcaagcaaaatctaaggaaggagtgtgtgagtgtatgtgtgaatgtgcatatacttgtgtatacatgctcatgtatgtatgtatttccctcatatgcctcattaagataattacaactgaaggaagcataattgatggctagaaaatttagcaggaataacacaagggaaatctggaggtttagtacatcaatatggtgaaagacaaattaaaggcttaattaccaaactgtagaagctatttaaaaattatgattcatgttagaactcacaattgagccagccttgtcatcatctttctctttgttttcaataagtgttccttgttcttatcatctaaaacccgtcttcttttttacccttcaaatgcttcttacaattctataattaaattcaaatccatcacaaattctctggataagtcagaatcttaagttggattttgccaattcaacttattaaagaataacagcccaagtagagaaattatatgtgtttcaaaatcattcatatctacatgcattctttctctcccttccttcttctattttttcctttccttctctctcacagaagaaaaacattgtaaacatgggatgctgagtgccatatgttccattacacagaataaaagcaaactcgtttcccatacaatgaataggaaatgtacaccccctagcataccaagtcctactttatatttattttggtctcagaaacgttagaatagccagtctgcaaaaatttttgcaatggttatgtgggaaaagtcagtagggaaagtcagtagggaaaaggaaatgttaaaatcaaagctaacttctaccacaagtgacctctccttggtatgatgtagtctagtggcatctatatttcctccagagcgattatctcaatttaggtgcaacagtggaagtttctgttttaaaccatttttgggttagcagttataacattcaagtggtttcttgagactctgagggaatagataacccaaatctgaacaggatggaggaaactcagtgccattttattttttatttttttatttttggtagagacggggtttcaccatgttagccaggatggtctcgatctcctgacttcatgatcctcccgcctcagcctctcaaagtgctgggattacaggcatgagccaccgtgcccggccctgagtgccatttttataggtactgttcaataaggtcttcaggatgcaacatcatcatattgttataagtgttattctgaaatgttgtggtgtctcacataagctccagttctatattttcaaaagcttataagattttccaactaagatattctaatgctacttaaatttatgttttaaaaaagaaaataccatttttcaatctgcctccaagaaaataggcaactaaaattaggaaagggtaaaaggaatccatgatcatgagaatgggaatggatacaattgcttaggttttagagctggcctatgcagtagtcactagaagcacaacacacagtgtggctggcaactctggcttggttcaggagaggctgatgtctgaggaaatccaatatggtggataggaggtccaagcaccaggggatactccaagtcaagtgggaaatgatctactcattcaaaatagactgtcttccagcctctgggaatgtagggaaaagttttagccacagcatagcatgatcagggttaggtaggttgcaaggacctgagaaggcaagctgcattagagaacatcattttggattttgttcattgaggagctgttgcagactgtttccctgggaaacaaactctgagacagagattaacatgcagggaatttattgcaagggatgaggggaatgctcttgaaattaacaatagaattgggtagcaggagctctggatccagaacagctctgcagaagtgtcctcaattgggataatacaaccagaactttattcccctcatgaattatcgattagatataggctgaccctaataagagtcatgaacttggacaagagtgtctcttcacctgatggcaaaacccagagagaggtagctatcttccacccatattcccagcagagaaaggcaaggagtcctgaaggggagaggtctgatggcacatccactctagtagtagatgcatctactacagatgctcataaaataacttagatagaagcttaatgctgatggtggggcttagggcatacctgaacctttgtgggcacacaagtgtccagggctcactcagatgtacaagatcccaaggctctaataccaacaggacagagctgcaaatgtcctcccagcttcccctcagagcaagtctcagaaatggccatgtgaaattacacatcctgtggcctttggatgatcagctgtttcatatggtctgtatttctctagtcaaaagaatagtagtaagatggacatggcctgaatatactggcagagacatgaacaaaggaagcagaaggcaatgggcaacacacttgtgctcaatttcaggacccaaaactacactgagcaaggggctccttctagacattgttccacagagaggctccctgacccctgttcaagctgttagagggactcgacctctgggtctgaaacataaaaaaccaaagtaggaaaagggaaaatcattcactgaggcatcactgaactcctttcaagtcactgctgtctgggtaaggctagaaacagtggccacactgaatctgcaccataacttacggttggctgactttttgctaatttgtctattaccccaagatgtttggaactaacttcttgcattgttaaatatttcagaatatatatagccaggaaagattcattctttagggttcaactaagagatttgtaactagcaaaatgatgaaccatgaatcaagctaaagagccagttagggacaaatataaatgtgaaacaaggcaatcttcaaacattaaaatttcaagtttaaaaccaggaatttatgattctggattatagcttttctttgcttactcaattggataatgaatgtaaactgtgacgttatggtgcaaaactgtaacccaaggagtgagcgatccagtactgacttgagaaaccaatattacactgtgagatattcacggttcaatggagagatggaaaattagatgccttaaggtctttcttccagcctaaatagaaaataacgtacaaatgtaaagcactggaaaataaaatcccttccagcccaaatagaaaataacatatacatgtaaaacactggaaaataaaaattttctgttgttgttattttattatctttctaagcccctttcctaactcttttccttctttgaagtatcttgaactccttttggacactaaatcttctttgtctgttccccagccagagatccctactaaaagagatagcatgctaaactgtaggcaatttacatgttccggactttcccctctcatttttcattccctcaaggacttcctctctgttaggcaattgaaattacaaaaattaggcattaatagccattgttgcttaatgggttacccatccccagtatagacagatgctgaagttttattccccagccttttagttcctatcattgtatcaaataagactagatgacggtatctccgtaaagccttcaatttcctccctggccccattagatgctctgtttgggttaaatgagaacagcttgcaaggtagttgtttgaacacgactgcattaatcagggtagaaaaaaacatgtagctgatttacagaaagcattagattaacaatttagagtaatgtgaggaaaaaacctcagtgccttataattatagataatatttataaatttcattgatttattaaaaatatatatatatacacacacacaaaacattcagattctagtatttgctatccaataggtacctttattttatattccaaaatgaaaatttatggtggaaatttcaactaaagtaggtatttaggcatacttggatagacgaactttgaaaatgccattaatatcacttacatatatggtggtaatcaaaactaaagctgaactaacttggcaaactctggaactgatattcatgtatggagtttgtcaatgagtaggaaaaatgtatcatttcagtgtgagtttatgacttcctttttgtaaaaggtggtatgggaacattgtctccttacttaatgaaaaatagtattagaatacacaagactgtcaggataattacccagtaaggataataactggaaactaaagacaaagagtaaattaaaaaatgggatgatatggctaataagatatgccctgcccaacagcccatcagactcttctcaccccaactcctgacaaattttcacatagctttggttgccaggagcctcaatacctgctccccagaaggtgcctgtgtgtcaatctctctgtactcaagggggcatgcagatgtttcctgtatcatatctctaggatatctaaggaccgactccttagttctcatttcctagggaggtcaagtctcttaccagaatcctttggggctggcaatgttcatcaccccatcctcagccctctaacttcagaggacagctgacttcttaaaggaatgaagagatctttttcaagtcactgctacttgaggcctcagcaaccaagaagttatacactcctcccacccccacaaattcacatacatgcagatagtagggtagactatacaggtgtgtgagtgtgtgtgtatgtgtgtgtgtatcctcctatatagaggcagaagatttcataaaatatatacatgagatatacatacatgattttatgtataaatacatatagtacacgcatataacattttacatatatatctcattttaaaacatcttgcttttgtaaaaattgtgtgagtatccgatcacaggaatacctttctaatcttaataatttagtggtttaaatgtacatgaaaggtcatcctagctcattataattctagaagagtcaatcatatatccatcaattactttggagcaaactaatggaatagttttaagcataataaagacaaaaggtgacactaaagaagcaaaaataagtctgttaatttccaggaagcttcaactatagaccaatcacattcacagggaacaacagaaaagtaaagctgagctgcagaaaaagtctgcactaccagggtaaaatagaaacaggaagattaagaccaagaaaacttacaaaagaatcacagtcagtgaaaccccgtctctactaaaaatacaaaaaattagccgggcgtagtggcgggcgcctgtagtcccagctacttgggaggctgaggcaggagaatggtgtgaacccgggaggcggagcttgcagtgagccgagatcccgccactgcactccagcctgggcgacagagcgagactccgtctcaaaaaacaaaaaacaaacaaacaaaaaaaaatcacagtggccctaacatgccaagattggtggaatctctatagcagaaactgtcagtctttatattattcttgctagtcaaattccactttctaaaagccagagaaaattcatgcagctgggtagtcctacagatttctgagattctctgagtatagagccatgcaggttctcctattctttccgagcgtctatattcctaagtagaaaatagaatttaagcctctttccaacaatcttaaagatacactagttttgaaattcagcaaaaaaatcagtacatttcagggtaccatatgctttgaaagggagaggaaggcagagaattaacatttcccaagagcctactgtaataaagacagaaaggcacattggataaaagcatagactaggagccaacctacctgtttcagatcccacctctgccattcacaagctctgccatagtgtattgagtgtattaaatgaactcataatattgaagagaaaaggaagtactcattatgaattagctgttgtttttgttactctgtgctgggcccattcttacaagatgcatggtctctcctgcctcagatatgtgccatgctgtttcatttatccaggcttttttttttttctttttttgagactgagtttcactcttgttgcccaggctggagtgcaatggcatgatctcggctcactacaacctctgcctcctctgttcaagcaattctcctgcctcagccttcatgagaagctgggattacagctgtgcaccatcacacccagctaattattgtatttttagtagagatggggtttcaccatgttggccaggatggtcttgaactccaggctcttctaactctcctgatcctttccctctctgccctcccttcatttcctccaacatctcaccttttccagggagcactgctgtgcctctccagactggaacaggtgccagccctccaccataacaatatttcactgtgtcctcccactatgtccctgagtgcagacaatttaagagcacccaccccactccccgatcgtctatcttagagccaggtacttacaaggactctatatgtaccaaagtcgtgagttcttcaagagtcccaactgttattttcttaattattgtataacacatgccatttttaattccctggctaacattcagtaagcaactgtgtgccaggactgttctaggaaatgagatacgataccacataaacaatgtctctgcctacatgttgcttatagtttgaaacattccaatcaaaaatttttgcttgtgaacaaaaattaagtatgtttcaaaaattgaaccaagtcacgtttgagaaacattacacatacggtattttaataattattataaaatatgactgtaggaataggaaaggaagcctcaaaacacttatttaaaaacccaccatggctccgaattctaaagaaatggagtaagcacactcccttgcactaactacaacaaaaaaactcctgaacaaaatacatatagcaactatttgagaactctaaaaataataacaataggtaacttggggagggtcagacctcaaagaatgactcataaagcagtcatttttgtgcttgtttcttgtaaatttcctggtttatattgaggacagccttgattttcaaactgtggaacagacacaaacagaaaatcaaggaaatccaatactttttggctaaaagaaaacggggtgtctgtaggctagagtagacagggaaatcttttttttttctttctccctttttttattctccctgccacgtactgagtcaagcaagtctcagcaagaactgaaaagtatgcaaggagttgcaaaaagaaaaaaactagagaaaaagatcccttaatcctatatatcaagtccttggctaacccctaaggtacacatgtttagaagtgacctgaagctgcataacaagagctttgaaaacataactagaatgtagaccatcgtgcaagtctcagatagtgccaggctggcacacattctgggccagtctgaacaggaccacaaaagttctaagagctaagccaacactggaaccacagctcacagaagggaaggtgaaactcatgttctaagcctaacccggctggctgattgctgaaaacaaaaagaatcatcaattagaggactttaacagaacccaaagtctctcaatgaaagacccaggatacaatccaaaattattcagcatacaacaaaatgaggacattttcaacagctctcgagtgtgaaacttgatcatccatattgggtcgtttttgtcattcttaattaaaacagagtcaaaaaaccagaagggaaaaaagcacccagggcacataacattgctccaaaaatgtaattcatttcaggactggttgctgaaaatgtctgctttaacctgaaaccagttgtatctaatggctactgaggcaaatggctgcaacttaagactagttttacctatcactggcactcaccaatgagagctcatgagcttcccaaaaccttaccagtgctgatatactttctcaaagagcaatagataacatttctcattttttctgtgtgtaaaacctctaaccatatctttgttctttggacatacaccaaagactactcagtttgtgtgtattccttgaattgcaattctttcctcccaaaaaaatatttgtctctatattttgactttgacaaaggagaaaaaacaatgaacagaaacaattcctgagatgatgcagatgttagaggcattagccaaagaattgaaagcagcttttgtaatgatattccatgaaaaaaaaaacaagaactttgaaataaatgaaaaaaagctttaagagaagaaatcataccaaaaaaccgaaaatttaattaattttttttgagacagggtctcactctgtcacccaggccagaatacagtggtgtagtcatagctcactgcagcctcgacctcctgaggctcaaatgatcctcccacctcagcctcctgagtagctgggactacagatgtgtgccaaccctccagctagttttttcatattttttgtagagaagggatttcaccatgttgcccaggttgctctcaaacttctgagctcaagcaatctgcctgcctcagcctcccaaagtgcaggtattacaggtgtgagccaccatgcctgacccaaatggaaattttagaattaaaaaatacaatcaataaaatctgaacattcactgaatcagcttagtagcagaatagaaatgggataggaaggaatcaataaacttaaagatggatgaatagaaattaccaatttaaacaatagacagcaaaaaagaatatggtctcagagacctatgggacactacccacaggtctaactaacacccatgtcactgaagtcacagaaaatgaaaagaaagagattggagcagaaaaagaatatttgaagaaatgatagccgaataccttccaaatttaacaaaagtcataaactgacaagtttaagaagctcagcaaatatcaagcagtaaaataaaaaacaaaaacaaaattaagaagaaccatatgtagatacatcataataaaatggttgaaaaccaaagacacaggaaaaaaattgaaatcagctagagggaaacaaaacattacatatttgaatgattcaacaatttgaatacctttagatttctaattagaaagcatggaggtcagaatagtaaaacggtacttttgaagtgctgataaataaggaactgtcaactcagaattttaaatccagtaaaactatctctcaggaataaatgtaaaataaagagattatcaaaaaaagagagagtaagttggcggcatgcctgttctaaaagaaatgctaaaggagccgcttcaagaaggaagatgataccagagaaaactgtggaacttcagaaatgagggaagagcaaatgacgaggtaaaatcgagataaatgtattatttttattcttttaagttcttgaaaatatgcttgactgttgaaagcaaaaaagaataacactttgatggggttttcagtgaaggtatgtgtaatacataataacagttacaggacaaaagggtcgtgcaaaggacctacatagttaaagatttatatgttccacttaaagaggtaaaatatcaactctaagtagaccatgaaaaattaggcattaatgttgtaatctttagagctatcaataaaaagtctactcaaagaaatacatttgaaaaacaatagataggttttaaattttcaaataatccaaaagtgggcataaaagggaaagagaggagaacaaaacagaaagcaaaagatgggagaaaaacaggccaaaaataaaatggaagacctaaatccaaacatgtcaaaaattacattaaaataaatggtcaaactacaataaggaaagagattgctggattagagagtaaaaacaagacacaactgtaagtcgggtactgaaacccacttcaaatataataatataaaaaagtgaaaggatacaaaaagatataccatgtaaatactaatcaaaagaaagttgggcaatgtttgtcttgttccaaagtttatcttttctgcatcccaattttggtaatgtttacacaattttatgtatttattaatatagaaccatacataaacaattaatttttgtgcatgcaaatttaaaaaataaattaaaaacctacttatagttctgccttcttaatttacttctttgtacactctatggttggcctccatatctgtggaattcaaccagcctcagattgaaaatacctatactgtatgtccaaggaactcatggatatagagggctgactggaggacttgagcatccaagaattttggtatttgtggaaggtcctggaacccatacctcagggatgactgaatactgtataatccaaagcatgaactttctaaattctaaataaatcttttacaatcacacgatccatcctacgtatgaaaaaaaaatgttgattttaaattcaaagttcaatattgcaattccatctacaattaggaacagtattcatctgcttggaacagaaactcaaattaacagtggtttacagaaattatggaattatttttgcattcacctaaaagaacactagaggtgggcagccccaggctgcatgaaccacctggatgatagtggtacatgataccttcagtgtctcagggttacactattactgtggtttgcaatcctcataactacttccatcctcaaggccatccatggtcacaggacggctactgctatatagccttcaggtccacgtacaaggaagcagaaggagcaggtgaagcagagagagcaaagagcctttctggaagttacatcaacaaattccactctccctcccactgaccacctctttctgcagaggagtctgggaaacgtggttttaaaagctacactcactgtcattctcaacagcacagaggtcttgttaagtgaggagaaaaaagggatagagaattactgggtaggcaaatgatagtctagttgtttaaaccactagccacaaatctggtactaactttttggatattcttattttagaaaagcaattcaagtcaggggaattcaacatgaaaaaaaatagacagcaatgaatttcattcatgtatttataaaactagaaccatgtttgtaatacttctgtgaaaggcagaatatgacagttattacaaacacagttgtttgaatacatactaacaagcacatcatatctcaaaattatggcatcattctatctttaggattccaagataatatgtttgagctaagtccaactggatttaaaaacggatgcttctagaccagaaaaagaaaagcagaaagacatgtgtttttaagctgagccttacttcttcatgagaggtttttgcctgctgaccctgttccggtagcttagatgcaggcggtgatgaaaggtcatttcacaacttcacatgttccagatggtgcctctttggaaagaatctctttctggtaaaagctagaaaaagaaacttctcactacttactgcttttagcattttgtttcctgccaacatgaaaacaagccccgatgatgggacaagacattttctcgtaatgtaattgtatccttcgaaacacagtggtgtagaaaacacaaggggacgcaaaactgaaaggaagaaagctgtatccaaggctaggcttttctgataaccagccattcaaactcctacaagttatttccctttagcttctgctactctggacagcttctgcacattttagaagaattctcaattttcttcctttttaaaatgaagcctagagtacagtgacttgtccaagactcagaagcagaacaggaacccagatctcctgactttcagggaaggtccttttccatctcaccaaatggatgatgcttttatgtctaagaaacccatagtcttcacttaaatgtcttcggcttctctgaagaaaaaagaagactgaaaagtgaggttaagagaccaacatgctggtcccagatctgtcaccaactagctatgggactttagggttcagttcctcagatgtaaaatgagagggctgtcccagactagggagagtgctgatgcccacatgtatctggccctgaactttgtcagatattttacatcacagcaggaactgttcttggatcaccttcttaggaaatgtgatcagtgcttcccaacatttcaagtcaggacacataaataaaatgaagatattaacattctacagtggcaaaaatggaagtggatgcttggagctgcaggtgaatctacctgggtgcaagaaggctgaggggaaaccagtgtctcagtgcatctgtaaactcacctgctgtacactgctgggaagtgggggctaagtgggagttcagatttttaatgttttggtagcagtctggaacctgtagctttacagtttttgtcagagccaactctgcatggggagattcccccaggacctctgctgctggatggtgagttggggaggaagggaaatacgggactggggtgaaggtggcaactggaagagctgaagagactcaatacagtgtgagagtagacagaaaagttgtcaaccctcaccaagacaaggagaatgagacaggcctcatgctccccatttatactaatcactcctcctatttagatcactggctgcctctttacaactccctttcccttaaacagtcttttagtattttctgttcacttcagatggatttcatctgggtaagaattttggcctatgaagcactataggatgtgttcggtatctcagcaacaagagatgccttggtgtgggccagtcagtacttacaggcttagataaatacccagtgctcatggaaagacatacagtctagaaacagcatgcttttcatattttatatgagatgaaagagagaaggaagacatgggatcataatctggaggaacgaggctcttagtaactagaaagttcaaagcactagattatttctattctctttccttgaactaagcaagcttttagaaaagaaaagaaatataacacaaactcactgacaccagggatttattcagccaagcaatttccagaggctatcctggaatcatttcacattcagctcaatactctgtatcttccacattcatatcttttgtcctatacaatgataattgatggtcagcattacagccctgaagtcttgcaacacactgaatcatcaaagggagattcaattatattcataagactggatgtgccatagcagcaaaggggacttggagattgagaagggttgaagcaaaagattttctggttaactcttagtaagccaaaattaactgaaaaagtttcagctctatgcaatatactggttgatggagaaatactttaatatttgaatgtgcacaaagaggaacatttataattttataaccaactcagcagcaatgttattggaagaagattttctatttttgcccagtagaaagtaatcctaaacatcttttcatgggagccatcttttattgtcagtaattttgcataattaaaaatatctcttagggttatttttgcttggttattttagaaaactatgaaatacaaaagcaaaaggatgaggaagatcttctgggaattctaccattggaaattccaaagtaattgctaatattttggtcaatatcattgtaatgttctttcatctatacatattaatacatttctaagtttcttaaaacacttgtataggtaaattttcacctaccttttcacttattacatttgaatatctttccatgtattcaaaattcttttacagtgtaagttttaatggttgtagaatattctgtcatacaggtttcagaatttagctgttccccattgttgaagacaagatttgttattcatttatctttctcgcaaacactattgtaatagcctatacctcaggctttgtttacttccatagagacccaatacctagcacaatgcctggtatgctgtaggccctgggtaaacagacagtgaataaattaatgatttcctcagcatactttccagaagagaactgatacatacaagaccatacatatatgatatgtaatactaaaatgcccccagaaatattgaaccaattaatactcctggcagcactgtgtgtatgtgtccagaataagtattacttttaaataacaacaacaaagtcattagttgattatcaaattctgagtaagcatcaaaacatcagtgggaatgtttgggaagatgtcagggcaactctggaatgatatttcttccttgaactggtgaacatcccatataatttacactgctctcagttagttaccctaaggttaaatggtatactcgagatgagagtttttcctgtgctttatttaaattggggactggtaaaatgtcacctactgtctgttttgtaaataaagtttaattggaacacagccaacccgttgcttacatgttgtctacagctgcttttatgctacaatggcagaggtgaatagttgcaacagagaccgtctggctgacaaagcctaaaatacttattatctgaccctttacaaataacatttgtcaacttctttaaaagagcacttcttaaaaaatgaaactaacactacaccataataaatcagctaacaagcatttattgaacactgtgaggcatggtgtctactctcaaggaacttgaaatataattgtggagtaaagcaaatacaaatgtaaaaattagccgaaaaaggtaccgtggcattaggagtcgagtactgtaatgaagtgaacaagtagtgaaagatttcagagacaggagggaaaaggtgggattggaaaaatggcaagatgtcactgagacacagaacttgaattaggctatgaatgaaaagaagggcttggataaaacaaagcagacagagcagactgttctggaatgaagagcatgggcagaagcaaagaagtggggctctgcacagtgtggagataccaggtgggactccatccaaaatgctggcggactagcacatcagaagcatgctatgtggtacagtatgaaagcaaagtgtatccatgatctgtgtatttcaaaggcattcattttccatgtaaagaagccctaaaatacattttttacttaagcaaaaaaaaactctcataaagcaaattaatattttacgctctcttcctacagtgcatattatctttcatctcctcacttctgattctaattagagttctatttcttcaaaaacttgaatgctgatgtaaaaactaaagtgaaagattaggaagactagaaagaaaataagatcagtatcataatacaacaaacaaaagcacaaaaggacaggcaaactgatgttcatcacttaatatttgccaaagcttcctaacaacacatttttctgaatcagttaaaaatacagtatctgcttattttctagtcccttgcatccaagctaacaaatgccattgtaaaattcatgtctttattttttgttgtggtgtatgcattttaaaattcaaaatgttttttaaagcttggaaagaaagatgtatttatagtatggcaattattattcaactcatctttacttagaagcacacttttacatgctacaggtgaggtgagatggatacaacattaaatatattctttctcaatgtcttatatgtaaaggtacaggtaaagatggccttttgggaaaatgtggagcatgggagaaacgttttcctccttttccaagcatagctccttcattccaaggtagtaacaatgacatctgccatcagattacccagacatcaagtgacacagaagcaaggcttatatagcactgtcacagttttaacattttagtttcaggggtacatgtgcaggtattttatatagataaactgaatgtcacaggggttcagtgtacagattatttctttatccagatagtaagcatagtacttgataggtggtttttcgatcctctccctcctcccaccctccaccctcaagtaggccctgctgtctgttgtgccccaatttgtgtctatgtgttctcaatgttgagcttctatttgtaagtgagagcatgtggtgtttggctttctgttcctgtgttaatttgcttaggataagatttcacagcagttttaaatgaagggtacattaataaataaatttatcaaaaatgccaccacagcatttttgatctcaatataaaatgtagcaggcattcctcccagcacacacaggttaaagactgcatcatcggttcagtccatgatttttctgttgacacacatctggtgaatacaatgtgctgaagcaatacaaaactaaaacaaggcttttgatggaagaggtctaagaatcataacatactgagtgtgtcagaggaagtcactcgtgctttttcactaaaagaagctttacaggtgggtgggtggaaggggatggagaacagttcacactctccatctcatcctgacctgggacctccttcctgtttccttggctggtgccagcatttccatctttcttacccacttctgccatgttgaagctcagctgggcattgtatccctggaggaacagtggacagagcaggggctttcctcttttgaggcacctacgtagacagactcactctctctactcggaaaataactgtccctggtgccaggttttggaagttgaaatgttttgagctaatgcctcctgtgattcccgatggcctactgtttaattgtgtaattatagacagttaaaaatgcatgatatgtgatggtgagaaaatagttggtgcttcgggagccattatggattacagtttttgaaaatttaaaacaatgcaatatttatatagacttggctgcactgagttattatgcaaatgccacatcccactctagggccagcattcctccccagaaacgaagaaaggcagatgagaatcaggagagatgccacagtgaccacatggttgggacaacgagcatcttgagtgtccagctgcaggataccctgtgagtttctgtgcctcagtgatgtctgtgcctctctttaagtggtgttaagaaaacccagtcaacaatatctaaataattatttgacagttgctcagattcgctgtaagagaattatatgagctttcttcttatggccacttgcatattagacagggccaaaaaaaaatcacaccaagccaaaagtaccttaggtattcccagagtcaaagcattggcttagcaactatttataggctacacagcttccttgaaggtttgatccactcaggggcttgctcagcaatggcctatctggtctatggacagcaatggaactggagtaatcaggggtgtgctggggactgaggagaatggtatcagtaaaaccaaatggttgtgacacaagacttaacagttggctaaaacctgaagctctggtgaaatattattcatatagggtccttgtacttatgccctacaagaactaggattgattccaaattgtttgtaaacctaagttaaaagcaatggattggcatggatcacgtatcttaccagacaggaagttatcagggtggtggtaggtgctggtgaccaaggcatagactgaattctgcagggagtacaatatacaaacagtgtgtgtgaatgaaaaagaaactctcactgttcattcattcactcgttcattcttttttcatccgtgtgtttgtttcttctgtcattcactgagtcaccgcaatctaaggtgatcccactatgtgtcaggatttgtgctaagtgctgaggatatagcactgatctttgatttcagttctaggaattcacagtcaattgaggaagaaaggcagaagaactttgtttctgactatcagagatatataaaagaacaactctggtgagttcagaggatcttgtgtaactgcctggaggagtcagaaatgacacctaagagaatgtgaacattgagatggtatcagaaggatgattaggagtttctgagcacagaaaacggggaaggcatccgtggcagaggctacagtgttcaacaatgcatggaagcatgaaagaacacagtgttttggagaactcacacattatccagggtggctggataaggaaaaagaagttgagggagaggaatgtggccagggaaccatgcacatgcctgggaatgggccttgaatgtcacagtaaagaaaatgaaacagatctggaatgaatggtgtacagtttcatcttgggacctgccatcatcatttagtgtaatgacatcatagaagtattcaccatgtgcagagcaaatatatacatgcaagaaacaaaatatcatggatagttaacattcagacaggcttattttcaaatctggattctatttactgtgtgacctagagcaagcttctgaaaccagcagaatctccatttcctcacctgtaaaacatggatgacacatatatggtgggcttgatttcatgaataaatgggatacagtgaggaaatgcttcactaaatgtcttcaccaggctctgaatctcattcttgcttcactaaccttaagcacatcgaaatggtataagcttctgagctttggttccaaaagttcagtctcacctctgcctttcaactgaaataaacttcatacatcaagctttccactactgaaagcctcctctttcaagagacttacagccaccattcatgacctcagcatcaggacacagaacatcctacatgcttagctgatacacttaggcatatgtttacatgttcccctcaaaaatttcaaatcgtttttcatatagagagacttcatcgccttaagtggaaggataatgttgaaggttcacagtaaatccaaatatgatcttgctgattacaaagtttaacaaagtttttattaaagggcctgatgtttaatattttaagctttgtaggccacataggtaggtctcctgcatattcttcttcttttataacaattatttaaaaatataaaaaccatttcttagctagttggtaatacaaaaacagtcagggtggggagatgggaagggtagttttggcctgcaaactgtagtttgcttacccttggattaggaaaataacataacagtatttgatagagctcataacatactgcttcagaggaagcaatggctaaaacatagtactgctaagaagtccccaaagtgtgtgaggctctcttagtaagcatcaggcacctaccacctgcagcaacattttagagatgatgcagcatttaatagaatcacaaagcagtaatggtctaggttgactttaaattgttttggtattctaaaaaataaaataaagaaacttcataataagtatggcaattttttaaacagtgaaacagatacataaccacacacaacatatatacacacacaaaaataaaatgtgcaagatttttaacagtgcttatttctgggtaatgggattgactgggggaagttaaaatgtttttcatactgttagagtttgaggtagcataaaaaaaagctgccagttccttttggtctggtcttggaatcaactgaaagagatatgtcaggtaaatgcagaatcaaatatggcctgtataagtgatgtggcagttagagcatgtgttataggtccttgagtgggcaagctggctaattaattcatcgctggtttccataaactggctcacccttggagaactgcaggtcttcgctgcagcagcaggacccctcctgtacagcagaggaaagatgagaatacacagaccacagtgaaaactagaaccagatgtcactccctaccctggggacaagtagatgagaaaaggtaaaggaagccaagagtccattacattggtaataagggtcccccaacatgcactgatttaccacagataagaaccaaccaggaagtgcaaaaattcccaagagattgaacaatcaatacttgctaccagaatcttcttctctcagtagtttctagttaaagaactgctacttctgtgtgactttggatcaatcagttcacagctctaactcatggttttcatgagcaagttgtaggagctgcactaaaaggtctattgaagtcctcttccgccattctttgtcaattactgagctctactgcataccaggtgctacccgtgctctgggaatacagttttggacaagataaactcagctgagaagttttcattttagtggagaaaatatctaaacaaacagctatttttatctgatgcccagctctattccattttccttctgaagcaaagtaaaataccacattaaagaaatttgaggcagaagtgactcacaccggtaatctccgcactatgggagaacgaggtaggaggatcacttgagcccaggagtttgtcaccagccagggcaaaataagtaagaccttatctctacaaaaaaatctttaaaaattaaccgggcatggtggtgtgtgtctatagtcccagcaactcaagaggctgaggtgggaggatcgcctgagcctaggaattcaatgctgcagagagctatgatcatgccactgcactccagcctgagtgacagagcaagaccttatctctaaaattataaataaaaaaaaatttctgatccattaacattattttgcttaattttctcaaaaataccagtagagagatcatacatgttttataacaacataagaaataaaactaacttttcatgtgtgtatcagcctgggaaacaactactaaagaggaaagagaaaaccggatttgttgaaagtttagggaacattgggggcaagaaggagatctgagatgattttagacacgaacattttatatttccatgcatcatctataatacaggtatatacttgccaaacagcaatgctatcatgttgacattgcttgagtaaatttttaaaaatctagaaaagtgatttttagatgagggagtgtgagaagcagaaaccaaggagaattctcagacacagaacttgttaaaacacctcatcttgagatctattaatctctgagtttaattaaaagtctgaatgaacaaacttattttatctgatttggttttccttctgataccaagttccatttggttttccttctgataccaagagaggttgctgaaactttctcacctatttacttgcatttactctttgtaattgagtgaagacctaatgtgcgaccccctggggcattctatagctaaactaaattactggtgaaatttacaaatccaatgacaaagtaacgcaaagaccaaaaagaacagtctaaaaaaattgctccttctctttttcaatcaatcctcaggattaaagggagaatttattgataaagacagagaagtaatctctgatggagcgagatggtgtatcagtgttctccatattcgttcaattaatagacttcactgtatgcaaactctgataagtggatgaaatgtgttgtttcttaatgatctaatttgtattccagcaggatgtaggctctgctagacaaacatttcgcttggctatttccctccaaacatttatgcctcttggtgtgctagccatttattttgacagtggggcttgatgcacatctctactgttaatagctctgcaaacattttacaacaaaaataccatacaactggaactaatctcattattttccatgttaataattcttacagcaacagaagatcattaaaacccagaatggtaatgcacagatgtttaatgtagatgttcaagagctcctagccaagtcattccttcactgcttttcacaacaaatatttactgagcaattactctgttgcaggcactgtgttgtttgtacatatttttaataaaacaggtatgatctccttctttacggagctgccattctagtgggagagagatcactgagtttaacaaacaagtaaatgactactcataagttgggataaattttaccagggctgtattttccctcaccataacctcccttaacatgcctcctctctcactattaaaaggcggcttctatcatttgcttgtatgatattcctaccacttacttatttttcatctccagttcaaagattaactgtagaatcttcacaccgatctgatgtgtaagaatcaagtaattggctcctagaattccaaataaatgaagataaacatagcccatgcttcagagttggcacgggcactaaacaaaggcatacctcattcacatttttgcagaagccccttgaatatttctatggcctccagtagttggtcctcattctcccactttccagtcttacctcatttgtcccccgtacgtgaagtacaatagctctttctgcaccaaacctctcacccctcttcttttcaaatgaacctcagggtctctaacaccaagctgttcctgtctgaacaagctctcctgccctctcttaattctccttataccttccttaccatacctcctactctaaccacccagagagagaatgctgccttcacattttaaactgtgtcatataatttatggtagtgttttccaaccccatcagatgcaatgttccattttataacaaatattatgtaatgctgcctttactatcctgaaatgaaattaacagataatataatttacctacaacattatttcaagaaaaaaatcaatatgctgccctaactgtaatacaaaggagaaataaaagggaagtcatctgtaataaaacgatatgtacagagaaatgctattctagaatatagaatgaattaagcagaagctcgcacctacctataatgaataattttgtatttaaaagaagaggattatttttgaacttccatacaaggcgtacaagaacataaaagaacacaagtagaagctgacactaaaataaaaactaataaaacagaccagacttatctgtatataggaaatagagggaaaccaccttaaataaagtacagagaagatgcagagacaaattacagactgtcaaaacagagatgtgagaaaatatgatgttcctataaatgacccaagacatatccaagtcttaacattataccttgagtatggcatgcaacagggtagtgataaatatcatagaaaatgtatctctcatcttaaaatcccaccacctgctgaagtttccattcagtctatagtactcacaacactttggggaacatactctttagtgggccattgcacataaaacatgaatgggaatgtgacaagtacttcatgtcaaaaatgagaaatatttttaaaacaagctttaataagtttcaatgaggtctattgagtttcatgtgtctccactaatttaatactgtttgattctaagtatgtgaatcatagtttcccatcttgtttactacatatttgtatgtggcaactataagtggagactgatggctcaaaaaaaagatgtcttcttgttaacttggatggttcaaatgatgcccctgttgagggcatagtctaccaaaatggtgaaaaacacttgtcatgctctgaataaaacaaagtactcttcatttacaaaagagatgcattctaggaaaattcaatgtacattgaaactatggaaaacatatcttgtgtctatacaaaaaacagagttaggttctagacattcatttgtacatacacaagtgtccagcagaaccaggggcaatttttgtttgggaatctttattgcatgctaaaataaccatggctttcctggttcccacatattaaaagatcataacacacccatgataactgggatgacaacaaaagttccggtaagctttcaatatattgctaatgggcagtactttcctagtcaagacctttgttttgtggagcgtttctacagaggagccaaaatctcatactattcagtcttttctttctcccctatagcttagaatcttcccaggtgtccttcaaaatgccttgctaccatgttctcacaaaatgcaggttctaggaattccagatctggcaggctggaaaatgacccctgaaaaacatatctaactccaggccaggtatgtgtctcatgcctgtaatcccaacactttcggaggccaacgtgggaggatctcttgagcccagcagctcaaagccaactggggcaatacagtgagaccttgtccatacaagaaaattaaaaaaaaaaaaaaaagaaaagtctaaccccagaactctttgcagttgtaattaggtaaaggatcctgagattaggagatgatcctgagatatctgggtaagctctaaatccaacgacaagcattcttataagagaaaggtagaaagagatttgagacaaaaagaagaagagaagacagtttctgcctccgtggtcacactgccacctcttcgttgtggaggcagtgggagaccatggaggcagaaactggagttacatggccacaggccaaggatggctggcagccaccagaagctaaaagaggcaaagaatagatttccccttcagagcccaagggaatgtggctctgcagacaccttgattacaaacatctggcctccagaactgtgagacaataaatttctgtccttttaagccaccaagtctgtggtaattggttatagcaaccaaaggaaatgaatacagcagatgagttagacactggccagggtagaagaaaggttaatatcatgctttgtttatgtgtttgttttgccctaagacttctacattctctgaacacggttggagacttggcgggggaaattacagaatagagaaacctctgttctatttcaaacgctctactcagcttccctccactccactgtccttcccaggtaatacctcgctgatgtggtttgggtctgtgtccctacccaaatctcacattcaattgtaatccgcagtgttagaggggcttggtgggaggtgactggatcatggaggtagatatcccccttgctgttcttgtgatggtgagtgagttctcacacgatctggttatttaaaggtgtgtatcacctccccattcatgctctcttcctcctgctctggccatgtaagatgtgcctgcttccccttctgccatgattgtgagtttcctgaggcctccctaaccatgcttcctgtacatgcctgtggaactgtgagccagttaaacctcttttctttataaattacccagtccaagatatttcttcataggcatgcaagaacgaacgaatacattcactcagcctatggatcttagcttgagatttccttccccatggaaacctttcctgtccctctccagctaagtgagattccaccacatgagctggaatagaattgttttcccattctgcagaccactcacctcattttaaaactaaacattgactacaatgagtcctcagcaaatattggtttaccccactagaatgtaagctcctctagataaagggccctgggtatatttcctcaccattgcttttctctgtggcctggcatggtactcacataaatattttatgaatgaatatttagatacagtcatttacagatgttttggtttaaaaaaagatgcttggccaggcgcagtggctcccgcctgtaatcccagcactttgggaggccgaggtgggcagaccacgaggtcaggagatcgagaccatcctgactaacacggtgaaaacccgtctctaccaaaaatacaaaaaattagccgggcatggtggtgggtgcctgtagtcccagctactcgggaggctgaggcaggagaatggtgtgaacctgggaggcggagcttgcagtgagccgagatcccaccactgcactccagcctgggtgacaaagtgagactccacctcaaagaaaaataaataaataaagatgcttgtcagtcagctttccagcagcagcaataaatttctttccaggataaagccatgttttgatgagtacattcttctagatactgtacttacaatacccatttcaatggtctcatcaccccaacctctgactcaatacttagtgtttgaacatgatcagttcatggccaccacagtgggttgaattgtgtctcctgtaaaattcatgtctacctagaaaaaacaaatatgaatttatttggaaataggatatttgtaggtataggcagttaagacaaggtcatatcggacctgaaatccaatggctgaaattgggcctgaaatccaattgggcctgaaatccaatgactggtgtcctaataaggggagggagatttggatacagcagaggaagatggcctcataaaaaccaaggcagaagttggagtgatgcagctacaagctaaggattgccggtaacaccagaagctaggaaggagcaaagaagaattcttccctagagccttctgaaggaactcagccctgccagcaccttgattgaagccatctagcctccaaaaccatgcataaatatatttctgatgtcttaaggcagtaagtcctaagttaacatttcaataggttcttggaaactgcaactttaagtgaaacaacatacagcaagtcctaaaataacataattttttttcaacgtcatttcattttaacattgatgaggaaaataactggtttcattatgcatcgttttgcctaaagttgcagttcccaagaacttatctactgtccttcattacagtggccctagaaaagtaatacagccagtaaaccactggtacgttttatggttttttgcccatgtttcttttataatgagtcacctcactgagatttgccttagtaacaccattcctttcaatcagttccagccattggctaatgagatggcacaatcagaattagaggaatataggggttcaattgtagaaaaagactgcaaaccagtataatctgagcaaggcagcagtactacacagaacagctcaggtgccaggtggttttttgtttgcttttgcagttcctgcctctttctagttacatgctgagctctgtgccttaccttcctcatctgtaaaatggaaataataataatcccttccttgtagagttgtgaagattaaattacatgctgcatacaaaatgcttagcatagtacctaggacaaggtaattaagcaataaatattagctgttactattgctagtagtggcaggggcaagggtcaaaaataatcatttcattcaattaaaaaacaaaggcctaaaccctaagtatgtgatggctgtggtagacacctgaaaaactgaatgcttttattccatgtagtgaagatcttatttttcttgcagattattctggagtttgactctaagagttatctttagatgcaaaaagtcatttcattttaaaacagcagtgcctgaataccacttatgttgcctgaatttgttcacattactattcacgaagcttgacatcctgcaatgacttctgcacaaaactcaaagtcagtaaaactttaggctacttaccatcaagacagggaacaaacccttctctctgcaaggtttttataattaaacatcatgacatctaatgatgtctacacagaaccgcttctcactagcacagaaaagttatctctaatagaaatgttctttctaaatggtaaaggagggagcatataaatatctctgcagtggtggcttctggtatagctggtcagagtggacaggacacataccaattactgttagggtttgcaaagaaaatagttcccattcatttactatttgatagaggagaagggatcaatgagcatgaaatatgccaacttataaattcatatttctaaaacctaaactaggcaaggagtaatgttcacaatgtataaccagtgaggatggttatgcctcactgtactgcccaatcagaaagagtggacactggccttaggcctggagcagtcctggaaggtccctaccactgcagatgtttgccctttacttgctagatagcaggaggtctgaggctctcagggagaggcaggggctccaagtcatacaggaatgggtaggcactccagttgactgaaggacacacagggggtttcaggcaatggctatttgccaagcaatatggaagtattttaatattgtaactgtgtggctctaaaggcaccaactagtgaacattgtcgccggataataccatgaagaattagactggcactgtgaaagtgaggtgaatcctaaggcagtcacaaagcagaggacagctgagagagatataggagggagccattgtggattggtgtatgcatggtgagttctacacagaatcagggagccggagggtttgatccctcaaattctattttagtatttggtattattttctaattatattgctgcagtaacaaaattcctttgttaaataattaaaagactccttttaaggctaaataccacctggctcccaaattttggtctactctccccggaaacaactccttattacaaatttagtagtctcattgcaggtatctttccatgtatacttatgtgcatttggtactgttttgggtgctatgtgtttacatatgtggtgggcggaattgtcaaatgctcccctaaaatgtcctctctcatccctagaactgtcaagatgatgagatatcacaccctgattatgttatgagacaaaaggaattttgcaaattagttaaggttactaataagttgactttgagttaatcaaaagagatcatctaagtggacctaatctaatcatacatgccctttaaaagcagagttttctccaggtggtagcagaagggaattcagagagattcaaagcataagaatttgatgcaccatcactggctttgaagatggaactgaccatgtgccacggaatgcagatgacccctagaagtttagagtagccccctctgagagcaagaaaatggggacttcactcctataacccccaaaaactgaatcctgccaacaatatgaatgagcttggaagcagattcttctcagaacctccagataagaaccaagcctggctggcaccttgatttcagccttatgagaccctaagaagagaacccaggtgagcccactgagacttctgacctccacacctgtgagatcataaacaggtattgttttaaggtaaatttgtggtaaactgctacacagtaacagaaaatgaattccatatatcatcctacaatttgttttaattcaatagtaagtcttaggaatctatgtgaattaattcattcctttgaactgttccatagtattccatagtatgtggtaaaccattttcaaggatggctgccaagaactgcccccatcactgtgcaaaccagctccttctcttgttattttcctgctcttagaatttgggtcaggctcgtgactggttttcatcaacaaaatctagtggaggtgacattcaagaacttctgaactcaagtctttacagaccttgaggcttctgcttttgcccttttgagattgaagaagcatgaataaaagctcaaactaacctactgaatgatgagaccccgcatggcaggggtgcagcccccagccaagcttcagataatctcaggagactctatgtagaggagaggaaccactcagctaagccgggcaacccagacaactgtgagaaaaactaaatcattgttgtctaagtcactgcattttgagatggttagtataactctctatgtgctcaatagagacataatagcacatacatcatgagtagataaattacgactatcccaattcatccattctcctattgataaacagtgttgtgttttccagtcattaaactggaccatacgaaattgccatttctataagtgaaaactggtctaatatcagcaatcttacaaacaaaccactgtgagtacttctccccatgcctctttgtacacacggtggacacatggcctcagggtgagaactaggcagaagaataggcatccacaaggttggcacatttaaaattttaccagatgctactaaattacccacagactgattcctatcagtgtataatacggtgttatatcccttgatctatacatctctagaaactccattataataaaaatggttatccaggcctcaaaatgcagcaaacctaatacgaaccaatctaaacctaaagcagtgttggcaaacctgatataaaatttctgataattaggccaggcacaatggctcacacatgtaatcccagcactttgggaggccaaggcaggtggaacacttgagaccaggagttcgagaccagcctaaccaacatggcaaaaccccatctctagtaaaaatacaagaattagacagatgtggtggtgcgcctgtgtcccagctacttgggaggctgagggaagagcattgcttgaacccaggaggtggaggttgcagtgagccaagattgtggccctggactccagcctggttgacagagtgagactctgtctcaaaaataaataaataaataaataaataaataaataaataaataagcaaataaaataaaatacagtacaattcttgataacccaaacaacatttttatttgacctttaaatattctgtggcaggtaattattttaggaaagatagatatggcttcctatttgtggaacagttaaatttatattaagttgagtttatcttccatgagtaggcctcccctaggtggtggaagtaaaactgaaatagggtatacagtgggagagttttagcagcctagaagttcatacaagttcaaaggtactagtcgctaatgaatgaagacacttcactccgcagataatagtgttatctatccaggtgccaatattgtgataacttggaggctgaacagtacaataatatttagaacatgcttattaaggggtgacttaataaacttttatcttaagcagagactctctatacaatacttatgtgaggtctattgtacttatgtccctaatgtaagttcttttcttcctctgcagtaatacaaatctagctgggcacctgaccacattgcccacgacatttggagcgaggcatagccatgcctagctaagtttgaactgacggaacaaggtgtgatgtgtcacaacttctagattttagcatgtgacacccttgacccttcacaatggcagggaggcaaggaggcatggagcagctgccttggactccgagatgatggctatgcacagagggtggcagtgtcaccccataagccctagtcatctacttctggatgctaaagtgagagacaaataaacctctctttttcaaatctctatagtttggagttttgtcattatggaagctttacaggtatcctgagttggatttcagggtttctagaaattcacacaaccaaccagcatcatctccatctctttacagattcctgaagttatgccatcgcaatttagtttctttggcttgtgatttccagcctctgatgaaatgcaagtatctcaagaaagagtaaaactgtaagctcctaagacattaactccttaatgttttcttgatcgtcagaacctttactcgggattcaataagaaagaaaggaaaatgcaagttccttgagtatttggtggatggctccaacagtaggggaacagcctcttaaaactaaaggaggctaaagacacaaagaatacggcaataatcaacacctgattcacagtgtggccacatgtgtctgatcccacagagactgcaaaatatgaacccaccttgccctagctgactgggagaatgctacgacatagagaggaaagaacatatgctgtggctagcttcatttatctggggacttgtcctcagagcttgtgttgtttgggattcctgatgagtaatacgtgcattttctacatctgggtgagtcctgttacccaggaaggctgctgacactaccttgacccagtgaaaaagctccatgatggcaggcacctgaaaagtcactggcttttggcaatctttctattatatgatctcctcaaaagttgcatatgtttagaaaacacatcaatttgttttcctcaaagcaaatatgcagaaataaaattttaagaaaggcacaaaagtaaatgagagctattccaaagatgaaaccgaaagtgccttctgaaataccagcataaatacctaaagtaagaaaatttccaacgtaatgtgtttttaatcagacacatcaatctaaagtttctgcaacatctgcaaacttgaatgctattgttaatgtgaccaacgccttaaaataattgcattagggtttttggcatcactttataataagtggacagttaattgttgctaaattacagctgaatctctgcagaattggatattacatccatattaggatcgaatgactccatcatgattaatgatactgcagtgagtaccaagagaattaaaattattaggcactaattttaaagtgttgacatttttccacaattttagagttatgtttcaacaaaacttcccaattaaacttactgctcgtggttactgggtaaaattccgagacaaatattccttcaaagatcaactttattagtgagtaaacattaaaattaaaaaaacattttgttgaactatccaccttatgtaactaatagcagatgatgtgttttacactctagttatatttaaataatacagccatgtaattaaagatagttggccataattaaaatattcataacaatttcctttcaaaacattatgtgcaattcagactgcatatttgtagtaagctagaaaaaagaaacacattattagttttagagaagtacatgcttaattatcaagggagtttctgcagattttaaagaaattaccaagagcacaagcataaattggtgtttaattgtttctggaagatgcttaggttataaaatatttcaaaatatttcctaggagacaacttggtaacaattcatcagacacagacttggcagtgtcacagaaaagtaatcatgtacctaaaaatgggcattaaacagacattcatggaaaatgacttatcttttacccactgttttagtattactgaatattagtttctaagtaccgtattgggcaagttactgtggttctttgaactagctattctaagtcccaagagtaattttgcaaatgaatgaaaaatgtaaataatttaagacagtaagaatatatagaaaaaaaagctctgagctcataatactaaaacagtaacaagttcaaattttgtattcatctctgatttacccagtggtctccacggaatttgttttctgcacctgaatttgattattttttttccagggtagtttcccaggtcaaaataatgtaaggaagataaatgagataatactgagaaaacattttaactattcaaaataaagctaatttatttcctcctgtgtttatcactgtgcttcaaaaccctgtcctgatattctcagaaactcaggtataaaatgaagagatatttaagtacatattggggtcactgccactaactagctgttgatctctgctaaatttgccccatgtagcttctaaaaacacaggtgatttctcaaacatctttgtttttgtggcccctaaaatgcctaccaaatgatcagatagatagtactatattctcaaaaaaacccttttcaggcttccagaattctggtagtcttcatcccacactcccctattgaaaaatcacaacttttttccttaaccatccctttttattgttaccccatcctcttttcttatttaattcactagaataggggttggccaagtatggcctgcaagccaaatatatactgctgtctgcttttgcacataaagttaagctgaaatgcagctcttcttttacctattgtctatggctacttttgcgctacaaagtcagaatgtctgtgacaatgatctacggcccactagcttagaccactcacactggctttttacaggagtctgtggacgctggtattgaatatgcgttctcagtgtttctgtgctgaggatctcctcctacctctctaaagtgcagttgaaaatgtctaagacaaaagttaacagggtagatgaggaattactctttgtgaaccatggggatacgtcaataacttccttcaaataatctacaagcatttcaagtacaccgaatctcccaaaagggagtccgtagaaaaggtaagctatggtcaaccacttgatctgacagctggagtggatcccactttaattaatcatgttagctactgattattaatcacctgataattatattttatccatcctattactctaagttcttttgctactctgcatcaaatattttatgtacattattttacttggtccaagcaataatcatatgtagttgggccattttacagataatgaaacagaaatttagaaggactttgttcaaggatggacaactagcaaaaagcagaactgggactgagccccggactccagagtccagacgtggtagggtaatgtcacctaggtcttttccattgcctctcaccacactatgggcactcaaatcaaaaaagtaaaaattgggttgtagcaacagcgtaagaaatcctttttggttataacaaacttggaagaagtatctcatttaaactccatataaattacattctcaaatgtaatttatcttttgatcaaattaggagtaatacttttcatttaagcagtttaaatgcactctcttctgtggcttggaaaaaaaaaacttttgtctcaaaatatttccttacaatggttttcccagtacagatgtgagattatagttacctttttaaaatattttgttgacgtttgtattcttaaaatatttttactatatgcagaagctctttagtttaattagatcccatttgtcaattttggcttttgttgccattgcttttggtgttttggacatgaagtccttgcccacacctatgtcctgaatggtaatgcctaggttttcttctagggtttttatggttttaggtctaacgtttaaacctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggcgttatttctgagggctctgttctgttccattgatctatatctctgttttggtaccagtaccatgctgttttggttactgtagccttgtagtatagtttgaagtcaggtagtgcgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggaatgttataaagaaacagtgatttacaaacataaaatcattattttcaattcaattcaaaaaatacaaaaaacaaattctgaggcaggtagaaaggcaggctcttgatatcaaagtaagtttctggatgtaattgaaagactgttccaccaagtgttcacattcagatagtggtgtatgttgagctaagtgggaaaggctgttaagaagtaaacatgtctgacagggtgcgcaattgcagaatgtgatgaacctgactccgtcatgtagcatgcaaatcagtcactaacatcctcgacaatacataagccaggctcagcagagcactcccagattgtgaaaatttgggagaaaaaaggagtctctggggaaaaaaaataaaagactggaaaagtgattttcaaaactgtgtaaaaactaagcacataatgcaatgattataggagaaagcatgaggtcactaagaatgaattgtaatacactgattttttctttttttctttgttttttttgtttgtttgcttggtttttgaaacggagtctccctctgtcacccaggctggagtgcagtggcacgatctcggctctctgcaacctctgcctcccgggttcaagtgattctcctgcctcagcctcccgagtagccgggactataggcacgtgccaccaagcctggctaatttttttgtatttttagtagagacggggtttcaccatgttagccaggatggtctcgatctcctgacctcgtgatccacctgactcagcctccccaagtgctgggattacaggcatgagccatcacgcctggcctttctttctttcaatacactctttagcccaaggaaatgacataggtcaaagcatcagggaaggaaaaagggaagaaaaaaaccgttttgttaattagcttcctgaaaatattttgtaaactgctatttgtccaagatcattccgctctctcttaaggatctttattccaaagtccaggtgctttgctacatctccctccactactttatttacatctctgttacctccatgatcatgcctttggctctggcattgctaactggatcattcttaactgacaggttagacaagcatgtaaacacacacacacacacacacacacacacacacacacacacacacactgtacataaacacaatggctgcatgggttctgtacactaacaataacaaggctctgaagtggtatgagttcaagactgagctcccagagagctggattcaagtcccgtgaatgcaagaggagactttcgaaatgccaccttccctctttgagcctcaacctccccatctgaaaaatgatgagtttgaatccaaggatattcctttcagctgtaatattttatcacctagcatatcttctacttcactctatttctagagtgctaaaaactcatttcttttcatttttcccagtgagaaagatggatagctttcccttagcaatctcattacatatttttacatatttgttggttattatgttttccttccatcacttttctacatgaatgaatggtataagttatcttcatcttcaaaagttctactattctatgtttgactatttttctttacagttactttttgaatactatttcctaaaagctgtgtagggcagtggttaagaatgaaggctctgaacatagactgcctgggattgaagccacttgctcaaggtaaaatttcagacaggttatcaatatggttaaatattcttatttttgaaatgaatattataattgtgccaaactctccaacccctgagaattaaaagagagaaagcattttgagtgcacactggatgctgggcccataactggcattatttatatggaagctgttggctgggcttgattgcttatacctgtaaccttagcactttgggaggccacagtgagagaaccacttgaggccaggagatccaaaccagcctggtgaagacagcaagaccctgtctctacaaagttaaaaaattgactgggcgtggtactccagctacttgggaggctgaggtagggggatctcgcttgagcccaggagttcgaggctgcggtgaactatgattacactgctgcactccagccttggcatcagagagaggtgctgtctcagtcagtcaatcaatcaatgaaagctgttattattttgggtggtgatgctggttttggctcttcctcatccccacaaagtccgagagaactagtgctttaaatgtaatttaaccaaatgagcactaaaaaggcaaatgagaaataactctatcttcttaggtaatcatggtaccttcttttcaacaataaactgaggtgacttttttttttatcatgtcctacactcttatcttcaactcactgtgcccttaaagagtctttccatatttctggcccagagctgcccctcccaagtggggagaaggttcttaccttcttgacctgaaacaaaatcattacagaatggggaaaactatagatctaaaaaaaaaaagtataaggagtgatttcttaccaaataacagagaaatcagccagctccagcagcaccccaagttggacacagagcacagcgtcaaagagatgtggctacaaatcaaccagaactgctacctgctgaacacctaatttttgccaaatgtttaattgtacatcctggactatgtcctccatcagtgaacagaaaaccggagatgttattggtgagaccagaatttcactgtttgataaaggaactcagtttctacatttggagttggttacctcatcctgagcaaccaaattccttaatgaagccagtctgaagtgtggacttcagaatcttgactgtgcaaactgtacatggaaatgacattggcatcagtagtctgcaaaaggcagcagtgtgaattgccatgtttttcatttatatctcatgttttctttttcttccttaattcccttcagggcatgagcccatgatccattacattactgttccaacttcccctttgccatggccttttatatgttttacctacttatgcaataacaaaggtatccttattcatccacacatataattcctaaacactcaaagatcatttcactcactctggtgctccttcagctgtttcctttaggacttttaagtgaatttcactggacctcaatgatttcgacacattcaattattgaagtgtgccttaacctgcttcttccagatgtgaactcactcacttgttcattaactgttactgtattaccatccttttgctattaaccttccttgtgaaggctgaagcaaaggagctattaaggattttacagccttcctgccatgcgcctgctcacactctctcccgctaataagtagcaggcctcctcctttggggtaattctcttctgtcttgacaacatatgcaactactctgtttcacctcattttctaggaaatgcatccttttgtatcttttacttcatgcctttagtccttcatatttttattgtatctttagacaaacttcttatcaattacacctaaaatatacttatttcctcattaaaaattgttcatgaaaaaatgtatcctcataggagttattctttgtttttaacattcaaccactgaacacagatgcttagaattatttcatccttgatttgctaagggacattacttttttgtttacttgatggtttagaaagacaataaatacatggacataactactgtctttctcctctggttttagtttgggaaattctaattgttctcatctataagagaataaaatactaatttgcactcaaatctatccaattgactttctcactctacatgggagaatttcctctctctactcttttgaactctttatttccttccctctattcccttgcctctcaaaactggccttcgtctgtttttgccattttacttgcattggtaggttctccattcaaacaacccagccagacacagcccatccactgggcattccaccacactaaacagtgggatgacagaatctaagaggaccagctggtttcaatgattgaattcagtgagtgccgagtggtgttcaacatatgccctgataggcaaggagcaaatgggcagagggtctgaaggaagcatttaaatagcatctcttaaaaaaatgttgctgttgctcagtttaaactatctgcttatatattctgggattaagagtttttagtgattttttctccctcttcctaacatgtttatattgcgctttcacaggcatagaaataaaacataaagcctactcactgaagccaaaatattaccatatgtgctcttctcaccgacccatcctccttctacctaaacccgtccctcctttggaagctctcttctccttttattaaaaaaggaaaacttctgggaggtcgaggtgggtggatcatgaggtcaggagatggagaccatcctggctaaaatggtgaaaccccatctctactaaaaatacaaaaaattagccaggagtggtggcaggcgcctgtagtcccagctactcgggaggctgaggaaggacaatggtgtgaatgcaggaggtggagcttgcagtgagccgagatgccaccattgcactccagcctgggcaacagagccagactccgtctcaaaaaaaaaaaaaaaaaaaggaaaactacaggaagctgattgtattagagaagaagagcattaagtgtgggctatgccaggggatacgttttagtgggaatggagaaaggatcatcctactacaccctttagtaggcaacaggaccagaagcacctgctcagtgggcaattatttggggtgtatttataaggcatcagcccaaatgctagttcttccactctccagaggagagataaatgcttctcattcatgcagatcccgagtaaaggtcaccctgtttctgaaaacatgtgaagagtgatatttgagttaagtcatttctaagtaatgactttcttcttcttcttgaatgctattgggaagtggtgaggcagaacttgtgtgactgtaaaaacagcagtttttaaaaatatggttagactagactattggaagagggaacagagttgtggaaacagctgctttggaagtttgaaaaattttattgactcataaaatgttatagcgagaagtttattttagaaatgaggaaaccaagaccctaaagcattagagaaattattcaaggtcattaagctccttatttatcaggcagaatcagaatcaaaagtgaatggctggcaaaaaccaatcttgtgggttttccaatgtatgacaacgtctcccttcttttctaacgtgaatcttttccataacttatccttacatgggagcaatttttagcctgctccactgatgcctgcctctaaaatagtgtagagttgtaaaaaaaagtcatttttacatcatcaaaacttctgaaacactgagtcagaagggatcatctaaacgctcttctgcctgcaggtgaagctggagcaaactcttcacactagaccctgcaaagtccctcagggtagaagggaccacggccagcgcccactacctccttgtcatcatctaatcttcataacctaaaaagccaccaatgggctccaacagggtctgtgggtcatgactgtggctgcatgtcgagtcatggtctctgcactcacaaattttgttttgcataaaagctgtattactgtaaagttgtaagacttagtaaaattcacattttggacattttaattcgagctcaaaagcagcagagatccctatttaaaggagacttgcaataaaactacacaaaatgtaaatacatgtgttaatttaacgttagtaaatccatatgttcttttgctgaattatcatatttagaactttgtaaaatagcagtccatctgcatggagtgaagaaaatgcccttgaataacctgatcagccatgctagccagcccatgacaagcacctccaggcagacacttactgagagccactatgaggcgggtgctgtgccatgttccctagatacagatataaatatatagtgccttggacttgggaagctcaaatctggtaggggaaaatagacttttaaaaaataagttagggcgtcatctaaatggttttgttgggaatcatttcaccatcgtcttatttctgcccatcatgaaggcatattcctctaaggtaggaaataacctttaaacattatctagtccatctcactgaccctaggcaataataagatttaaccactcttgtcatttgaaaaactgagcctcttccaatagtctctaatatttaaccatctttactgttaagatatagttgtattacttacagcctaaatccctcatgctatttttcaagttcccttcccttctcttattgactctttggagatgatgataagcatttaataactctgctaatttaacttgaagatcatcttagtttgctgttttctgtgatccagagttctgatttataattaactaggcagtgtgcataattctcttctgtgtctgccctaatcagagaagcctgaatattgtgcacagcaggcattcagaaatacctgtcaagacaacaggcattccagataaggacggataagcactgaataagagagaaatgctagaggacagtatccccgatgcacataccagcatcccaggatagcacctctctttttaataacagtcttccacggagtcccttgagagactaagaaccatgctcctacatctccttaactctttcccttcatcaaacgcagtcactcgcacactacaagtcttcaatcaagttgaatgaataaatgaatgaatgaaaacagaatttcaactttcactattataatgaaccctgttagcctttccttacataaaaattcatttaacattcaagggacattatgtccttgccaatacttttaaaaaccttaactacagtcaccatgctatataatggctctccagaacgtattcatccttcatgagtgaaacttcgtaccctttgacaaacagctctccctttctctcactctccaatccctggcaaccaccattctactctgtgcttctatgagttcaactatttaagacataaaagtaaggttatacagtatatgtctttctgtgtctggattatttcacttagcatagagtcctctagcctcatccatgttgtcacaagtgggaggatttccttcttttttaatgataatattccattgtgtctgtgtgtatacacatattttctctacccattcttacactgttggaaatttaggttgtttccatatcacagttattgtgaataaagggcctataatatttatatgctctatactctttctccttcttccacatcttgttaaggactaaccattccctctcgggctaatttgtaaaagaagcaattccaccaagcccttcttaaaattatataaaaacttcccagcctgtacgatgaggcctcaaattatacaacaatataagcttcctgagcatcttgggataaacgtgctttatagaattaagataccacttacttgattgtaatatatcttagggctacatagtcaaacctttgaactcacatcaggtgatgcgtgctgcagaatatagaaacaagattctacaaagcagtctggaaataacatgtactactgaaaaacaaaaatactgtaaattagtataataaatcaaggaatcagcaactctctaccactaactaaatcagtaatgctttcttcaagagagttatgagaattatatttcccatgtggcttgcaaatgtaaagagatctattaagactgtctgatagttactgccgaaggatatataggaagtagaatactaggaagtattatattcatgacattgctctattttatttataatttttataagagcttaaaaatctaggtttcatttaagcattacttgtgtgatacaaaaaatatagtaatttagagtttgatattttttgaaaggctttttcaaataaaccattcttttgaattcaaatgattaagaggattaaaagtatcaagaatttatttcattaggcatttcccaatgggatcaagtttttctgaaaaaaaaaaaacttacgtaaaaccaagtattaaaacatttccactcaaatacattagggaaagtcccaaaatgaagcacagaaaaaataatggcaacataaattcaattattgtaccaagtaatcgcagaaacatgcagaaacatgggcattcaagtaaataaattattctgattttgctcctagctgacacaaattactcatttccttggacttgatacaagaaggcttcagagaaaaagaagaaatgcaatcaaagagcaaagcacattactcatcatctgccagccttgcagcaacagaggtttcctacagtccctccctgccacagccttgcaggatatgtctataagccagtctaatacatgcttaaatgttctcatttacagactcgatttccttttgcgggttcctgcaaaagttctcaatggtggtattgcaacttgcatccaatagcaaagtgcctgtagttatttgttactaataaagtcctgaagttttcaaatgacttgctttaaagaactgatcctggattatttctaaaatcagcaagggcaataaagtatttacaactagtagggcctggcatcaactaatcagaaaggacactggcctgagaagatgctgctgtctcaggtactagatggtggcgaggttcacggtatcacagaaggaatttgttagtgcaggggacactggggaggagggagagtcaggacattctaagctttcatcaaccaggagggaagtatttcggcattttaaaaacctagtgcatctgtctgttagggcgagaaaaagcagaatatcattccagataaattattttagcttcactcacatgcatcctggtgtgctttcttgagtggaagaaagtagatgaagtaacatgctggaaatcacacataacctatggctttcctcatttgtgaacccaaggaagcgtgccacatatagaaatacaaagtcagagttacaactttgcccccgtattctcacacgctgtgttagttaaggctgccataacaaaataccacagactggggggcttcaacaacacaagtttattttttcacagttctagaggctggatgcccaagagcaaggtgccgtcgttgctgggatctggggaagcctctcttcccggcttacagatggtaaatttctccctgggtcctcacatggcctctcatctgcatggccacagagaaatagtgttctggtgtctctacctcttgttacaaaggcaccatcagtcttatccgattaaggtcccatctataggtcctcctttaaccttaattacctccctaaagggtgcatctccaaatacagtcacatcaggggttaggggtcgaaaattcgaattttggaggtacacaattccatccataacacacaccacgtaagaggaaagagagaagccttctcccacacattttctgctttgaccaatttaagtgaaggtgaatttgtgattattactgtagacaaagaaccctctaaaagcagattgttgctgtagacctgccatatacccatctcaaaaaggacctcaccaaaccccaggccaccttggctaaaaccacacctaattactataactgtgcatctcaatgatcagccaacaagcactactgactaccaactatattcccagaaccaatggagagatacaagaagattcacatcatttggggtgaatgagagtatgcctgtgaattaccagtgaacaagatcaactcatttacatgtaatcagtggggatcagagccttcctgatggtcatgtagaatgtgcacaggtagaacctcactctacaaacacacccatgaccatcacctctctcatagccctctgccatgattctcatggcaacaagaacattctctgtcatagcggcataaccctaagcagactgggcccgggtaccttttggtgtaggcaacatccagatagctgtttctttctcactgtaatcatttccaatttcattcaagagcctcattcacactgggctgtgatgaacatttggctaacagattgcttaagtgaaaaacacaagagagtgaccacagagtaaaagataaattagtggaaaaaaatcacttgaaactttcactctaggaagaaagggacatagcacaggatgagtaatagaatctcccccagcccacagccactgccaatagatactaagattccaggtaaattaaaagaatacatgagaggtcactgaaacagaaatccagctgggagacagaaatgcaaaattctctgtagaagaaaatgggtagaccaagggcagtgcaacatatagaaaaaacatgaaactttacaattggaaaaatacacatcagaagttcttactggtcttatgaccttagccctctgagtcacagtttattcatctttaaaataggtatgctaggtatggcgtggtggctcacacctgtaatcccagcactttgggaggctgaggcaggtggatcacgaggtcaggagatcgagaccatcctggctaacacggtgaaaccccgtctctactaaaaatacgaaaaattagccgggtacggcagcatgtgcctgtagtcctggctactcgggaggctgaggcggaagaatagcgtgaacccgggaggcggagcttgcagtgagccaagatcgcaccactgcactccagcctgggcaacagagtaagactccgtcttaaaaaaaaaaaaagtatgctgttcactggttaactacaaggactacatgacaatacagaggcctgcaatcacacacaccctccaatgtctctggaacataacaaaaaccactataaatatctgttaacagtataattaggagctacacttccaatgttaacttgcagctgaaaccatcaactatcattcacaagaatggcaatgccatctgcagtaagactcagaagtattggaaacccttccaagcctttatgtagacagatgaggagcagccatttggtttaatatacaattattgtcagaactaccctataatttgcctcctacaaatatccaaatgccactaaatggggcacaaggtcaccgtggtggagcagactgtctcatagctgactgttttatttctattagagatgacccagggccagatgtgtgcatggaatcttctgctggccttacacttttagcaaatggatacgatgaaacgtgtccccagataacaggccatagggcagccagggcagttctccttgctgaattctgcttccagctgctccatgggatgaaactttgtgttctagggaagttttctgtcaacttgtcaaaacagtcgctccggccactcacacttacatttatgttatagggcccaagtgtttggacagtgaccctaccttgggtggtgctcagaatcctctcttcccctaaggatagtttacacaattggagtttttttttttttttcttgaatatgtttcaagctggtgttaattctacaaaacagatgggcagctaaatcttttgaagttgctaaatatattttgagagcatataatttttatacaactaacgttcagtttatatttctatcagctaaactgttattaatatttgcaaaagccaaatgtcaaaagcatttaaaaatgtcaaaccatgtgaacacgattagggaagggtttcttgtaagaattggaaaatttcacctaacggtattgtctctcttatacccaggcacaaaatgccaagctccaggtcctgagcttcagggggcttcactccgagcctcctctagccatccccttccaccaggtgtgggtttccctgcatcatggggttatgcccatgcagagtctgtgcctcccctctgcctcatgatgttcagggtatgctgaaccaggaatttgtttccaaatgggcccaagcctgcttccaggacctgctgggtatgtgtgcgcacccaagatccaaaaagtagccaaatgctggcagcaggcatgggatgtggacagagtatagacatgacagctagggtgtacacacatgtgcaccccaggcccttagtggtaatgggaacatggagctgggggtgagagaagaaagggagccaaccaaaccactgggctgcaagctgggtgttaggaattggctgcccctgtaccaaatgggccaaaatggaactccaaggactatgagaatgccatgcttgattcggccttccaggtcatgatgaagatacattcatcaaggagaacacattttacatggcattttattttgctgacttggtttataacttgtatatatttagacccgtagaatgtgggctgccatttatatactcttgttctaggccttgtaaatattaggagtaggactgcatcagagttaggtttagaaaattatagacttgcaaataagagtaattgtattaagttctgttaatttcttcagcaaaactaagattgcaactaataatctataagaaagcagcatgtcttggaggtattctcttcttttattttcataaaacattacaaacatctgcaaaagtaaaggttccagtataagaaatgctcacatgcttgattataaccaactcaaagccaattgagtttcaacattaactcctgatcctccctccaaattatttaaattacatcacacaagcatatcttttcagccatatttatgtcagtatggataggtatgtcttttaaatatgtcttttaaaaaacatagccatatgttatcacacctaaaaacatgaactatatcaaatattcagggagtagacaaatattccaaccatatcttcagattgtctcatttgttttcttttttgcagtattttcaaatcaggatccaaatagggttcacccaatgtctcacgacactattcttgatctataggttttctccccacctcttttttccttccttgtactttatttgttgaaaaaaacaggtcatttgttccgtagaatttcccatagtttggattttgcagaacctagtcttatagtgtttcctataagttgttcattgtatctacaggcttgatgagattcaaggttcatttttttggcaaagttgcttcatagatagttttgggtatttccatcaagagacacaagatgtataaatgtctctctctggtatgttagcactatttctgatgcactatttcattaaaaattgcaaaatagcttctaattatattcttctttctccatttattagctaaaatttcttacaaagggaaacttctctccactgaggatgatttagttacaggtcttaaagacagaatgcttctttctcattgcttatcaattttgaaaataaaaagttggtttcctagaatcccctaaaggttttcctggggttgttttgtattattataagtgaaaggatttaaacaaaagctgacatgctttaatacactgcagttagtattcttattgatgtatgaattgagctgtttttgattggtggaagacttttcaaattggatcctggacattttaacaacagcctcagactgctatgacaaaaacaatactacctctaaaaatatgaccactaaaagcaacgatattttgtggatttctttttgtcatgaatatggatcccactacaagtgtacaagcatctgttttcaagtcacttcaaatgattgttcactctgtagatttgccatcaatcacaattgcagttagatttactggttttgctttcaatctgggggaattttaaaattagatgttatgttacaattttattaaacatgtaagtatttataaagtcaaatcctcaaaacaaggtttattaagagaaatttagcttctattcttttcccatcccatcttctctctttctatttaaagttaacaacttcttaagacttacatcattcttccaaatacatctctttctgtatgtttgtttacatgtgtgtggacatacacacatgtacaaattccatttatctggaggtaaattgaagtatatatgtgtgtgtgtatatatatatatatatatatatatatatatatatatatatagtgttcacacacacacacacacacacgcccttctcaacctggtatggagattggtgatttgctttttccggtgattgattattttgttttacatgaaaacaagattgaaatattgaaaatgaggaactctagataaatattttttgtaaagtagtgctatggaaatgatgttgaactctctaagtcaccatatttaaatctaccattcacttcaaatttaactgaagatcaatttctccaattgttaagggttcattaatcaagtaattctggaaaagggcatattgatatttgaacttaattattacgaagttttataagttttagaatgaacttgaaaatgtatgtctaacttttttgtaacttacgcaaaataagaaaaatttgtggccgggcgcggtggctcacgcctgtaatcccagcactttgggaggccgaggcgggcggatcacgaggtcaggagatcgagaccatcctggctaacacggtgaaaccccgtctctactaaaaatacaaaaaaattagccgggcgtggtggcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaaaaaagaaaaatttgtcagtcatgcagaacatacctcaagcaattaataaatacactgatatattctcaaagacactggaagaaaaaactttagtaaaacggtatatatctaaaactatatacttgctccaaacataaatattgcactgatgcaaacactaaatttttgagaagcttaacatatattaatttttgtagtgtacaacaggaagagaacccttaagggacagacagacctgacttaaatcctgattcagccattagtggctgtgtggcctttgcaaattgcttaacctttctgggctttattttctttatttatcaaatatggatgctaatagttcctcactggtctataatcaataagattatttgtttaaagcatgtagaaacacaactggtacaaggccagtgctcaataatattagctcacttgttcttttgtagacaacatacatagaagacagtatgaataatggttaagacctagggtatctgagttcatacaacagctacaatacatccaagcagtatgaagatgggcaagttatttaactcatgggagcctcagtttcctcatctgtaaaggagagaggctaagaatatcttccgtagaggactgttttaagaattaaattacatgtaatattatagttcgtctaaaaggaagggatgcttatttgtttcatttcactgttataacactggtacctaaaatagtgctggcacttggtaattctccttaagtgttaataaaaaataaatgagataactgttcgaatctcacgtatttcatgttactttcaagttgctgcttttcacatctaagagttctttcctcatgctctgagacttagtccttcgcctctccggattttattaaatgatggatgttctcactgtcagtgtaatctccaaggtcctggcctttcctgaactggggtttgggtgcactgagacggtaactacagccttactaccccactactcaattctttactcaagagaggctgcttagaaagtctgggtctgcagaatctcatagtgattccaatctattagatctgtaggatatttccggataacatatcatgtgctttggtgattgtttctgaaaaggcaatagacttgtaagtgttctatgtgtcatgcatattggaagtacactaaatatattactacttcactggggactctcttgacaataatgtgaattgctgagggaacagaaatcaatttttaaagtgtttctgacatcaaaggtgaccgctgggcttcaggaaaagagttcaaagtaagattgacttcgtgattgagatattcataagactcacactgcaaaggtaggttgggcattcttccactgcccaagatgcaagcgaatgatgcaggcagattccaagctgagtttgctgagataagggcctccaaggaactgagttccggcaacatgcattgtgagtacccataccatcaggtctgtctttgtattctgttctctgaacctaaaatgccccttcttcagttctctattaaaccctcttcacctgcacatgcttcaatactcatctcaaatgaatccatttctggctggcagagtttttcatctatcatttttttctccctgtcttatagcaaatattggatcctaaccttagttattttcacatgtaactcttttttttaccctacgatccttggcaacaggggatatggcttacttatttctgtgtctccacaccttgcttagcatagagccaaaccaattttttttttaattatcatacttcaggtttagtagtatctgcaaaaaaaaagtattctttatacagtattatctaagtggaaattttattttaaaattcaatagaaataatataaattagattttttttaaatctcaatatgatggaccaggttggccaaataccatccacagtgagggttattaaacggtagattcaaacagcagcatggtccatcagaaataatactttattcatttacttcaccatttattgtgcacctactatgtgccaggctaaaatcataagcagcttacattttacaaagggaagatataatatgcagctgcaaaatgccagcaagaaaaaaatataattttgtgataaaagtctgtaatcaagtgagtaaagtagaatattataaaaggcatcagggagatggtgaatttggagctggattttgttagctaaacacatattgtccaagccaacagcaaagggaaaatttgggccatcttagctacattaaatggctacacagtccatgtcataaatgcaattataagttgatggtggtctatgtatttggaaacactgactcaatcttcagcaaaagtggtttgaaaatgaaatgggaaaatacactaagcaagcagagaccataaaagaggcactaatgacataaacattcaaccttccttacaaactttgaaacagaaaaatggtggttgcccagttttttgttgttgtttgtttgtttttgagacggagtttccctctgttgcccaggctggagtgcaatggtgcaatctcagctcactgcaacctctgcctcctgggttcaagtgattcttctcctgcctcggcctcctgagtagctggaattacaggtgactgccactatgccagctaatttttgtagtttttagtagagatggggtttcaccatgttggtcaggctagtctcaaactcctgacctcaggtaatccacttgtttcagcctcccaaagtgctgggattacagacgtgagccaccatgcctggcccagttttccttttaatttgctataattgtatctatcccactggctcaagagtctcttaggtgcaatctcagcagggtgataataattaagttcaagaaattctgtaggtggcagagcatgtcaatctatgagaaaggatgaattctgcatgaaatacaattgcttagatcagtagggtaaatatagtttaaaacaatctattgtatatttcaaaatagctagaagagaataatttgaatgtttctagcaaaagataaatatttaaggtggtagaaatcccaataccagtaatttcctattttcaaattatacgaatgtattaaaatatcacttgcactccaaaattatgtacatctattatctatcaataaatttaaaaaacctccactttctattacagattataaactacaaaacaaataaatgatggaacagaaagagtgtgtgaccagaagtcagaagccctgggttctgggttggggtccacatagccatgtgatcataagcaagttacctcattttttaagcttcaatataatatttattattattaatatatatgattcgatatcatataataggctctccctatcatatgtaaggttataatgagaaatgaatgaaataacatagggaatgattttggaaatgataaaacataaaagtaaaaagtactgtcatttctgtaaccatggggatatcaatattaattaaaatgcttattataaaacacaactgctaaagcggttacagaaaataaacaaggaaaaagaaacgtatatttctgtcttgagaaaatgcatgctgtcagttgttactcctgcaaatgacaggtgaaaacctttggtcaggagaaatgtgcaaagaattctgaaacacagtttaatgaaaactacaacacatttcttttgtcagaaccccatagcttcagcatagctaattctctgcttcattcttaagaaacattcttaaaagcttgaggctgtttgttagcaacagatgtagacatttataaacaaggaccatcttaacagaattatttctcacgaattaaataaaggatcccaaagaatggttccaactgtttacagttagcacttagacttatactatgtgggaacagtgttcattaaatgcactgcctatggaccataaaggtaatcagaacaacaatctatactactgggactgctgcctctgcctctgccccatatgcaaaccttagagagattggtataaatgttatctgagagccataaaacactctcagaaagtaaactttagcttatgggaagtaaaccttcagttcaccaaattccatttagtgccctgcagaaagaattctgcaaagagtattctgaaagaggcaactcatcttttataggtgagcactccatcacagaagcccagagatgagaaatcaggtcttcatcctcccaggccatcacagtttataactctaagaatgatgactattatcaaaactttaaagatccccagaaatggccattctacaacctcccttggaagcaaatttctgtcataaacacactatctgtaaaattcttctatatgcttaacctaagtctagcagaattctggctgcatctttctactttagtgaagatattcattcattcattcttcaatcaacaaatttttttttaatgcttatgatggcaaaggttattggtgattgtataagagaggaacaggggaacaaacaatgtcccctggataggcagcgacctttaactctttatttagatcactattaggagcaatgtatgaaaataactgccaatttgtagaaaataccgatgccagaaaaacatggtgcccagtcccaagtacggtaatcaacaaaacttagactgtaggaaactctacaggtccaatattataggtctttaacgcataaaatatgaaggaaaaggaagggatggacagtaacctgtaggttcaaagaaacttaaaagacatatccagttgtttttttaacagatgcacaagactaaactgaagggtctgggaatgcacattaaatgatgacactattaaaaacacaggagggttattgccataaggtcacactaatagcttattggaaaaagataaaggttgaggctgagaagaggtacccagatgggattctgggtggccggcagagtctcctttcttgacctagcgttggttacaaagccattcaccttagaattattccttaagccagacatttatttattttgtgtggcttcctttgtctatgttttgtttttgaagaagcatgtatggatatgaagcaactagagctcctatacattgctacattgctagtagaaatgcaaaaaggcacagataatttggaaaacagtttggcagttccttatggaattaaacaaatgcttactatatggctctgtggtcccaccctagttatcttcccaaaaggtaaacactctaagacctggacatgaatgttgatagcagctttaatcacattcactcaaaacgggagggaatccaaatgtctatcaacaggtgaatgaataaacaaatagtagtatatctacataacagaatactattcacgaataagaaaatgaactactgatttttgcaaaaacatggacacatcaaaaaagaatcacacaaagtcaaagaagccagaccaaaaagttccatactttatgacttcgtcatttataagcctttctggaaaaggcaaaactataaggagagaaataagactagtagttaccaggggcttgggagggaaatgagaacaaagagggagggagagaactggtccaggacatgaaaatattctgtattttaattgtggtggtagttacatgagggtcaatgattgtccaaacttatctaaactataaacgtaagaaaagtggattttctataaaccacaccaaaaaataaaacatttattattgaaagtagaaatcaattcagttttcagttttaaaacattattctgtatctcacacattttcttaaaggaaaaaatgtgttggagtaggaacagtaatgtatcagaagttataatatgttattaaaacatatttagaggagagactaaatcattggtatttttattgatggctctttcttcagagaaattgttaaaaagtgaaaacaattctggttgtcataaagttatctctgtttagactttttaccaaaccagttcaaataaatcctaaagtggacaacatcagagccaagagcaatcttggttatatgttcacagcagagtatcttaacttccttttgccagccaagttccccagtatttaattttggctgttcccaacagaaatttttcatctaggctcggcagttttctaatctcaacttctccagagtcaagtaaccaaaatagacatggccaaaacccagtcccacagagcctccctgtgattacagcatggacaataagacagtctcctccaagacctcaacataaaactcattgttagaatcttcaagaaggcctggttacaaatgtgaaattattacttcacccaataagtaagtacatttcatttctaatgcagggccttttaaaaagcataaaaagcattataaaactataatgcaattgaatttactcatgttacagatgagcaaattgagacccaaaagggtcaaattacttaaccagagttattaagctacttagaggtacactgacaccaggtcctggacaacccattaaataagatagtgctctttgcaatgaaattggaactatactctgtgttaatactgttttctctacagggatgaataataggcaacatgactttcacgttgtctactcaaaaacatatacctctttaaaaaaatttaagaagaaacatgtgaccatttcatcatttattaggcagaaagagaaatacaaaacaataaagtaatgttcagctttcagtaagttagtatttgcccaaggagccgaaaacagcctttctttccagtttgctacataattggttttggctttcctttgcattgcttaagggagagcttacatgctagatcactaagatacaaacttctgacaccaaaatatgatccatattatgttatccaggcattttaaaagaggtcatttaaaatcttttcttccatctgttgtaatttgaagaaaatttatccttgaaccaatgttgctttaccatcttcaacttctggtagattcacacagagcagcagatgagaggccccaatttttatgaaaagtctcaggcagaaatattgctgatgatgtggaaatagcaattccaaatcaacagaaaattgccctctgtattcatcaggaggagcaaggcactcaggagagccagcctctgagacaggtcaaagttgacgaacagtcagacatgggaacaagtgcagaagaggagaagagctctgtgctgatgcttgtccaaaggtcaattgacagcttttctcatcttgttacattttcctccttctaaagatgcagagaaaatgttcttttaatgtaccagatacagaagcagaagggagtacatgggtagaacatttaagggcatattatcctcttcaacacacacttctatgccaggtgcctacagtttccaaatgggcagcagaaaatgaaccctaggattccataaagtctctgagaaccgataatgtgaacagcaatgaatgaacgagttaagcggtaaaaccatctccatttacgactccttgaagttcagcatgcagcagactgcacttaagcacagcaatcaactgtgataggagaatccccattacagtaagtaaagaaatagcttcaaggctgtggatgacggtgccaggggagaaggtcagaacaggtgcaaagaaatcctgaaggtagggagtgaaagcttgagttccatgtgggtgatttttaactatcctggtcaaatatgggtggcaaaccttaattattcccccttatttagaggtacaatgactggtgtaaacacacaaggaacatttcaaggctgaagaggcctgaaatcaagtatctttattcctgatatttgggttgtaaaatggtttgctaagaatgtttacaaattatgtccgccaggtgctaaatctcccagatcaattttaatttaaatcttcaaacacgctgcagcacagagctgtgacacaataaaatgtgtagtattactgttgtcactatgcaatcattaatttcatctgactattcatgcctcagcataataaaccattaacaagtatgaagtctggctgttctgaatctggacagaagtcctctttatttacagctaagctataaatacggtgttttgttcatatatgtacgtaagacttctctatctaaattctactttttcttgagggcataaacggtgttactaggcacacaataaaagtgtttgtttcctgttgaaaatagcagctttcattactaatctacaaactgggcctggcatggtggttcaccagcacgttgggagactgaggtgtgaagatcacctgagcccaggagtttgagaccagcctgggcaacatggtaaaactccgtctaccacaattacaaaaattagccaggcgtggtgacacgcacctatagtcccagctacttgggaggctgaggtgtgaggatggtttgagcccaggaggtgtaggctgcagcgaggtgaggctgcaccactacactccagcctggggaacctgagccagaccctgtctcaataataataatcatcatcatcatctacaagttgattagattatttccaaagggaccaacagagatacctttgcaaatcctgcatgatatgcacaattatatatatgaaattggtactctgtagagttgcttatctcctcactttatcacctaagtgatcccattactctacctttttttttttttttgtaaatcactgttatttcaactcaacgtaccccaccctaacttggagacaatattcctcaaagtgctcctctaggtgaatctaactgatacacaaacacttcattacctcaacatggataataaatccaggggtccaaacagtgattgtctttacatacaagggaagacagttccatagtctcatctacagcattcaccttggctgtctggacaatcacaattcaaacaagcggttagaggagtggggagagtgggaagaatttggaattttagatagttacaaagctaacccctcataaaatatgcccagccacacagacaatgggttaaacaatcactttcacatctggaaagcacctttgatgtatattgccaaataataagataaagtggcagccctaagatatcaccacctgcctctaactactaccttattgaagtgctctctcaactgtgaaggcttaatttgcaagtacctttctttatccatatttacattaaagaatgtaaatggtctgaaccaagtttgttatgcctgtctgaatcaccctcattgcaggcaatttctgatgtatgagcttatggctgattaggtaacctctggtggcatatccaatttttttttattgcctaaatttggaccatttctgatcattatagcctaatcagaggtcaagagggaagaacagattgtggctgaaggtttggtggtgatataaaaaaaaaactactcattcaagcatttgtatagatttttatcacctcagcgatcccattactcattaatagagacaatcacaaatgttcaggcttgcctggtgccttcaagccatcaggctcatcacacagctgaaactgcataaaattaagccatggaccacctctcctgaatcactcatcctgacacctgaactctacttcccacgtgtacctaactgtcccagcatctaacttcattctccgcttctccctccattgactcaccttgttactgaagctgagactgggaatcccataactactgtttagagactcccatgcctacaaggccatcaaacataccaataaaacacatcacccagcctgggccaggcgtcagcatcttatgcctctgtttcccacattcatagtattagaaaagcacatgtatatatctggagattcccatgaatctgaagtagaatggttgccctgagaactttaagcaccagagtaccggagtagttcctatttcacttgtgatctcttagacatgacccagcattcttattccatatattaggaaattgaaaaactgctcaactttccagatataagtgacatagtgaaagcagcagcccttgcaagaattaatcctaatttgcaccattttgggccacgtctactgtatccttcagtgtcttctataaagtgttctatgtgatacattctattatgaatttattaacagagataatattcctctctttaaggagtagtagcctttggccatgagataataattacatattacttgtttctttttttcttttgatcttgtctgccaggaatcttagagctaaattacatgctcatactcagaaaacttgttgggctatgtgaaggtgataacttgccacattctcctttcatgacctttattttgtttttattttatcagccctattgtaaatctaccttttattgtaagccataccacattctttgagaaagtggttattagcttagtttttaaaagtaacctcagcccatgaacaatgttcaaaagtaatttcacatcccagatatcatcatgcacaaaatgaactcattggcccaagagaaaaaaagaaaaaaattatgaatataaaggtttctaattcaacagaataatttatattatggaaattatttagatgaccatattggatgctaaccccgtccaagggtgatgcaataaaggcttattctataatattgagaatttttcaaagacttaataagattatttaaacataactagaaatatcttaaaaaccaaagtttaaactgtgaaaggccatcagaaatggttcagtaggtctactcaaattattgtgtaattatctgttacatatgcttttcccctccatgtcttttactgatttgcattagttctctggctgtaactggacttgaacttttcagtttcaatgacactttacatgagaaaactaattataataggataaaagtccttcacaaaagaagtatgtaaaaaccaaccactacttattgtacacataattatcttctctttcagcctaggatgtagtcttggctcttgtgtaacttaaatctgtaggggattggcatctgatttacagcagaagacccagcatcatatgaatataatttactatgccatgtgtctcctgccacctaaatctatagcttgaatatagagacatctcaattagacagtgcaaagagagcaagatctgcctcctcctatcctgtgccattaaaacaaccaatattaccaagcagtgcttgttttaaattcactttggaggggtggatctattattttaagttggttaggagacacaaagggagagttgccatcaaactgaatgaaaaatcgagcataaggtgatataagtaatagcctatgaggggtgggacatgcatttattaaagtattgattggtgtatttctatagcacctgtgtattatcatggacttgaggagttgaactggtgttaaattataatgctgacacacaggagtcatccatccttcttgtcctgttcctccatgaactcctacaccaaagttgaagcacatacacagtattggccataatgaggtaaattatctggaggctcaactgtgtttgttctctccctgcaacacatctaaaaattaagctgtcattataaaaacttcataatgacaaagctatattatttatcaccggtcacagtgttctccaaatcctggtgaaaagttaaagacaagacccacacagttttctcatgacgattttagggcaacttctcaaacatggatactgcctgggataatctcaggagagaaaagtgaaacaaattattttcctgattttataaatggtgaagtatagaaatgaatgcagattgtccttcacaaggttcctatatctggtcccaaggctgtaaatgcacagttttctgggggattcctcccatggaattgaagggattttaacataatagtttgaaccatcacctaccctcatattaactataattggaaactgaaagattccaactgctagaattaaatctaggagctactttttcagaatcttcctttcaaattctttgaaagagagattctagtgatctctctctctctctttttttttttgtttttgtaatggaatcttgctttgttgccgaggctggagtgcagtggcgcaatctcggctcactgcaaactccacctcctgggttcaagtgattctcctgcctcagcctcccgagtagctgggaatacaggcacctgccatcatgcccggctaatttttgtgtttttagtagagatgaggctttgccatgttggccaggctggtcttgaactcctgacctcaaatgatccgcccaccttggccttccaaagtcctggaattacaggcgtgaaccactgcgtctggccacattcaagtgttctagtgatatctttttaaggacagaaactcactgattttttttttttttttttttttactactccttagtgtttcctctaagcaatgaggaagagtttattgaatcattagagtcacatactctctctttgtcttaaaataggattgcgatgaccactgaaatctcatccttttggctggccttttttttttttattattatactttaagttttagggtacatgtgcacaatgtgcaggtttgttacatatgtatacatgtgccatgctggtgtgctgcacccattaactcgtcatttagcattaggtatatctcccaatgttatccctccccgctccccccaccccacaacagtccccggagtgtgatgttccccttcctgtgtccatgtgtgctcattgttcaattcccacctatgagtgagaacatgtggtatttggttttttgtccttgtgatagtttgctgagaatgatggtttccagtttcatccatgtccctacaaaggacatgaactcttcattttttatggctgcatagtattcaatggtgtatatgtgccacattttcttaatccagtttatcgttgttggacatttgggttggttccaagtctttgctattgtgaatagtgcctcaataaacatacgtgtgcatgtgtctttatagcagcatgatttataatcctttgggtatacacctagtaatgggatggctgggtcaaatggtatttctagttctagatccctgaggaattttggctggccttttaaaggacaagcctactggctgcaaagccaccacaactcacttgaagacccttaggaaagccatcaggaaagaaaagacaaccagtttcaataaagctcatgtcaggtacaaatggaaagtttcagaaaattggtctgaatgccataggatgcttcagtcagaacagaaggtctaaatggttggtaaattagctcatcaaacacaacagaagcttactcaatggacattcaatccaaggtgttactggtgcagagagagatgcacctcaggaagcaatctgctcagctaagaacaatacctggagaactgctgctgcaagctacgcatctgaattctgttgcgttcagactctagggtcacctcctgcaaccgcttctcgctttgaagacgtaagtgtctctcctcttccagttcatgtatcagcttctcatgctataaaagacacaaaggggatgacttttaggaaggtgtttatgacaaaaataagaaatagctggttatcaagtgataacttgagctttatatatatgaatttcatcctttgaacaaccccacgaagtaggtcctattcttaatctcttgttatagacaacgaaaccaaggatcagagacacctaagtaatttgtgcaaggtcatataaaccagaaggtaatagatcttgactcccaggtgacttaattctaacacttgaataatttccactaacccagagagcatcctgtgaagaactatgacccaaaaatactattgaatgcacaataagtcagataataattagtaagattattacctgttcagaattatttcatctcttccatctctggtatatccttgaaagagaaaattactacttttatagaaggaccaaaaatttcaagttaattagaatgtgaagctgatgagggtgaggctcaagaattgtttttcattttgtccagttaggtcttcagatataaaactaggccaagccacccactgtttttataatcctagataactagctcatctcacgaacgggtatcagggactgaaagaggaactggatgacacagaatagacggttcagcagaaactcattcctggaactggtaaaaagcacacagctcagatcctcctgatagcactgagtcagctacactaatgtctttgttgttttgtttttgttttgttgttgttgttgttgttgccttttttaaaaagcatgccatgctgttattgttactgctgttactacactaagcattttgtacacaggatatacactctatgatgaaaactatacatgcaatgtctgatcatgagggacatatatacttaaaaggaaagaaggcaaacagtgacctctgttttgaaataaaccaaacactatgactgtgtaccatgcactatggattaaatatgattcatctcatgtggcatattcacaggaagtgatagcaatgacagattttctccagctctaactcatgagaaaaaaggcattctgaggatcatgaaagaaacattagactagaatctagatgtgaatcctgatcctctaaaaatacttacacatcctcctgcctctgtacctttgttccagcgtgaaaagctgcctaggtctctcggttgaaagcctagggttccttccaggctcagttgcaagccatgtcctctacaacttatccctcatcactgcatttcctcccttccctgaattccaacatcacctaccatctttaccaccctttaggtctttactttttctactgttatttttcatgtgaatttatcataattctccacctggataaatatttgttcaagatgccttatgtgcagatatattttacatttttagcacattacctaatatgcagtagtgctggaaatatatttgtttattgattctgaagctggccttttgcttactcaggcctgactttttgatggtctacttttaactcccataatcagttacttttactgaaatcagaaaaactaaaatcaaaattaaaatcaaatctttattctgtcactttggaaaatgacattctggaagcgctggaaagaaagaaaaatgtggttgtggaagataaatgggttaattaaagttaactctttacaaaaatggtcaaaattgcaaatttcatgttatatacattttactataataaaataaactctttatggttatatacacaattgacattcctctttttattgactgattagactaaaagaaacatggacaagtcaccaatactacagaatttggaagatagtgcttcgattccagaaacaggccaaaaaaaaaatgtacgctaaatagttcaaaagtacatgctacgaagaatgtgaagttcacacctgtaatcccagcactttgggaggctgacacgggtggatcacgaggtcaggagttcaagaccagcctggccaagatggtgaaaccccgtctctactaaaaataaaaaaattagccaggtgtgttggcgggtgcctataatgccagctactcgggaggctgaggcagtgaattgcttgaacccaggaggcggaggttgcagtgagccgagattacaccactgcaatccagcatgggtgacagagcgagactccatctcaaaaaaaaaaaaaagaatgtaaagttttgcagagaaaacagcatccctccttccttcaaaagcaaagaatgctccatagattcactcactgccatatcaaagagtcccaaaaacatgatcatgagagaaccttttccacatgaataatcttttctcttcaatttatttatgccttttaaaacatgaaaaaaaaagcacacacacacacacacacacacacacacacacacaaaccctgataacacagagaaaattctaaggaattaagactatgagggcaaaagctttttactaaaatatattcccttcaaatgacgtgtatttctattaatccatcaaaacttgacaataatccacacctactaaatatgaaaaatatttgtacccaattttttttttttttttttggaggcagagtctctctctgtcacccagactggagtgcagtggcgcgatctcagctcactgcaagctccgcctcccaggttcacactattctcctgcctcagcctccagagtagctgggactacaggcacccgcaaccacgcccggctaattttttgtatttttagtagagacagggtttctcgatgttagccaggatggtcttgatctcctgaccttgtgatctgcccgcctcagcctcccaaagtgctgggattataggcgttagccaccacgcccagcctgtacccaaatttaaaaacaggctacacatagaaaaaatatagtatcaatagattggctattttttttctgtattcgctatattctggatataaattgatctatccccaaagtaattttaatttgtctcccaaatgttggctctggatctttcccagcagaaagtgtgaaaggcaatgagagatggagaacagttgctgttatttacacaacgccactaggtactgaagagcaataagtagaggacaatatcctgggaatctgggttacaaatctgacaggaccacatttccacagcaacagctctctttctgcagagccactgagctgggatggcttgaagacacctgcctaggagagcctcatgatgattttcaaagctcctcaatcaccacctttcaattcttcccatgttcttcgagcaagatgctccatgttcgtcacctcttccctttctctttggcttctcttagcaaagatctcaaatcgctgcaccagaacacaagcaacagctcaaaggctgagtctaagcagtgacattacatacatgttcaacaaaacttgccagtcacaggctcttctttccctttacagaggtgagctttgttattagtaaaaaggtaggtttccctgtttttctgaagaaaagctgtgagtgggttaactttcaactctgttattcgttagctgctgtctctaactccgaaatgagcaaactctgcaaaaaatatcttcaatctggagaatattttacattttacaaaatgtgtccaccttcattactgtattcagtcttcagaacaattcagcaatagtggttattatcacctccatctaaagataagtgcagaggactgaaaagagaggcaggaagcttgctctgtttccatggttagaaatagcagctctggagctagaattgagtttttctgaccctaagtctcccacttttttcccctactactgtcagctctgctgtaacatttcttttaaaagtgctaatttgttccaatgcaactgatatgttgtgaaaaaatttaagcatgacacaaatcttaggtttgccgattgcctgatttcattcatgagaaaaattaggtgaacacagaaaactccacccagttgaactgcatcgaaacacacaaaacacatatttcaaacagacctcagtccactgtgtgcattacgagccacaaccatccacatgtggtgtttacaacttcccctccaatttcagacagcgttccttccaccacttcacagtaacttctgaactgcatccctgttgatatccacttccacaaaaaactctttcaaggtaaagcaccatatttattgtagtatttatgtattttttaaccactgaacacatggctgccaattgtattaggttcctacctttttgtttttagtgtgtcactgacaaagttttgagtatttttcccatagtcctgtttcccccaaaagctttgtggttttcactgtgtggttttacagagtgcagtaattttcagtaacacacatgttataccagagctgactggacaccatggtggagaaaaagaagtccaaaacaagagtggaattccaaaatacttttcctatttggacatgagcaaagagttaagttctagacaaagaatcaaacatacaaagagaaagacaggtatttcctccatggttctacagaatgatcttgtctatacctcatagcctacacatagcaacagagctcaaactgagccatcctctgattaaacctcaaatgcaggagattcctccatttccctgggtaatctatgtttctgaccttttctcctgataattttgtaaaacttgcttaaatcattaaagtatcaaaaggtcctttctacatgcatgttccaaggaaatgaagcaaaatctatatagattctgataattctctaatttaatagagaactgtgcgtgtaaaagcagctatgtacccccaacatggagtcgtttacttacttggcccacaaatgtttactgagtagctgctatgtgccaaacactgaactagagatggaaaccaacaatgagtcaaatggacatggttcccggcttcgttagacttacagactaatggagagggctggcgctaaataaacatcacacagataaatacggcagtataaactgattgttaattaagagtatgctgaaaggtgaaagtgacggaaactgattttgtttggtaggtcagggaaaggcctctgaggaagtaatattgaaactgagacctctgtgatgaccaggtgctaccaggcgaagagaggggaccagcactgcaggcagagggagaggcaagtgcaaagccctttgtcgtgtagggagggaggaagagaagcccagtgtggctggaagctggtgagccaggggacaggagtggcataggacgcaggtggaaaagaataagggatagaccacgtaggaccatgaacatgacatgacagatttgggactgtagcctgggtaaaatgatgactcattaccaagggcttaatcaagtgaggaagatgatttcagatttggcaaagttcattctgactacggtatggagaaagaactaacaggctaaattatagaatgggaaaacatttatataaatatttaaatatttaaaataaatataataaattaaataatgctaccagcttttagtttgtaccacaccatttactagagaagtggttttgaacaagccacttaacttaaaacttaactgctttaagccagtttcctctgcatactggggacggtgaactcatccaagccaatttcatagtatcattgtgaataatagatgaaataatgtatggtaaggcacttcaaaaactcaaaagtcctatataaaaataaaatatggctaactaaaattgtacagcttatattgtctaatatacttcagctacttttgataaactctgtataacatttgtctttaataaccattacatattaaagataatcatagatatttcaaaaagttcaaaaatgtgtgtctaagcagatcatacattaatcttgaaagaaaacacattttaaatatgattttgatgtaagaatggagaggataacttaatcacaaatgccatctagaatatatataaccctgtgtttggccttccctaaaatacattattttttattctcatttcctagtatgatttcaaacagatggcttgatgtatggtatgagaaaacttcagaatgaaattaaaatattaacacttgattcaaatatggaaagccaataaatacctctattctaggtctaattatagttggtgattctcattatatcagtgggtggtaatactgccagagttaaagacaattcaaaaatatgaaaaagaaagaggaatttatttggcttggaaattctagcaccacattatgtggcatatatttgacgaaacatatcaggcataacaagaggcacgtcccacataggctccaagccctccgtgagtcctgcctcgttgagtgtcatgaggtaccagctcatctcaggtgtcctatgctggcttgatgtctgaagatacatgataattgagaagtaatcgctatatgtctgtttcaaaagatttcctgaaatgtgtccaagtgataatattcgaattgagtcatactttatgaccaaagaatcatggggaaaacattagtactcttggataataagaggatcttaaggtaagaaatgaatagaggccattagagaaggacaaagggattcaatgatattcctgtatattgatagaaaaacacatgagctcatttgagaaatgtggaaactgagaagcaagctaccaactagaaaacgtgcccagtcacaggtatctccacgtattcatcaaccaacatccaatgtgcactcaaacatcttaagaattacacggagacccagaacaatccttttaattctctccctacctattgagaatctaaattgacacctgtgttttttcttcagaagtccataagccaaacacatcagcagaaaaattaatgtcttcatgaaaactagtttttaatgggaaaactctattaaccaactctgtcaagccagtatgaaatggatctaaattaagctatagttattacatctaattgtagccttgtttttgttttgcacacatattgcaatacagtttcaccataaagctctctgaattcaatatccccattagttatgaaagatttggtcatcctagaagcagagaaacagataaggaacttgaggattgattttttaaaaacccgtactcttggctgtaacagaagaatcagaatcagattttgagatgcaaggatagaaacagccaagtatatatctgcagtgctgataacatcacccaagagagacaaagcttttattctaactaaaaaaagatgcagagcttggttttgtgtgtgtgtgtgtgtgtgtgtgtgtgtgtgtgtgtgtgtgtgttttggaaaagaaaggagaaagggtgagataaataaatacagaagaggagaagggtggggtagagggtagaaatttcaagggcaagtaagacagatgggcacttggatggatcttaaaaatgtcctcaatgctagacaggagctctataacagaaatggcacaggtgaagcaccccatatgactaaattttcttagacaaagattatatatgtccttattatttagcaaagggatagagatgtgaacttgatgaaaggagtttttccagggtgggttgtgaagaaaagcaagataaaatgaaggtgttaggaataccgctcaaaatcctaaggaaattgaacactcgaacaaaggattcttagcaaagcaattttacttccgcgcagaggggtgcctccttggccagttgccatgagaacacacctgaacaaaggggcaggagagcctttattcctgacgcaagtcctgcccctgtaccctttccccattggctgaggtggggtcgtacaatctaatcttggttagctaaacatttgattttttttagatggggtaggcacgtaaaagaaagtggagggaaaggggaaggggtgtctgtaatgagctagaaagttagtcctctttccaaataaggaaaggagtgtgagctggtactgatagtgcttggtactgtggtgtgcataggcatctatcaaaggcaaaaaggaaaaaaaggagaaaaagaagggggggtactatgaattaaagaataaaagattgattcgattattcgaagagaaacctcatcatatcccacaaaggtctggcacgtggagattgatatgcactataaagtcatggtggaaaaaattacaacaaattttgggatcctaccaagagaaagtaagttgtttactgcatagtcaatggtttttattatttatcaactagggctacaaatgaataataaaatggtaacactgtatttacaacaaaaagtaatacagttttgcttttaatatcatcctacagcagaaaaaaaataggatgaaaatttatatattgatcaacttctcacatttttcatcagtctaagtgtcattttcacatcatgattcctacagtggagaaggcatgaggctaacagactgggctagagtttctgtcttcccattaacttgataagtgaccttgggaaatatacttactgtctccggacctacttctaaactgctgtagtaagttcttataattttatgttgccttggcctccattttaaatataagttggattctctcataccagaagaagggctcagtcatccttggcagaatttccagttctacgcctaactcacactcctagttcctcaatgtgttcaattcagatatctgcattacacagttgctcactacgggtcagctagacacagcctgcttgactggccctgctgctcctaccccctgcatgagctgtgcagatacgccacagtgactaaccctcagtcacagtgtggccacctggaactcacacctgttgctttaaactcacgaattaacattccccataggaaacctgtttggacaacaccctggatgccagtaaaggcattggctcatggatctctctctacatgtgctcctagacctccatatgtgtgaccctcaggtgtatcacataccccgagggcctgtaaacaagaaaatctgtatttccctcttgtgtctcttctaatcattggaaggttccctccatctggaagattctaaattaacactaatgctaaggtcccttccaactctcacattctatacagcaatgaaattagccacaaccatatcaggaaaagcataagcaattacaaataacattagtggcataaagagattaaatgcaatgtctacaagtggggtgtgtgtgtatacacatattttgggggttagtgaaagtataagtttcacttaatactgatgaaagtgactggcatccttgttttggataattagtgggtgaagatttaagaggcaaagggcacagtttttgggttaaagagagccaggcaatgttaaaacaatgatattgcacattacacaattaggaagaggagtgataaaatagacacaccaaaggcattggttttaatttgattctgaaatgattgggagtatcagtagattttgaggagaatgacagaatctaaatgatgtttaatctaaatctaaaggatgataattcttcctcagagtggactctagaggtgagatactaccataaaaggaacaatttcctcactgtcattcattagcaatggttccttgggttggaaaaggcctttccacagggttttctacctcactgactttatgacttctataagcttctcagaaaactaattcttctcaagtctttgaatatctgatgtttacagaggctgaccaaggaaagcaagacattgagtaataacccaggtaggtagtaagcttgttatcaatagtcaactgcctaattcagactctctttcccttacccgaatcttttccttgagtttattcagtcaaaaggctcaattctcagcttgacttagaaaagagctttatttactcaaccagtgggtcctttcataaaaagtcaatgactcattcttctcccctggtcacagatctttctttgttgtcatgttaattgatcacaattaacagtagctacttattattctatccccttgaagttttcagaagttgattttattaaatgccttcatacttgactgaagtcttaaacattgtttccttttctgtggagacagtatattctatgcaaagaagacacagcatttcaggttttttgtttttgttgtagcaacttttgcttccagttctgtaccctgaaccacatgtgcactttcagaatggctacagatctatgccccattttacccccaactctgttccttttctgtctgtactccacaacaatcggtgaacaacaagtgaattctctggctagtttcattttcatttcaaacttttggtccctatgtttctctcgttgttctctgttatggaggattccaagatttttcatcctcccatctacgctctagtcttgaacttcagctatatttactatgaaggttaacacctgttctgcctcaactctgatgtctctcttacttcactgcccgcctaatttatggtttataaaacatacttgtgctcttgctttataacttagctttatacagaatatataatgccacagtctttgctgtttcacatacatatgacgtattaatcattatataatgatatgtataatatatattatatataagtaagcttgttaatataataaattatattaacattaataaaatgaataacaaattatatacaaaataatatattactatatattcagtttaatgtatattataaccaataatatattattccctgtctcttcaaagagcacactttccttcaggcagggattaggcctcaaacacagtcacaaaaccccatagaatattagcatattgctgagctttccagaatgttcaatacatacttgttaagctccacatgaatcctcttgaccccccacgaccttagtgggcagctagctctaggtttataaagtttctctcggtaacaacttttagtcttaatcctgactgaggataatgtgatgagattttctctggtttagaaactccacagatacatttctctctgtcatcttctttcccttaccattgccttctcccaacagcccagggattgcaatcccaacttcatattcacatctcttaactgatgattcactttcgctcaataactattaagtcaaaaatttaatttctgagaagatgtgcaggagtttccaaacaaagccatttataattctatttttaaggatagtacattgtaccgttctttttgttcgccctactagactgtacagagtagtggaaaggaaaaaaaaaaaacacaactctattcagactaagaatcctttttatcctgtagctggaatccttatattccttccttcagtgaatgggtataattatgtgtattggaaattagagtattcgctataattatgcactcttttaaagtgggagaataattataatgtctacaaccaactgtacaaggtactactgaagcttttgttttaaatctgccagggaggacctcagtaatgattaatttcttacaactactttttattcatttggagaacatactaggaatgccttcacacttcccgtttcattgtggaaagtttctttaaacaagaatatttctttaaacgaagacttgagaacaagtgggttggtttttacatagccagcttccattatttcatcgtagattatatgagaaacctaaaaattttaaaacaggacttttagcagcttcccttatccttgttagcaaatgcaaacttttacattttatcatgctgctaaaaggtcagctacaacatttaaaaactcaatgtggaactaatcacaagctttggttcaatgctttagtattttatttcatacaattaccaaagttagaagaaattgaaagcaccaaatattaaagaattagagattgtgttatttctgggaggtaaggttaaacagaaatatcatttttatgaggaaatcattaaagacctataaatgagctgagtgagtgcagttaatctacagaaggggaaaacatatactcttaaaagacaaccagagggcctcttttgaaagtatatttaacccttggttaaccacatcagtcaaggagaacatcacaacagacaatctcactttctcaatgatcgacacagtcaccagaggaagcaaatggaaaacacagtttcacatggtctaaatactactcacaaaagataggccagtgtggctacaattactactattaataatagaatacctgcctggcccgttgttgggtatagaaaagctcacagaagaaacgcttacatcatgactgcaggtcttttgcatgcactttatgtgagtgtcagaaattgtgttctcaggtgccctttttgtaatctcctggtctctccccagtttccactcctggcaatgtttagccctttctcgttcagaagtggtctctcctggaaggctttgtcagacttgactgaacacagcaagagctatttttccacatggacacattaatatctgcccctttctagaggtcttatgatcaaagggaaatgaaagtttgcagacctggaagggtgcttgaggtcactaagtccaattgaggtcctaaaagataccaatttgtccagggtgatccagcttaccataagcctttgtcgctgtggacagagaagattcaaagatcctccaaaatctccctttccaggcagtcaacaatagagcaaattttcaagactttggcagagttttgcatttggaccagttagatttatatgtaaaactttcatataaactactttcctctgcaatatagacctttttataagctcaaaattaaactgctgcatgaagatggaaaagtgatttggcaagaccataaaacattttcatcctttttatattagtgtcttgaaagcccttctagaaaattttgcctccttcttcagaagacaacaatattaaaaacgtgttttttttttaaccaggccttgaatgttatgtacattgctccacaaatgtacatttttatataggctaagactctatttatgatcaaagaatcagattcaacatgcacaaagaaaatggttccaattagtgagagttacctgccatcttagtaccactgtcaatcagaacaggtgtgttattacaaaagtgtgccattacacaggttataactcatccacgtgcaaatacctacaacagaggctctccacctcttaggccaggaagaactgcaaagcatccacaaattacaaacggttcagtgtactgaacatgatgtattgacaggtattgaataaataaaaacacaactgctataacacagaaatctgtggccttattttttatggaaaaaggatccatgtcttcataagattgtggccactggcattaaatctgaactacagctagtgccagcagccctactgatgatacgtaagacagggaaacatgtatgtacaattaaagtgcacctccttattcacagagaagtcacaaagtaattccaggacaaataaagtgaaggaaaataagagagagagagaaaaagagagactcttcccagcatcacaaataagaatgataatgatgaaccctggctgagagttctaagcccttttcacatagctgccactgaacccttgcaacaatactagacagttggcactattcccaaccagattttttttttttaagattatgaggctaaggccacagtaagtaaatagcagagccaaggtttgagcccatgcaatctgattccaggaacctagggcttgactgcctctctttacaggtatgaaggagtttctttcctggtctagtaaactttcatcgcaaccagcaaaccaactgatgcatttaagcctctccctttccaggaccttgttagagattgtagggtatagaagagttccaagagatggtctgaaaaatagagagacagagatggtctttgccattaaaaatattgtaatcttgttaggccaagattatcacacattcaacaattagctagtaaagtatgaattatctagagcaggggttggcaagtttttctataaggaaccagagggcaaacattttaggcttgatgtgccacacagtctctgttgtaatgactcaattctgctctggtagcacgaaagcaggtatagataatacatagactaatgtgtgtggatgtattccaaaaaaactattacaaaaataggtagggagggaaatagctcagccatagtttgtggactcctagtcaagattaccagctataacaaaaaaataatcaattctaatcattcattttccaggaggtgacattccctttctccaaaatgcataaactccctagaagccatggggttgcagaactgtcttcttactgttaagaaacaaaaacaatttgaaacctcttccccgaaacttaatgaaactgtagctactgtcgaaaatgaaaaaattaagtgtgtgttttctagaaaggatgaactttcagcagtgctgaaaatcacgtaatatttgtgcttgtcagtgtgctagaaacaaatcttttatctatccctgtgtgattacgtctctgtacagaggcacctgcgttgtgttatacatagaattatattttaccctttggtgttgaaccattagccagtgtgtcttcttattctcaattaggaacagagttcctcccactggagggagagcagaggctctgcagtcactcgctgccgtgttagtgttgttagagattatacaagtcactttaactcaacaacttacaaagggtctacattttacgtcaaactaatctcaacattagataattttgaatactggtcataatatacatacaggtagatgataatttagccatacagattaacattttgttcttttctaacactttgagagcctatgagatttaatgttgacagatgctaacacctttaaatgcttttctattttctcagatgctgaaataaaattttaattttattatttaaatacatttaatttattaaaaacaagttggaatatacagtaaggctctgtagtgcatggattatacaggttgtagcagaaaaaaaaatctatctccctctctctaccaaaagttttatatttactatgtgctatttaataaataagttaattttccaatgagaacacatggacacaggaaggggaacatcacataccggggcctgtcgggaagtaggggttaagaggagggagagcattaggacaaacacctaatgcatgcggggcttaaaacctagatgatggattgatgggtgcagcaaaccatcatggcgcatgcatacctaggtaacaaacttgcatgttctgcacatgtatctcagaacttaaagtaaaataaaataaataaataagttaatttccctgcacaatcaatcattaagtcttctacctcccaatatatgagctggcctaggaggggaagagtagtaagtttataatctaaaatttgtgtacccttgggtcgtaacttttaccaacaacttaactctccatattgtgcatgtagttcatattttaaagacttcaaaacttcagacgtccttttgtctgttacacattgattgctgttaaactaaatgtttttcactctgtaatcaatactttcttacaaaaataagcccaggcattgacaaacaactctgcagcacattgcagctttcctgaatgaaaaactaccacccccaagaattaaaaaagattgcatcgactccagtgcttattacaatttttacaagcttcttacagctgaatcattccactgtaacaagactttattaaattagacagccattgaatcttaagctttctgagaataacaagtaatatgcctttgtcctttattattgtttctgcaaccatactgctcatgttcatatttacatcttctcttgtgatgaagttattaaaaagcaacatctagataaaaagcaacatctagataaaatgggagggaagcaacatctagataaaaaagcaacaactagataaaatgggagggaagcaacatctagataaaatgggagggaacatctagattagaaaagcaacatctagataaaatgcaacatctagataaaattaaaagcaacatctagataaaatgggagggaagcaacatctagataaaaaagcaaatctagataaaattaaaaagcaacatctagataaaatgggaggagggaaggggtggtataacatgtaaacgatgactttgtgtttcatgcgactaccattctagatcaattttaaaaagcactactaccttaagaaaatgctgttgtacttttagaccccaaatgcaaggaatcttttaatctgggacttttattttacacactgtaaagtgtgagttgcttttataagcatttgccttcaaattatttgttcatcacatggttcactctcttaatacaaccttccagtgagaatccatggtgaatgcgaggggcaagcagccaaccatacatcaggttgccaccaacatgcaccaagtatataactctccctccaatactaatccacacaaacaccaaattcttaaggcatataaccctatattccatcagtaggcatttagtggtctgggtaaaagctaaagcaagttgagaataataaaaacaaacacttccaaatacaacaaagagaaaagccctcacgtgcatacaccttaaacaagctaaggcatgttctcaccttcatgtttattagcaaaaaagaactcaagaaacaattgtttaaatcatttaaaccttgcatgtatatatccatggcaaacagcaacaaaggcatttacaatttttattagtgggtgatatttcctgtcaacagaagtggttttgtattacagtgacataagtcaatgtacagactccaaagtttttcacaaaaacactttctattttttgatccaagatagcacttctatgcaatagctcaaaattgccaccaagtggacggacaaacactattctggttgtagttgtagagtaaacagctgcttctgatttgaagagtgttgaactaatcacatcaaccagtgtttactaaatattaatacctactaagcacagggtgctcctctatgcaccacagatgaaaggcattctgatcagagtgagaaggctaaagccctgtcacgggcaccgcatcttgcgtgctaatgttctctggacttcaataggtaaattattccatttatctctttagaggaggaaaaataacctattaaggctactgtgagtgagcaaaacagcaacatccagtctgggaagggcattcatatcgctaataattgttgaatgatatgaataagctccagaaggtataaaattggagtcactcctaaaatcactgatagtgttcaagagactaataaattagaggttatgtggaccccaccttacaatctttcatggagacactgctctagacatagcagtggtgatgtataactcacggtaggtctataaccaaggctagataagcatatggatgagcaacatctacattcccagctagtaagcggcctcttccccatgggtacaccctgacctttcacatggaagagtttagtgtatgtgaaaccccaaaggataggaatctacatacatatttgatgagccaatttatttaataaaatatctaatttttccaaatgagtgactctaagtcctatttaggcaaatcctcagcttctggcattatttattttatgttataaaacataccttctctcttggaagcatgggtaccaaagggaagaacagtaacttttaatggatgcagttagatcttgaaatttttatctgaaaaccataaagcttttaaaaataaatttgcaaatgtaattgagcctctaatagctgctactgatagtaattaaagaaatctcatttccctaaattaaacataatgaaatgtttttcaagatcaaataaaactagaaaatgctatcagcctgatagaatttgcctctgaaagtggtgttctggagtttacagagaagcctcagttgccagcaaaagtcaatggtttatagggttacgggcaatatggaagccatttccactgtatcatatcaacttttattggctgataactgatctgaaagccagtatatggtacagcttcacattgcagtgcttatgcaaatgaagcagacactctaaaattcttcctttagtgcctttaaagagtttgttatttaattaaacgttgtcagcatatcttcagttcaacttacacatttcacactcttaatgttcaatttttacattacttttgcttttcttaaagtgaaatggcatttgggcatcagagtgaccatcttacccaggtctctcttaagcagggaagtgcttcaatttgctgtcttagtatgggctactataacaaaaatcctacagactgggtgacttaaagaacagaactttatttctcacagttttggagtctgggaattccaagatcaacttgccagtccattcagttcctggtgagggctctcttcctggtttacagatggacacctgcccactgtatttccatgtggtagagaaagggcaagcaagctctctgaagtctcttctgataaagtcatgttaatcctatcataagagctccaccctcatgacctaactgcctcttaaagacccaatatccaaataccatcacattggaaatgagagtttcaacattcgaattttgggaggacacaaacattcagtccataacaattgctcagaattgatcattgtcttctcatttcttgatggtctccagacaaaaatacctagtttccctgttatttcagcaatgtatcatcgtggtaatcaaaaaggttttccttatgtttgataaaaatattttgtgtcttaattccttgccttattatttgggcttctatgaatctaagaaactgttcatctctaaactcttcataacaaggctttattccaggaaaatataattaagccaaccattagccttctgttaacagacaccttacctgtcacatacatagaagcttctaacatctcacttgagtatgataagaagtatgatgtatttatgtcatttgtcatccattttttatcacttttgccacatttctctatatttttacattctctttaaaactggtatatccaaaaccagatgtaaagctacataatgggtttagttaatgttatgctcaggcaaagcatggactgatcttactggtgctctatgttggctccatacttccctaaacgaagtaccactcccatccccaccccacccccaccacacaaacagctcttctctactgagagcctctcatttgctcgtcaaattgcgcataacatgcaggcaacaaatacctatcttggaccaattaatgactcttatctaactcttaactacaacgatgccccaaatttttcttctacatatgttccttgattatctccctgctgaaatggtgatttgttttcttaatcctaatacatcacactgctctcactaattattcattcattaactatttagtaattacttcttgccagacactcaataggtattgccattcaattcagaataagacaagtttcctgtcctgaagatacttaaaatctagtccatgccccctacttaagggggactattgttgtaaatcattctattttgtgtctctgttgttcaaagtataaattaactgttctatgttaacattctttcaaaccaatgactgagcatttgctgtctccactccattcttgccccaccctcacctccagatggatgtcagtctttagcacaatcctccaatcaattgtttattcactgatagccttgacaggaaaggtgattacaaactgctagcttaataacagaaacaacaggatttcttcaagtacttaagggggcaagtgtattcaatactgcagtatccccttacctatgatttcagttactcaagtcaactgtgatccaaatataaaatggacaattccagaaataaacaattcataatttttaaattgtacatctttctgaacagcatgatgaaatcatgcacattctagctctgtcctacccaggatgtgaacctagtgtatccatactatagcggatacctgcctgtcagtcactaagttgttgtctgggttatcagataaaacaagcaaagtgtatctagggtccagtccagtccacaatttctggcatccactgggggtctgaatggagcatatatactgaagataagggggaactaatataaagtgttctttacctccaggatttctaactgagttggggctgagtctcacatcttacagtttgtccacctttctttgcctcttttcaaaggagcactttctgtcggtgagggcttcatctacatttttacctcctagttcatgttttcctagagcatcattatttagggggaaaagtaagctgtaacatttttaaataaattggtttgctgatgggagtttaaattggtgcaactgctttggaaaaccatctgggagtatctgattaaagctgaatatatacatcacctgtaacacagcagttccagtttaggtgcatatgtttaccatatatgtacatctgctcacctaaagtcatatactagcagcattattcataagagccccaaaatggaaacaacccaaaggtccattaacacagataaattatgggatactcaaacactgtaatagcatacagcaatgaacaaactacaactacatgcaacaatatagatgaatctcacaatgttgagtgagaagagtaaatactgcatgatctcactttatattaaagagaaacaggcaaaggtaatccatgtcattaggcgtctactgaaggggatttggtttggtgcctagagaggaacttctaggatactggtaatattctatttgttggtttaggtgctgactcacaggtgaacttgtgaaaattcagtgagttaaccaatatgtacgcttttctgtatgtacattatacctcaataaaaagtttttttaaaaaaacagaagaaaatctaggtgaccttgagtgttgtgatgactttttagatacaacaccaaaagcatgacctgtgaaagaaataattgataagttggacttcattaaaatgaaaaaccttaaacttctgctctgtgaaaaatactgttaagagaatgaaaagacaagccacagactggaaaaaatctttgcataagatacatttgataagagatgggtatacaaaatatacaacgaatgcttacagctcaacaataaaaaaaaccgcgttaagaagtgagcaaaagatttgaaagaacacctcaccaaaggtacgcagagggcaagtaaaaatatgaaaagagtctagggaactggaaattaaaacaatgagataccatgacacactattacaatggccaaaatccaaaacactgacaacaccaaatgctgatgaggacctggagcaacaggaactctcattcactgctagtgaaagtataaaatggtacagctagattagaaaacaatctggaagtttcttacaaagctaaacataggcttacctatgatccagcaataataattctagttatttaccaaaatatattctaaacttacatccacacaaaaaaaatgcacatggctgggagcagtggtgtgcccctgtaattgtagctactcaggaggttgaggtggggggacctcacttgaggacaggagtttgagaccagcctgggtaacagtaagataagatcccacctcaataaaaaacaaaaaccaacaacctgcacatgaatgttcatagcagccatgttcataattgcagaaacttgaaaggaatcaagatgttcttcattagatatgaaggaaaccagaatatttctccccaaaatatgaaggattattgagatgaagacaagtaaaatgcagggtagctctctgccttccctctgtttacttaaagcagaataaagaattacaaagacttttaaaaggtcttttgatctctccctatatcccacctaaagaaaaaatgtaaatttccccttactgcagacaatctcgacaaagttagggatggcgccagaggaatgtgagctttactttactttgccacagttttcccccctttggaagcctggaactaatttcctttgccctgtaatttttctaaaatctattgctctttgttgaagattttatgtaagattaaactctaaaccactgccttaagttactttactcctgtgagatgtacgccgaatgcattaataaacttgagtgtttttctcttgttaatctgtctttggttgcagaagtctcccaactgcaaatttatgaatactgaagaaaaattataatttctcccattcagatgaatgaataaacaggcgtgatacatcctgcaatgaaatattattcagtgatataaaggaatgagctatcaagccatgacaagacatgaaggaaccttgagtatactgctaagtgaaaagagccagtctgaaaaggctatatactgtatgattccaagtatagtcatgtgccatataacaaagttttggtcaatgactgaccccatatacaacagtgatcccatgagattatagtactgtaatttttactgtacctttttgtgtttagatatcaaatacttaccactgtgttaccattgcctatgatattcagtacagtaatatgctatacaggtttgtagcccaggagcatgaggccataccatatagcctaggtgtatagtggagtaggctgtagcactaggtctgtgtaagtacactctgtgatgttcaaacaatgacaaaattgcctaatgacagatttcttagaatgtatccctgtcattaagcaatgcatcgttgtacacaaagttttggcaaagttaaaaccatagagacactaaaaagatcagtgatttccaatggttcagagctaggggtcatggatgaatagatggcatgtgaaatatttttagggcagaaactattctgtatgctactataatgctgtatatatgacatttttatacatttgtcaaaacccagagaactatataacaccaagagggaccctaatataaatgatagagtttagtcaataatagtgtagcaatattgcttcatccattgtaacaaatgtaccatattaatgcaagatgttaatcatggtcatgggaaactgtgttgggggtgagagtggagcaggtaatataatatgagaactccctatactttctgcttaatttttctgtaaacttaaaacttctctaaaaaataaagactactgattttttttaaaaaataaactcatttaatagttacaaaataccaaacttgattcactcaaatctattcaggttaatccagggatcacaaagcccttaattttccccttctaccttcagaataaagttcccaaacccccaggcatacaacataaagccctcacccatcaatccagccccatctttaaacactctctcctgtgtccactgtgcttctggcatatctccatgctttcctactgttcttttccttggtcctagaatgccttcccctcccaacacacccctaatcgccttagtttagctggtgagttcctatgcatcttccgaggcccacttcaaatagttcctccttcttttttttttttttttttttgagatggagttttgctctttggtccaggctggagcgtaacggcgcaatctcagctcactgcaacctcctccccccaagaagggttcaagtgattctcctgcctcagcctcctgagtagctgggattataggcgcccgaccaccacacctggctaacttttgtatttttagtagagacggggttttgccattttggccaagctggtctcgaactcctggcctcaggttatccaccctccccggcctcccaaagtgctaggattacaggcgtgagccaccactcccggccagttcctccttcttgaaactctttactgttcttgattaaatgagcatctctttcttctgtttcctaatcacatgctgtgattatgcaactggctcttgatgaaatgggcatcgctttcttctgttttctaatcacatgctgtgattatgtaactgtttgtgtttctgcctcatttgtgagaatgtgaacaactctcacaaatgagggaccatgtcttaaagccacctctggtgaacactggtgccgagtgcataatcaacaagactttattaatcaataaatgacatagttattattcaagttgttattagcactggtacagcaacccatgtgagctgaaggtataacataaatgttaactcagtaaagtcacttctgcaaggggctgagataatatggcttaggtatttgacatgctgcttctataacttaccatggcaataacacttaaagtcacagaggaatcacttgctcattagacacactctctggaagaccagatgtctcaaggaagactttgataagtgctggactgcaattgattcatggctgaattctctgaggagcgtcacaatggtagataagctatatgttggggatgaaatagggatgcatatgctttatatgccagacatgcatacatcagagggagtggtctatttgagaaattaaggactctaacttacagtttttatctggcaaaaagccagttcagttcagcagtgagagttcaaaatataatgcgatcttagaagaaaaatcacagatgcaacccaccacttaaacctgtaatattacacacttaggctctatacctgggccacttttctttcctcttaaattctgctttggcaatttcatctactctaaggtttgaaccattatgcctatgtgaggtacctcctggtatatatctcccctaatgcaggagcagaacaccttccacttgcttttcctgacccttctctactctctcccactctgattcctgccctgggaggctaatgtttgtgccctcatcaataatctgttttctgcctctggcttcctgtgaagtccaaccttggaggagctcaaacaggagatcagaggaaggaccagggagggaggagttttattcacctgactcaatgattcctaaactttagagtacatcaaaatcacacagatgaaggcctgttaacagagattgctgggccccactcctggcatttctgattcagtactgctgggatggggctgagaatctgcacctctaactagttcctgggtgatgcggatgctggtggccaggactccactttgagaacccctgccacagctctttccctggaaggttactgagctacttctaccaaaagtctgtgctcttctcaaggtgacccactctacaagactgtggtgattaatgttatgtgtcaaattggctaggccaccagtacccagatatttggccaaacattattctagatgtttctatgcaggtattttttagacgacattaacatttaaaccagtagacttgtagactttgagtaaagcagatcaccctctgttatgtgggtgggcctcaaccaatcaactgaatgtcttcatagaaaaagactgaccttctaggaagagggaattctgccacagactatctttaaaatcaaactgaaactcttccctggttctctggcctacagaactaccctgcagattttggacttaccaagcctctgcaatcatgtgagccaaaataagtctttctctttttctacgtgtgtgcacacacatccagttgtctctgtttctgtggtgaactctgactaatataaagaattcatccctccaggttcaagtaactgctccctactccctatacagctcttaagacagggcaatgacagtttgactgctacaaagtccccagtttctgtactgtctctcacctgtttctacacctttgcaaacagtccttgtagagtaaacccttgttgaattatcctatttcagatgtgccatctatttcccattggactactctttggtacaatgcaccttaaattagagggaaaactcaccttctctgctttctttctaagcctactgcacctgctgtgttccctcttgtgattaatagcatcacttcctcccaggaacccagacgcataagctcagcgtcagtttttcacctcttgtaattgctggtccagctttccgggttttctatgattctggaagctctttagcagaaagtttatctacttcatttctgtatctccagaccctaacacagcatgttccaggcatctccaggtagcccaaaaatatgtgctgagaaaacaaataaattaaaatgtgtatgaaatcttaaaaattgtatatgcctttcatatacaatgtttccagactccaaattccagtttctttccctaacgctttgctccacacaagcaaagattcactgctaacatactgagtattggttcatcttccacgacaatgcttgtatctattccttcccgtttccacaactctgcttcctgtttctattatttgtgaccgggataattgggtattagcattctaacctgcttccttgcctcctaacctgcttccttgcctccaatctccctgttctctaatccatcttatatcttaaatctctgatcatgactttgtctctatttaacagcttcttattacccaatgaacatgagccagattttttagggtttgcatgcaagatccttcataagctggtcccaagctagcacgccaacctaatcttaccattccctcatatgaactctccactccaggtgctgttcacctgtaccttgcaatctgaatatttccaactctgtatcatactgtgtatgtcccttgcttaaaacagcatgctactcatttttgttcacatctctcagaacctagctcctgccctgttcccaacacaatgccaacccacaataattccattttgcctcaaatactgtcaatagctattttctatatctcacatctggaatctaccaattttattgcttttgaatgtaagtatatcttatctttcaaatcaggctgtaggtaacaagcgggcccatcaaatggtggtctactttcttctatcctccaaacctcaagcacagtcattggaacagtgcaataataagcatttgctacattcttcttcagtgagtatctccaccacctatgaaaaggcatgtctgtgaagaactagtacttactgtgttcctaccagagggcattaatacgtagaggaaaggtttcccatctgcctggggttgacagatttcaaaggggcaggaggctctatatttagctaatcttattgagtgtttgttaggaaaagagcaatgcattctgtgttttgattaatggttttcacgcttttgtttgtggagattttctttgtttctaaggagtattttttctttcacaataaactcccgagaataaaactcagaagatttagacatgcccaggaatttctctatttaatcagcactttaggtgcctcaaatgttagtggctttgcatttggcactcactttgagaaacgctgggatagtgtataaaaagaaactgcatagaagagaaagacttcatgttaattatggagtggtggtaaacaacattattaaatgtgatctactaatgggaatgcttgctcaaattaatgttttcattaaaaaatccatgtaatctaataaattaaggtatttttccaactgagaaagtgattctccacttgccttacaatcaccccatataactggcaggtccactagttaattctctacctcatgaaacactgagagtagtagtaatatggttgccacatgatacaatgcatgttgtatcataaaaatatatttcaactaaagggtagatgtgcttctaaatgaaagaggatatgggtagccagagagagcagtattgctccaaacaaaaatcggacacttgtcctttaggaaatttaaaatatgctgtccttcctttctgtttgctcttggttagggaggttttcactggaatctatttgaggcaagtgctgagtatatttgctgtcattgtgttctttgatctcagtatattgattggatgcagctgcagaaacaggtaatgtgggcaaatatgaagaaaacaaactgctgcctgcagataattttttctggagtgttaggggaaatccaagataattacacattttcttccatttatttttaagaatatgaatagcaatacacacttcagtcttcagaatggaggctgcaccttttaaactcactttgaattatgatttaaaatccattgtgctgcattcattcacttgcttgttcaaaaatatcactgagattttgtgttggacacataaataaggggctacctactctaagactagcatccaggtgtcctattcacacctcagaatgatgcttctctattctctatttccacaacaatcccagagttacataacccattacctcatttatatgttatctccactacttgccagtctagacacctctagtattttgtggtttcaatctatcttatattcaattaacaaaacaatctttccaaatataatttagattagccactggttcaataacacaatatcatgcctcattgattacccatcattcaattaatcactcaacaactaaagttacagagaacctactgctcttctgggcactggtgctagggtcaaaagggagagggaataaagaagaaatacaatgcatggcttgtgctcttaagggctacagtagatagaacaacagcctaccaaagttgtccacaccctaatccctagaaaatgtgaatttggcaagagtggttttgcagatgtcattaaggttacagactttaaaataggaagattgttttggattataagggtgaggccagtctaatctgggagcccttaaaagcagacaatttctccggctggaaacagagagatgcagcaaaagaagaagtcagattccaagcatgagagggactcagtgcgcccagtgctggctctgagatataggcccacatcaaggactgaagagaggcctttaggagctgaggttggtccccggttaaaacaaaatgaggtcctcggttctgcaacttcagggaaccagattctgccaacaacctgagtgaatctgaaagcaaattcttcccagagccttgcaataagagtccagcagaccaaaacttgatttcagccttgggagacctggaacagagaaacccgtcaaggtatcccagactgttgacctacagaatggtgagatgccatgtatctgttgttttcagctgctaaatgtagactgtttgctatggcagcaataggaaactaatacaaagaccctatgaacgatctatagggagggcagtcccactccataaagcaacacattccatcattaagtacaatatgcagggttggtgagaaccactggcatgttcctgtaagttttgaaaggattcagaggagagaaaagtcaatgaggctcatggtagttagagaaggctttatacagtaaatagtatttaaattgattgaataaagatgttagatttttttaagcaagcatttcaaaaaagtagaacatgacagtgacaggcacaagcaagttggaatgactgtgaaagaaaagcttgactggaatggcaaatatagtccaatagtacacataatgagcctcctaaattaaacagtggcttgaaaaatgttctcaggggtcactctaggcaaaagtatgatggggagcaaaaggaagggaactgtttgtacacatgatggggatatgtagtccctctctccatcttctccccatctggtcttcaatcagagtacctccactctgatagcttttacatagcaatttgaacaaagattcagcagctgtattagttttctaaggctgctgtaacaaagtaacacaaactgggtgacatagaacaatagaaatgtattatctcacagtcctggaggccagaagtctgagtctgaaactaaggtatcagcagaccaccttcagggctccctgaaggcagtagggaaggatctgctccaggcctccctcctagcttccagtgggttcctgagcttagcagcatgactccaatcttcacaggacattctccttgtacatttatagggttcactctattccagtctccaagatgacttcatcttaataaattacatctccaaagactctatttcccaataaggtcacattcttttttttttttttcttttcctttctttttcttttttttttttttagcagcgtttatttgatcaaagaacaattcatgaatcaggcagcccttaggatcagaaaagattcagagaactcccaggtcatattctgaggtactggggaccaaataaattttgggatttacaatccaacccataacaatggctgaaataaggtttgaaagctaaatatataaaatagcaactctgaccagcatcgaaagctcttcagccagtaatttaccctccaatgtggacagactggcccttttaggtgcacaatttactcacccttcctgctacttactacccttttcttctcctagaactttccatacccagttctgaggattagtcccagagttttctcctttagaagaaatctagatgataatctatttctagggagagtcttctactttacaggttatattagtagtaaactgtcttatgcttactaaactacttagtaatcactgaactgatatcctctgtgacaggtgtccccagcccccaagctgtggaccggtagcagtctgtggcctgttaggaatggggccacacagcaggagatgtgcagccagccaagagcaagcattgccacctgagctctgcctcctgtcaggtcagcggccgcattagattatcataggagtgcaaatcctattgtgaactgcacatctgagaaatctaggttgcaccctccttatgagaatctaattcctgatgatctgaggtgaaacagtttcatcctgaaaccatctctccaacttccacccccagcccatggaaaaattgtcttccacgaaactggtccccggtgccaaaaagtttggagaccgttcctctatgagactggagccaagatgtatgactcatcttaatcatgctgcacccaaaatcagtgttctacagccagcacaaaccctatatatgtttattgaaaattagtccatctaaaaatatattcagatgttacacacctaaaaacaacgcattcaaggctaaatttagactttgtcccatagaaatacacctctagcccagattttaatttaagcacttcagtgtgtcaatcactttggcaaatacagccgggtacccacatagctctgtactgttgatgctaagtcagccttccagccaaaaccagagaggcaccacctagcattgtgatgtcagtattatgtgtcagcaagatacttagccctgcaacccttaggtggtcatgctttctcccagcccatgaatttctcatgtgaaattttcaagatgtaacaatttttaaaattaagctttagaaactctcaactgagattcacgtttcaaagtaatggcatcctgaaagctcaggcctgtccaaggaaggtttattttattcttttatgccagaaagacatgaggtatatagggcccagaactgtccacaaagacatcttctcctatataggatcttcttccatataggatctcctgtatcagggatctacaaccagggagaaaagtacagagtttttaaactttttctagaaatcccttgaaaccttaagtttagagtcaaggggcttcacctaattcttcctatctccaaggaactatttaaagcagatttgcacttactcattcttggccttttctgtgccctcttgtatagttcatatatagaacctataattaggcactcactactttcaaaagcatgtgtttttcacaccataccaccagcctttggaaaaaggatgttctacataaataggcaaaaggccaagaacaaatattttttaagttttagataattttttatcacatccaagggtggcatttgcaaagactttttttaaaagaagtcatttaattactgcatttaaaattcacataaagcactgtgctagagattaacgatctatgtggaaaaacattttgaatttaaaaagtactgtaccaacatttacaagagttgtagcatcttaagttgaaaagggattgatctatggaaagtagaagtataaatacatacttaaagctgcagaaacatatttgtttttgaaaaaagaagttgaacatttattcatccctgtaaatatagagtgttactatgagagaaaaaaaatcagcataatctacagaagccctaaattctttcatgaacacccttgagaccgtcacctattacttggatcaatcttcacattctataatccatttttactcttaaggaaaaatttaattgacttcttgatgcaacattgtttttttttgtttctttttttttaatttaggaaatgttcaagtctttacatctccacaatacatagtcttataagaagacaattcaggaaactgagagctttcaaagccacttgtggctactcttaaattactttctgcagttaaaataactgtgtgtttgtaaacaaagtgcttttcaagagtaagatccccaaacagtcatacgttatttttttccatgtgagaaaatgcattattgtgaaggttcagagacataaagatggcactagagaactaggatgatgctttcacctccataaaaggagaagtataaaagagaactgcccaaggaaactccaatattcagttgcatgtcagcaaatgggggaaacgttctaaaatgccctacctttatacatttaaaaagatgaaagattaagtttcaaggaactcacagcaaaaaaagagaaaacaccccaaacagtactttgactacctccagaggaattaaagggctatcattccacatgaaaatatcccagcatttctgttgttgtgtctctgcctatgtgattggtcccgaaggccccatacacactggtgttctcagatcacagctgcttcttgtgctttaacttgattgcctctacacgtacagacacagggcatgaagcccatttatcgcaggctcaaatctctgttgatgtcattggaatctaagccttcttgctcctgagctgcaacaggcaagtatagaggcccatagaagacgggagatgaatatttaacttgtccagagttcccagacacctcagaaaatattattacatctacttagtactgactgttgttatcagcaccaagtcaggacagctttatatttttgctggagtaaaatttcagaataaaaaccttttggtattggaactcaaaaatgcgtaacttctgcctgaggaatttcataattcagagatgctgagatggtatctacctatgcgttcttgtaaaggtgcagtgaggaacagagcttagttttgttgttgtttaaactttttccatgttcccgttgacttctattctcatttaaaaggaatttttattttcacttctcaaatatcctcacacttgaacttcaacttttagtttctaggtcaagtagtaattgtatgagatgaattccaattcaaagattcctgttatttggagccagtcccgtaactaggtaagaaccttttcttgtacatctacactaaataatttgtctgttttgcaaatgtggattctcaaaacatagatatcttaaatatgggcatatctcaactgaacaaagcaagcatcaattgaacgcctactttaagcacagcaaggcctcagaaaacagacaatataaaggaagtgagacgcagcaaacagtgagagaataattccaagcccacaggcgagaagtcaattttcaaacagttcactgtgtacaggtccatgctatgcaagcacaggatattttttcataatatataaattgatgccttcaacaatctgtggtggtccatccacacacacaaaaagaaaaaaaccaactatggtgccaagtagtataaaaagttatttatccaaactgctgcttttgttttgatattcaaatatagattgtagtcacaggaagaggaaagatgatagaaggtaaaaacgagctctggagtgagagctgtgtttgaatcctggttttgactctttctagctgtgggtcttggcaacgttgttcactcctgggtacctcatttgcttccctttgtttttgctgaagagtccataaaatgaattgcagagcactaaacaaatcttatttattattatgtagtcttgttgttacaccttacaacacaattgtataaaccatagctttttatgaggttttaaagattgtttgatgagaacctgctctgcatcttgtctttcaccatttctactccaaatcaagtccaagttcttgccactttccttgtggctttgggattccagtctgtttaaatggccacacaccaacctggctatccaggttcttaaacccctatccttcagtgtctcgggaatctctgctttccatggatctttccagatgaaaacttaggagacccctgaagattggaaatgaaataatgtgttttagaagagaatcttgggaaaatatttaacatgaagcaataagctgtatttggatgcctgaagagatccctcatccaaggcacaggacgtctgtatcaacatgcctggctttgtgctgttaacaggtatgaagacagactaggtaacacaaagtgttggcaaagaaagagcagtggttctcaaatgaggatgattttgcctcccctcttctaggtgacatttggccatgtcttgaaactttcgggtgtcacagctggggatgggaggaggtgactgccatctgcaaggtgaaggccagagtgccaatgaacatccatcaatgcacagacagagcctactaccccaacacagaattatctggcccaaaatgtcaatagtgtcaagggagataaaccctgacaaaagcaaaagtaactctcaaacactgctggtgggactgcacactgtacaatccctttggaaagcaatttggcattatgtgatacagctcaggttcaagatgctcacagcctgcaacccagcttttctcctcctgggtaccttcaagaaactcctatgtaagagttttaagaaaatcttttaaaagtcatattcagtattgtttatagaagcaatccaaatttctattaggggaatggctaaattgtggtacatccatgcaatgtgaaaccatctagtagtgaaaatgaatgagctacagttgcgtgtgtcaagagaggaaagcacagaagcagactgactttctcagatgaaaggaactgcagaaaatcaaaagctggggtgatagaacaagcagggtgtccagtgctgacaacagagacagtgatgggtgtaagctttgggctgtgacacacagatgcttctcctgtgttatgagcatgcaagggtcttgcctttaagatcacctgccatctttggtatcagatacccaggtcatttgctggctactatttggccccttagatcccctggtagaaatcctaagccttttgttctcataaaaggaagatatttcactataatcaactaagttgatttcatcatcaacttctcagatcagtttatacaaagattatattattttttggtgaattccattagcattccactagtcaaccaatgtttgagtgcctgctctacgctgtgttccatgtttggtgctttaccaacagtggggatgaaaagtatgtggtctttgttttcagggaccgccagaaaaactaaagaacatcctctggcagtatcaaatagggccctgcagtggaaggaatggggtgaggtccatcagagaaagtctatcagaataggaaacagctatagagaacagaaggatgaaaaggagtcactcatgcaaagaactgggagagaaacattccacagagaaggaaccctgaaatttgagaagataaaacaataatcagtaaaaccattactttaatgtagcatacttcatgtgagtcattttgcctggttcatactttatagagatgcaatcataatttacatacaattttatatcttgctcattattatatcatgaataactttttcacgttgtaatatagtcttcacaaacatttaaatggatgcattatattccctagagtggttaaaacatcttttatttaattagtgttttggggcttagtcattcttattacttgttctttgtccctctagtgtaaagatgaaggtctctctttatgtaacttttccctatgtcttttgcattattgccttaggccagcttttcctaccttaaatttaaacacatatacacacaaatgatgaagtatgtttcattcctgtttcatcttaatcacttttatctttaaaatccttaagcttagagaatagttcacattacccaagccatacaatgtctttcatttcggcacagtcttggactgtctttaaaattcatcacatacataaactgaaaaactgaactacagctaccaaaaaaggttttaaaattgaaatctggttttagggggctgacatttcttgagcttgtgatttaaagtacattttttctttttgtagtctctggcagtcaaccttacagatctcccgtctgagctggtttatgatcagcaggctacattctagatgacaggattacctactaatgtcttagaattaagtaccactaacttgaatcataagcaaattaaacatttcagctcaaatgctttcctgtgactccagcaactttcaggtcttaagattaacaggttgtggtctgtaataaaaaaataaaataaaatcccctacaacttcagcttccctcaagaatccacttacctaagagcaaaagaggtatcctgtgatgggactgaagccctttggtgaaaataaaaagtttaagtgacaacacttagtgtcagcatgacaggttataacccagagaaatctaacccacttggcttactcatcttagtatcactcagggtggaaggcagcataatgatttagctattatttaataactaagataaatcattgaagtaaataatatccttgccatcattaagaataatcccagtgtaagtcatttctaaactacttcacggtgtatgatgcaacaataataaaagcttacgttcacaaagttctttagttcacaaatcatattaatattaacatatttgatccccctaccatacatggtagataggaaagaaagcttctttatcttgtggatattttagagcatcattttcaaggttaagagacctgcttgaagtagtatataatgaagtgaggcaacgaaccctggtctcctgattccaaatcaactgttctttcaactgcaccatgataccctggatcaaagcgtagaacacggattagcttctagttccagctttgacatgaactagccatgtcaccttatacaagtcaagtaactaagcctcagtttattagtaaaatgtcatttgatcacatgatctctgaaggttgaaaattccattttctataaaagaattttctttttacttccatgggaagaaagtgtcttcccactacagattcctgctccccacctctccatccaattattcccctgcaagtatatagatatgatcgattcattaagtcagcttcaatgctataacattatcatcataacagtgataaggtaatattaatagctaattttaagtgtgtgtttactgtttgcaaggtactattttaagcgctttatatgataattcttttaatccttacaatggccctagaacaagctgaaattattattcccactctccagattagaaaatgcaggcctgaagaggtcaaggaatgtgttcaaagtcacaatgccagagctgggattccaactcagacagcctggctcttgagcccacgcacttaatcactaccttacgaatccacattccttgacttaacaatttcacatactttctaagagtgaatttcaactgataacattttttttttttttttttttgaccacagatgttgcctgaatctcactttctggaacagtagcatatgaccatatataaagcccccaaccaacactttccctaatggactattccctgctcattcctgacagaggtgtccgcactgtttctggggttcctttcattatacagactctcaaaaccaaacaggttatttggtaaatggaagagatctattacagtgtggagtcattaaaacagtccttcccagtatccagctcccttccgctttgcctgcttgactttctagagagcccacctcctctttcgagtcagtagagagtcactgagttcaatttgctgcaaactaattaattcctaagaactttgacactagaagctaagaccccaaaacagctcctcctcctttcatcctgagagaaaatatttcagatataatacatacattttcaatttccatatttaaaattcgcttcaatccatttttccccatatttataaggtcacatttgttctttatgttaatggcacagatttcagagccaggagactcaaagtacttctcaaataaagagtgtattcctcactgtgtggtaaaagagtttactcagcttcctctttgaaccatagacagcatttccaccttctaaacgctgtatcccaaatggacaggctgcccctcttgctggacagccctgggacccaggggacatgctagtcgttctccatcactgtccttgtaaagttgtacaaaccagtcttgaaccaagtatttcagcataagggggactatacaggaaaaatataccagcatctgtcagtagcagtgaatgtataaaataaacatcataaagtgggaaaaagacttccaaacaactctcagcaatcttgtctaactatcctgaccttaaaatgccaaagtacactgcagtaaatgggagagcaacatatcaagtgctgtcactatttgccgttccattctagaattccaccacctcgatcttgaaacctccaatcagatgtgctacagtaaatctcccttccactaatcaagatggaaatcttttctttcccaatcaggtccaattgcacagacaaagcagtgcatctgtttccctttcaagacagctcacccaggggatggtggagctttaccgacagaacagctagatggtttgtcatatatcttctcctctcgcagagtgtctctgccatcttttatcagtggttatccagagcttccctttttgtgacaatattaacccaggactgctgccataagcattcagactccacttgctgcctgcagggacttctgaggagagtttatcaagactgctgagcctgatgcttttacgttaaagtggctcccactcgcagttattagtgtgtgcggcgagcccacacccgcacacacatgaggccaactccccacaagagtgctacgcagagcagtagcaatccatctgttttcagttagaaaatacaattgcttttgcacagttgaagaactgatctgatatgaaatgaccctggcagttttgaggtgatagcaaatactctgatgtggctgccaaggtaaggcattaaaggggttacgtaagcataaggcatccctgtgccacttaggaatgtccgtaaagcaataaacaaacagaccaatagacacagaagttgcactatattcccaacttacaatacaaagagcctgcaatcatcagaccctgactttcagaacactgaaatgcttaccttggatgatgttttaaaaaataattttattatgggcatattatattttataattctcagtgattcatacaaaagcaatactctttaaaatggccagaaggatgggcattttaaaagagatgatattagaggaaatgtttaatttcattgcctttggggctccttgtaaggatggaaggcaagattgtgcaacggctgggaacgtgggtgagggcagagtgggggcagatagaactcaaaaaccagctctgcatcttcctagctgtgggacctgggcaagttatttaacccctctgaactagtgcaactgggtgttaataaccacagctacttctctgggttgtaaaaagcttgtgcagatgctgtgcagaaatggtgtgtcatgaatatgaggataatggtttgtcatcatcatccatagtatactatggtttctatcattgtgagttcccaaagaattctgcaatgactgtaacgaagtaatctgtcccatgccttgcagaatcatctctacctctgtgcctttctttattccacactgtgtttgtatttttgccatagaaagcaaagatggagaaaaaatagctagcattccctctaaagagaaatgtcattctgccctgtaacaacaggaacatacacagcctattttgttgaggcattgacaagactccattcacagcaatggcgatgggagtgactattccaaagccatggcttcttcttttctacatttcattccatattgtccttgtggatgtcccatttcacttaagctttctttttggccctgagacatttatcagcatagcctacatgcagatctaccctcccaagcatgccccagcaataactcgtctccagtcctctttaaaacacaaccttctcctggtttactcaggtgacaagcttgctaagtctaataaactgatctagtatacatacatagctcctgatagattaatatattaccatactggcgatactgacaatttttgaagagactatctgaagcaaaatgtaataatctaaatgaattactttctcacgctagaattctagacatttaagcaggtcagtagagagataaagggagcattttgaggcagggtgcttttgaaggcatctcaagttataataaaaggcaacaacctgtttttcatactgtgacatgaaacccacaaaaggagacagttgtttttgtggaatgataaagagaagtaggccattacatgcttaattaaagattcaatccttttaatccagcagaaatgtgacccccaactgagtagaaacgtggtcttcagggaataagcatgttttttttgtttgttgttttgttgttttaatagagaaaagcattaggacaaatctctttattacagggctgaatgcatcctcatgccattggcctccggtggtggtctctgaggtggtctctttctcacccaagagagaggtctggttccatcatgcccagagcactatgtcacatgcattcaacttgccaagaaaagaaagaactcaactaggattatggatgctgttttaaatgaatgtggctccctcttctggtggaaagcctgaatcaataataaaatcatctcaaaggagaaaaggtgcttagcttcttcctctcccagctccagaaatatatgtcaacacaataccactaacaagtgaaccagacaacaatagatccgccgtagttctcatattctgcaaccaaggctaagtggtgaagagatccacaactgagatgcagcaacaagagaagagaaaaagaaatggactttagagggctggatctcttaaaaataagcccttcctataaatatatacatggatatagggaatggagaactaatgctgctttggaaaactactgctaacagaattcttctggggaacaagttaataatgataaaatgtctatttgacatcttgatttttagtgaggtcaaatctacaatattaaaagtatcttccatcacatttcagtaagtcctatggagactctggacactttgaaaacacttttgtttactagaaataatgacttgagccccaactatatacctatttatcattaagccaaaaatgtagataaccttacaaatggcgtaaaatatctatacttaaataaattccaaagcaaagcaaacaaaagtatatgttgataatgcactatgctgcttcctaaataaattctaacaggctgagggttatagaggcctgagaaataaacacggagaacaaaacaaataaccctaacactccaaacagaggagcccagttagactcccacattttgtgtcttaacacttcattgattgttaaattatattcactcctgaatgaccccaatgtttctgcatcacaaatcttgccacttgctggaggctacaacccatatcttttctttttgagactgagtttatcatatctgtttttttgagactgagtttcactcttgttgcctaagctggagtgcaaaggcacgatcttagctcactgcaacctccgcctcccaagttcaagcgattctcctgtctcagcctccaagtagctgggattacaggtgcccaccaccacatctggctaatcgttttttttttgttgttgttgtttttgagatggagtcttgctctgttgcccaggctggagtgcagtggcacaatctgggctcactgcaagctccgcctcccgggttcatgccattctcctgcctcagcctcccgaggagctgggactacaggcgcccaccaacacgcccagctaattttttgtatttttagtagagacgggttttcactgtgttagccagggtagtctcgagagatggggtttcatcacattggtcaggctgctcaaacacctgacctcaggtgatctgcctgcctcgacctcccaaagagctgggattacaggcgggagccaccgtgacgggctatcatatctttatggaagggtttcagtgctggaagcaatgcactgtgctgtcaggcagaaggttcaggttcaggagcactgagggctgcatcctcaagccaggggcaaccagtaaagactcaggtgagattatgtttgatctctgaggagtgcctgtctcctcattcccacgaagattaagtaaagtctttagatttggggatggcaggaggttggggtgggatattgccagagacaacttgatagtggtcatattttctgttctttcatataaagaggtagatttcaactctggggggagctggaagaaagaaaatggctatggaaatactgagcatcattcatatagacaaaaagtctctccttgactgaactccactcaggttattttgaacttttatcaatgaagccctgacttgtgaactttcatgttcatctctccattgttgattttggcaagaatcctgctaagtcagtttagacagaattccccagcctccaaatctgatcatcctccaccatcccccaggtgatgatgtctgatcaccctggcctgtcttcagcaagaatcctgtttggctggtttaccagaatccccccttaccacccactggtccccctaaccctggctcctttgctataaattcccacttttccttgtcgtattcagaattgagcctgaattgagttctatacagaggcctcttgctcccattgcaatactcgagtaaaatctgtttttactattttaaccatggtctagctctggcttttctttgacaatatccacatatgacagatttaccaaaaataaaatctgtttttgccatttagtcatggtctagctctggctttctttgacaatatccacatatgacagatttaccaaaaatctggacactgggatagctataaacgacagatatatgagacatttggaaatcaggagaggggataaacagaatggagagaaggtagaaaaatacatacgctttttttcccccagtgattaaaaacacaaacctggtacaataccattaactgaattaaagtgtttatttgaatttcatcaatttttctcctaatattctatctctgttccagcatcctatccagaatcccatgtggcatttatggccatgtctccttagtctcttctaagctgtagcagttgccaagtctttccttgacttttatgaccttgataaaataccctccagtttgggtttttctgatgtttctcattattggaatgaggttatacattttagacaagtatactacaagaaaaatattagtgtaccttatcaagaagttcatggtgccactagatcttaatactagggatgtttatcttgatggcttacttgtagtaggctctaccaggtctctctactgcgaagttactattttctccttgtatttaacatatatcatggaagagataccttgagactaggcaaattctattattcctcatactttcacccactaattttagcatccatcattatggactcaaggaaatttattttattctacaggctaaaatccatcaccgaggttaattgcattattcattttcttgctcaaattgtaccagctttggttattaaaagctccttttaggttgcattctgtgtccttttgagaaatccccatctatttgggaggcatttccctattctcaggcacaacaaaatattccaagtaacatctttttttttttttctcccccctgctccagctttggaatcaaccatttctccaaagagtcccagttcattttactctacaagaatggtgtttagaaaccaagattggtctctagctgtactctctgtaatgaataacctcatgcgtgtttacttctacaccaccgcagatgcatcatgagggtagatccctaaaccgagactgccaagtccaaagatgtaggtaatcttgttagatgtgactaaatttccctacagaagaattgcaccaatttgcattaaggccagcaatgtatgagtgtctgttttcccacagcatcaccaacagaatgtggtgtgatattatttagttttcaccagtctgataagtgagaaatggtatctccatggtttttaaatttacagttctctaactactgaacttttttttcatatgcccaggggtcatctgtatataacttttgtgaatcatatgtgcatgtctccttcccataattgggtttttctattggatccttgaacctaagattttaagggtttaataccatagacatgttaaccctttcttgtgatatatgttgcaaatacacatttttttgccctagtttgtctgttgtcttttgactttatagtattttttcatgcaattttttagagtttttatataaaatccatcagtcttttgttgcatccagatttgagtcataattagaacgtttttctgtactaggattagagaggaatccagctatgttttctttggaattcttctgtcttttcctctagtacttagtttcatgtactgttcttcacagtgatttgaagtaacagatttttttttggtggtgatttcaaagctgtcagggttatccaaaactttctgagaattgctttaatatctgtactcctacttagaccaaggctaactccaatagtatatatttcacttggagtcactagtaagaaggaattatttgattgaagaattataatcctatctcttctgttccatgtctgcctctgtctcttactctctcgccccacagatgggaaactagaattcaaatgataagcctaattgggttaggagccaccatggaataattcccaacagcccattctttatttgagggtacactctcagctccatataccaaccttcattgtgaaggatgaaggccagaaaccacggtaaatccattcataggacttgcttccccattattagcaccatctgagtctgttaaaaatcttaactaggagtttaatttctctacagagggctttaaattaattagggatgtacatgctaacaaagagcctgatgcatccataaatcaatctggggtaggaggactagtcagggaggatcgtctattcagtggagaccgcatatccagcatccctgttgggttcccaacaaaagggtgcaggtgtggaataggccactgtgacaaggaagccccaataattattttgcatcacttaagccacagcaggtaatatggcaaatcaaagtcccaggcgctcaccaagtgaaacccatgttgccatgaaaagccacatcatatcactttaacctctataaatgaattgccataacactgtgatttattttataccaagcctaagaattaaaagggcattgatcaaaatgatctcctttttccccttttgttaagaatagaaagtaacagatggaaccacttttttttttaatgtgctgaacattatttagaacaacctcggaaattgctggtgtcttttattaaatatacttgctttaaggtttacgctcacatacaattatgttctttggatagaatgttacttatattccattagttaaacacagcactcatttgaaatccactttaaaactgcgtaacaacaactcccaatattcaaacacttccatgtgctagtaacctggtttctagtctttgattagcaaacatctgatgaacaaaagcaaccatggatccttttaaaacaattttgtattttatttgccataatatcatctatatctatatgacagtcatgagtgtatgtgaatgaaacaaaactttttaaaaaatctataaacaatgcccagtttcagtgtggttacagtctctcttgcaggaatttctttgtccatctaaactattcagactccaccccacttccccaactttagggttctgaagtccatatgctagaaaagcaaatacatttaattccatatagggaatattctataattaatccctctttaagctaaaaatgtgttattacataagccctcactaataaagttaagaaatcagtgattttaaaatatgaagcccaaaaagtctcatgatgacatctcaaaagttatcactgatttaagctacattatccaggcggcagatatttaagtttagaaatactggagtcaacactctaagaattttagcgacacaggaggttttgttttctatatatatatatatatatatatactcaagaaacttctgtaaaatgcatgttttccatctctccatccgtgatcacagcgttgtaaggcttacaatgactcaggccctacagagttcacagacatggcaagcaaagaaaagaaaacgaaaaaaggaacactctgtacaaaagatgagagatttaatcacattccctatactgaaggccctggaccaaaccatgaagatgaatgtgggggtgtggggaggggatccagtaatgtactgtccaagccattcatgtgcaaccccgcacagcttcactttacccccttaaaccacacagatgttctcagaatgcaaacatggattactgccagccatgttaaataacccttatcccatatcctgacctaagctctcaccccaactgtttggctactttcataccacaggtttgtaaaactgtggtctatatctgaggtctccactcctacaccagatattttctagtcgagacttccatactagggaggctatcatgaggcaccccaacaacacccatgggagtggtatcagggaaggccatgaagggagccaggacttccatcactgccaggtggtaatgagctccccatccccacaatgtaagtggagaccacctgggaagtctggacttccacctctacccagcagtaatgaagcatcagcccacccccaacaattccccgttggggtggtgtgagaggaggcctggtggagaggcaggatttcatcaatgctgagtggcaaggaggctgcctacctctcctgtcaacgtaggccaagtggatgacaatagcaaggcccttcttcccatcccaataggggtgcagggtagctgtggaagcctagtagggagccagaagtcccacacctgcccagcagaagttcccctttggtatcaatggaggctgataaagaacctggactagtttcccaaactggcagtaactaggcagatcctcccttttctcctactggagacgtagcaatagatgccaggcagagccgaaggtttaaataagaaccagggctgggagcagtggctcatgcctgtaatcccagcactttgggaggccgagcaggtggatcccattgaggtcaggagtttgagacgaccctggccaacatggggaaattctgtctctataaaaaacatgaaaattatccaggtgtggttgtggtgggacaatcctgtagtctcagctactcaggaggctgaggctggagaattgcctgaacccgggaagtggaagttgtagtgagccaagatcaggccactgcactccagcctgggtgacacaatgagaccctgtctcaaaaaaaaaaaaaaaaaaaaaaaaaaaaaaaaaaaaaaaggccaggcgcattggctcacgcctgtaatcccagaactttgggaggccgatgcgggcggatcacgaggtcagaagattgagaccatcctggctaacacggtgaaaacctgtctctactaaaaatataaaaaattagccaggcgcggtggcgggcacctgtagtcccagctactcgggaggctgaggcaggagaatggcataaacccaggaggcggagcttgcagtgagccgagatagcgccactgcactccagcctgggcaacagagcaaggcaagactccgtctcaaaaaaaaaaaaaaaaaaaaaaaacccaggtctctcctaatataaaccagcagggcctaagcatggtagctcattcctttaatcccaacactttgagaggctaaggcaggtggatcacttgaggccaggaattcaaaaccagcctgcgtaacatagggagaccttatctctacaaaaaatatttaaaaattatctgagcttggtggtgtcagcatgtagacctagctactcaggaggctgaggtgggaggatgccactgcactctaggctgggtggcaaagccacacagaccctgtctttaaaacaaaaccccaaaaaacaaaagaaagcaaaaagtaacaaaaataacaggttgagtataccttatttaaaaggcttggaaccagaattgtttcagatttggtttttttttttttttggattttgcagtttgtattacacttaccagttgaacatccctaacccagaaattcaaaatgctccaacaagcatttcctttaggtggtatgttggcactcaaaaagttttgaattttggagcattttcaattaaggattttaggaatagggatgtttaacctatactccaaaagtccaggtttcaattaaaaaaaaatcactcataaaacaaaaaaccaagatctctaagtgaatggaaaaagacaatcaatagatgacaacgagaagacagagatgtttgaattatctgatgcagattttaaagcagttgtgattaaaatgcttcaatgaatagtaatgaacatgtttaacaagtaaaaaccagaaatccttagcaaagaaatacaaagtcttagcaaagaaattaaagatataaacaagaactaaaagaaaatttagtactgaaaaattcagtagccaaaatatacaagtcaatgagtgggctcaatcgtagcatggaggtgcagtgaacttcacagacaaaagaaaatacacagtctgaatgaaagagagaaattcaactgaaaaaaaggaataatgaacagtgtctcaggaatgtgtaggaatgaaacagagggtttcagatttacgtcctcagagtttttgaggaagagaaaagagactgaaaaagaattcaaagaaagaatagataaaaaaaaaatcaaatttgacaaaatacatacagatttaagaaacagagtaaaccccaaacaggtaaacccagcgaactctgtgccaagacaaaccatcgtcaagcttctgagaatgaaagacaaaggaagtcttgaaagcagtgagggaggaatgacaccatacctacagggtaaaacacttgcattaggaatcttggagggcagaaggaagtggcacaccatttttcaaatgctgaaaaaaaaagaatgccaatcccagaatcctatacccagtcaaagtatccctcagtaatgaaggagaaatcaagacatctcaaataaaggaaaactcaagaaaatctgttgccagtagacttatcctaaaagaatgattaaagacgtttttttttccttttcttttctttctttctttgaaacagggtctcactgtgttgttcaggctatagtacagtggcatgatctaggctcacggcagcctcgaactccccaggctcaggtgatcctccccactgcagtctccgtagtagctggagactacaggaacacaccaccaagcctgcctaatttttgtatttttttgtagagacgcggtttcactatgttacccaggctggtcttgaactcctgagctcaggccatccatccgccttggcctcccaaagtgctgggattacagacgtgagccactgtgcctggccaaatggttaaagaaagttttctaaataaaaacagaaatgataaagaagtaaccaactcaaaacagattaaagatacaaatataagacctgaaaccataacactcctagaagaaaatataggggaaaagttccttgatattggtttggcaacaatgtttttaatatcaggcaacaaaagcaagcaaatgaggctatatcgaactgaaaagcttctacacagcaaaggaaacaatgaacaaaattaaaaggtggcctatggactgggagaaaatatttgcaaactatgtatctaataagggattaaaatccaaaatatataagaaataaaataaaaataaataaaaacctatgatgcttatttacacatacacactcaagaaggaatcttggaacatcgggggaaagaaagaacatggtaagaaaaaatataaataaatataatgggtttttattctcatgagtttctaaattatatttcacaactgaagcaaaaacaacactatgtgatatggttctaaatgtgtgtcaaggaaatctttaagacatttacattataagcaggacaggtaaaagggacaaagatttctgtactttacttgaactggtaaaatgatgacactgatatacttcttagttatgtatatataatgtaatacttaaaggatccactagaaaagctacataaaccgatacactaaaaaatactctaaatacatcaaaacagaatcctaaaacatgtttacatgcaaggaaaaaaagcacagaaatgaaaaacggagggaaaaatggaaggcaataaataaaatgacagacttgaattgtaatacatcaataattccattgaaagtaaatgatctaaatgtgctaattaaaatcatatttctctgggaggctgagctgggcaggtcgtttgagcccaggggttcagggccagcctcagcaacatggtaaatccccatctctacaaaaaaaaaaaaaaaaaaaaaaaaattagccaggcatggtggttcatgcctgtagtcccagctacttgggaggctgaggtgaaaggattgcttgaccctcggaggcagaggttgcagtgagccgagatcacaccactgcattctaggctgagtgtcaaagtgagactctgtctcaaaataaggataaaaatgaaaaataaagacagatttgtacttgtacagtggatttaaaaacatgacagacacaagtaagtgctatctacaaaaaactcacttaaaataatataatgatatagatagggttaaaagtaaaaggacgaaaaaagatatatcacactaacattactccaaagaaagctagagtgactatattaatatcaggtagacttcagagcaaagaaagtgacaagagaggtacatcataaaattataaaatggtctattcaccaagaagacatagtaatcattaatgtgcaccaatcaagagctggaaaatatgtgaaatggaactgaaagaactgaaaggagtaatagacaaatacacaattatagttgtagacttcaacactcttctcccaacaactgatagaccaactacacagaaaatcagcaggatacacaacaatagcattaaccaacaaataggatctattcaacatttatggaacagtctacccaatgtaattaatacaaaagtacataaaatacactaaagaaattcaatgcacatcttttctgagtgcccagggaacatttgccaagatagaccatatcctgagccataaaaaactcagcaaatattaaaaatttgaaatcatacggactgtgttctccaaccacaatgggattaaacttcgaataaaaaataagagaccagtaaaatatccaaacacttgaaattaaacagcacacttctaaataatttatgtgtcaaacaagtctcaagtgaaataaaaaatacatttgactgaataaaaatgaatatatgacatatcagaatttgtgggatacaactaaagcaatgccatgagggaaatttatagcactagattcatacattggaagagaagtctcaaatcagtaatgtaagttcccaactcaaaaacagaaaaagaacaactaaatccaaagatgtagaagaaaggaatgaataaatataagagcagaaatcaatgaaactggaaacaaaagcaataaataaaataaatgaaagtaagagcagattcttgaaaagttcaatcaagttgacaaatttctagcaagattgcaaaggaaaaaagagaaaagacacaaattaccaatagtaggaagaaaacaggagctatcactacagacacagcagatatcaaaaggatagtaagaaaatactatgaacaacactgcatacataaatttgacaactttgatgaaatgggtcatttccttcaaaaacacaaactaccataactcacccaataagaaacagataatttccatgaccctgttaataatattaagaaaattcaatttataatttaaaaatccacacacaaaagaaatctccaggcacagatggtttcactagagaaatctacaaaatgcttaaagaagaattaacaccaattttatacaatctctttcagaaaatacaacaagagggaatacttcccaattcattttataaaattagtattaccctgatactaaaacgagataaaggcaaataaaaaaactacaaatcaacatccctcataaatgttaatgcaaaactcattaccagcacactaagaaacagaattcagtaatacataaaaagaattatgaccaaatagaattcatcagagggacatgagaatggaaaaaaatatccatcttatcaacagtctaaaaaaatcaacatcaattgatgtgggaaaaagcatttgacaaacttcagcccattcatgatgaaaactttcagaaaaatgggaatggaggggaacttcctcagttaaaagagcactggccaaaaaccaaacaaacaaacacctcacaaactacagataaatggtgaaaaaagactgaaagttttctcacaaataatgagaacaaggttagactgtccactttcactaattttgttcaacataatgctgaaagatctagccattgcaatcaggcaagaaagcaaactgaagtcatacaggttaggaagaaataaactttctattttcagaagacattgtctatataaaaaatcccaaggaatctacaaaacctcctaaaattaataactatatctcacagaatcataggatacaagattagcacccaaaaatctactgtatttctatatattatcagcaagtatgtgcaaaacaaaatttatatttttatttttattttttttctacttttgtgttacattcagagtgtacacgtgcagggtttttacatgggcatattgtgtgatgctgaattttcaggtatgaataatcctgtcacccaagtagtgagcacagtacccaacaggtagtttgttagcccactcacccttcctccctgctctagtagtccccagtgtctattgttctcatctttacatccatctgtactcaaattttaactcccacctataagtgaaaacacaccatatttggttttctgttcctgtgttaattagtttatgataatggcctccagctccatccatgttgcttcaaaaaaacatgattttgttcatttttatggttgtgtagtattctacggtgtatatgtatcatcttttctttatccaatccaccactgatggacacttaggttggttccatgtcttcgttattgtgaatagtgctgtgactaacatatgaatgcatgtgtctttttggtagaacaatttatattcctttgggtgtatacccagtaatcggattgcggggtccaatggcaatctgttttatgttctttgggaaatctgtaaactgctttccacagggactgaactaatatgcattcacactaacagtgtataagtgttcccttttctcaacaacccctccaacatctgttattttttgacttttaaatagtagccattctgactggtgtgagatggtatcttactgtggttttgacttgcatttctctgatgactagtgatattgaacatcttttcatgtttgttggctgcttccatgtattcttttgagaagtgtctattcatgttctttgcccactttttaaggggttggtttgtattttgcttgttaatttgtttaagtttcttatagattctggatattagaccttcgtcagatgcatagtttgcaaatatcttctcccaacatacaggttttctgtttactctgttgaaagtttattttgctatgcagaagctctttagttaagtctcatttgcctattttttattttgttgcttttgcttttggggtcttcatcttaaattcattgcctagaccactatctacaagagtatttgctaggatttcttccagaatttttatagtttgaattcacacatttaagtcttttgtccatcttgtgttaatttctgtataggatgagagctaggggtccaatttcattcttctgcgtatggctagccagctattccagcatcatgtattgaataggattcctttccctattgcttattttttgtcaactttgtcaaagatcagatggttataggtgtgcagctttatttcagtgttttctattctttctcactggtctatgtgtctgcttttgcaccagtaccacggtgttttggttactgtggcactatagtatagtttgaagttgggtaatgtaatacctccagctatgcttcttttgctccagaattctttgactatttacgctcttttttggttccatatacattttagaacagtttttttttctatttctgtgaaaaatgacattagtattttgacagaaacagcactgaacctataaattgctttgggcagtatggccaactgtaataatattgatttttctgatccataagcataaaatatttttccatatatttgtgtgatccctgatttctttcatcagtgttttatagttctcctttagtgatctttcacctccttagctgtattcctcgatacttcattttttatggctattttgtaaatggggttgtattcttgatttggttctcagctagaatattattagtgtaaagaaatgccagcaattttttacactaattttgtaccctgaaactctattgatgtaatttatcagttctgggagccttttggtagaatctttagggctttctaggtatagaaccatatcgtcagtgaagagagatagtttgacttcttcttttcctatctggatgcctttttatttctttctcttgcctgattcctctggctaggacttccagtcctatattgaataggagtggtaagagtaagcatccttgtcttgttccgttcctcaaggagaatgcatccagctcttgcttgttcagtatgatgttggctgtaggtttgtcataaatggctcttattatattgaggtatgttccttcgatgcctagtctgttgagggtttttatcatgaagtgatgttggattttgtttaaggctttttaggtgattaagataatcatatagtttttgctttttgtttttatgtgatgaatcatgcttattgatttgcttatgttgaaccaaccttgcatctcaggaataaagcctacttgatcatagtgaattaactttttgatgtgcagctgaatttggtttgttaatattttgttgaggatttttgcatctatgttcatcagggatatcggcctgcggttttctgttttcactgtgtctctgcaaggttttagtatcaggatgatgctggcttcgaagaatgagttagggagaagcccctgctcctcaattttttggaatagttctagtaagactggtacaagtttttgtacttctggtagaattcggctatgactcaatctggtccagggctcttttgagttggtagattttttaccactgattcaattttggtgcttgttattggtctcttcagattttcacttttttcctggttcaatcttgggaggctgtgtgtttccaggaatttattcatttcctctagattttctaatacgtgtgcagagaggttttcacaatactctctgaggatcttttgtatttctgtgagattaattgtaatgtcatctgtgtcatttctgattacacttatttggacaatataatttttcttctttgttaacctagctagcagtctgtcaatcttgtttattcttttgaagaactagctcttggtttcactctttcttttttacaattttttttgcatcttaatttcattcagttcttctctgattttagttacatcttttcctctgcaagcttcgggtttggtttgttcctctttcctagtttcctactgccatgtcagattgttaatttgagatttttctaacttcttgatgaaggtgtttaatgctataaactttcctcttatcattgctttagctgagtcccaaagattttcataagttgtgtctctattttcattaattttaaataaagttttttgtttctgctttaactttgattttcacccaagagttattcaggagtaggttaatttccaggcttttgtatagttttgagagatcttctttgtactgaccaagaacactgttgtactgtgttctgagagtgagcctgatgcaatatagatttttaaaaatttattgatacttggaaagcacaatgtaaaagacaatgccatttataatcacacaaaaaattaaaatccaggcatgctggcatgcatctgcaatcccagctactttggaagctatagtgggaagatcccttgaacccaggagtttgagacccacatgggcaaattactgcgaccccatatataagtatacaataaatatttagatgtcaagctaacaaaacatatataagattgtatgccaaaactatacaatgataattagataaatcaaagataatctaaataagtgaacagaaagaacatacttatggattggaagacttaaagatgtcaattttcccaaattgatatttaaatttaatgccatttctataaaatttccagtgagatggccttctttgtctcttttgatctttgttggtttaaaatctgttttatcagagactaggattgcaacacctgcttttttttgttttccatttgcttggtagatcttcctccatccctttcttttgagcctatatgcgtttgcacgtgagatgggtctcctgaatacagcacactgatgggtcttgaatctatccaatttgccagtctgtgtcttttaattggagcatttagcccatttacatttaaggttaatattgttatgtgtgaatttgatcctgtcatcatgatgttagctggttattttgctagttagctgatgcagtttcttcctggcatcgatggtctttacaatttggcatgtttttgcagttgctggtactggttgttcctttccatgtttagtgcttccttcaggagctcttgtaaggcagacctggtggtgacaaaatctctcagcatttgcttaatggtaaggggatcaaatcaacaagaagagctaactatcctaaatatatatgcatccaatacaagagcacccagattcataaagcaagtccttagagacctacaaagagactcagactcccacacaataatgatgggagacttttaacagtccactgttaacattagacagatcaacgagacagaaagttaacaaggatatccaggaactgaacccagctctgcaccaagccgacctaatagacacctacagaactctccaccccaaatcaacagaatatacattcctctcaacaccatatcgcacttattccaaaactgaccacatagttggaagtaaaggactcctcaacaaatgtaacagaaaagaaattataacaaactgtctctcagaccacagtgcaatcaaactagaactcaggattaagaaactcactcaaaaccgctcaactacatggaaactgaacaacctgcgcctgaatgactactgggtacgtaatgaaatgaaggcagaaataaaggtgttctttgaaatcaatgagaacaaagacacaacacaccagaatctctggggcacatttaaagcagtgtgtagagggaaatttatagcactaaatgcccacaagagaaagcaggaaatatctaaaattgacaccctaacatcacaattaaaagagctagagaagcaagagcaaacacattcaaaagctagcagacggcaagtaataactaagatcagagaagaactgaaggagatagagacacaaaaaactcttcaaaaaatcaatgaatccaggagctggtttttcgaaaagatcaacaaaattgataggctactagcaagactaataaagaagaaaagagagaagaatcaaatagacacaataaaaaatgataaaggggatatcatcaccgatcccacagaaatacaaactaccatcaagaatactataaccacctctacacaaataaaccagaaaatctagaagaaatggataaattcctggacacatacagcctcccaagactaaaccaggaagaagttgaatctctgaatagaccgataacaggctctgaaattgaggcaataattaatagcctaccaaccaaaaaaagtccaggatcagatggattcacagctgaattctaccagaggtacaaagaggagctggtaccgttccttctgaaactattccaatcaatagaaaaagaaagaatcctccataattcattttatgaggccagcatcatcctgacaccaaagcctggcagagacacaacaaaaaaagagaattttagaccaatatccctgatgaacatcgattcaaaaatcctcaagaaaatactggcaaaccaaatccatcagcacatcaaaaagcttatccaccacgatcaagttggtttcacccctgggatgcaaggctggttcaacagaggcaaatcaataaatgtaatccagcatataaacagaacaaaagacaaaaatcacatgattatctcaatagatgcagaaaaggcctttgacaaaattcaacaatgcttcatgctaaaaactaggtattgatgggacgtacctcaaaataataagagctatttatgacaaacccacagccaatatcatcctgaatgggcaaaaactgcaagtattccctttgaaaactggcacaagacagggatgccctctctcaccactcctattcaacacagtgttggaagttctggccagggcaatcaggcaggagaaagaaataaagggtattcaattaggaaaagaggaagtcaaattgtccctgtttgcagatgacatgattgtatatttagaaaaccccatcatctcaacccaaaatctccttaagctggtaagcaacttcagcaaagtctcaggatacaaattcaatgtgcaaaaatcacaagcattcttatacaccaacaacagacaaacagagagccaaatcatgagtgaactcccattcacaattgcttcaaagagaataaaatgcctaggaatccaacttacaagggacatgaaggacctcttcaaggagaactacaaaccactgttcaatgaaataaaagaggatacaaacaaatggaagaacattccatgttcatggataggaagaatcaatatcctgaaaatggccatactgcccaaggtaaattatgtattcaatgccatccccatcaagctaccaataactttcttcacagaattggaaaaaactaaagttcatatggaaccaaaaaagagcccacattgccaagacaatcctaagccaaaagaacaaagctggaggcatcactctacccaacttcaaactatactacaaggctacagtaaccaaaacagcatggtactggtaccaaaacagagatatagaccaatgggacacaacagagccctcagaaataataccacacatctacaactatctgatctttgacaaacctgacaaaaagaagaaatggggagaggattccctatttaataaatggtgctggaaaaaactggctagccatatggagaaagctgaaactggatcccttccttacaccttatacaaaaattaattcaagacggactaaagactgaaatgttagacctaaacctataaaaaccctagaagaaaacctaggcaataccattcaggacataggcatggacaaggacttcatgactaaaaaaccaaaagcaatggcaacaaaagccaaaattgacaaatgggatctcattaaactaaagagcttctgcacagcaaaagaaactaccatcagagtgaacaggcaacctgcagaatgggagaaaatttttgcattctacccatctgacaaagggctaatatacagaatctacaaagaacttcaacaaatttacaagaaaaaaaatcaaacaaccccatcaaaaagtgagcaaaggagatcaacaacatttctcaaaagaagacatttatgcagccaacagacacatgaaaaaatgctcatcatcactggccatcagaaaaatgcaaatcaaaaccacaaagagaaactatctcacaccagttagaatggtgatcattaaaaagtcaggaaacaacaggtgctggagaggatgtggagaaataggaacacttttacactgttggtgggactgtaaactagttcaaccattgtggaagacagtgtggcgatccctcaaggatctagaactagaaacaccatttgacccagcaatcccattactgggtgtatacccaaaggacaaatcatgctcctataaagacacatgcacacgtatgtttattgcagcactattcacaatagcagacttggaaccaacctaaatgtccatgaatgatagactggattaagaaaatgtggcacatatacaccatggaatactatgcagccataaaaaaggatgagttcatgtcctttgtagggacatggatgaagctggaaaccatcattctgagcaaactattgcaaggacagaaaaccatacaccacatgttctcactcattggtgggaattgaacaatgagaacacttggacacaggatggggaacatcacacaccggggcctgtcatggggttggggggagcagggagggatagcattaggagatatacctaatgtaaatgatgagttcatgggtgcagcacaccaacatggcacatgtatacatatgtaacaaacctgcacgttgtgcacatgtaccctagaacttaaagtataaaaaaaaaattccagtgagatattttttaaatatatgcaggattattctaaaatatatatggaaaggcaaagctaaaactaatgtgaaaaatgaagaataaagtgagatgaatctactaaattccatgacttattatattgctgcagtaatcatgactgtgtgttatcagtggagggacggacatagataaatgggacccaataaagaaaccagaaatacacctgcatgaataagtccaactaatttttgacaaatatgcaaaagtaattccatgtgggaaaaacagtcttcaaaaaatagtggaaaaattggccatctataggcaacaaaaagaacttcaacctaagtcttataccaaatgtatcacaagctttaaattgaaactgtagatcttttagaaaataggagaaaattgttgagaactaaacctacgcaaatagttcttagacttgctaccagtagcacaaatccataaaagggaaaacctgggcatcatcgaaatgaaaacttttgttctgtgaaatatccatgttaagaggatgtaaatcagttatacactgggagaaaacatttacataccacatatactaccaaggactagtttccagaatatataatggactctcaaagctcgaaagaaaaaaaaatacaattcaattagaaaacgggcaaaaagacatgtagagacatttcaaagattatacacaaatgacaaataagcacataaaagatattcaatgccactaaccattagagtaatgcaaactaaaacgacaatgagatatcaatacataactaccagaaaggctaacaaaaaaacagtcataacacaccaaaggctgatgagtgaggatgtgcagaaaccaaatcactcatacattgttggtaggaatgtcaagtggtacagctgctctggaaagttaagcagtttcttaaataactaaccatgcaacttagcacactgcaatccctgggaattgatctcagagaaatgaaaacttatgttcgcacaaaaacctgtacacaaatgtttacagcagttttattcataaataaagccccaaactgaaaacaacccaaatgtctttcaataagtaaatgattaaaaagttgtggtacatccatatcatggaatagtatttggtgattaaaaagagaaacaatgcttcatgcatacaacaacttgaatgattctccaaagaattattctgagagaaaaaagacaattccaaaagattatatactacatgattccatttatgtaacattcttgaaatgagaatatgatagaaatgtgggaatagattaatgggtgccagagttataaagggcatggggagaaggggaaatggttgtggctatgaaagcacaacgtaagggatccatgtggtggtagaaatctttgtgttttgactgtatcaatgtcaactgataccatgattttggtatagtttttcaaagtgttgccatgggaggaaattgggtaaagggtcctctgggctctctctgtatgatttcttacaacttcatgtgaatgtacagtagttatctagcaatgaaaacatctgttaaccagctagagaaattattaacttttgcaagaagacactttcacttttcaagcaccttaaaatttagtgtattctagtgattattataattttatgagatttataaatataaacactagtagtcggtataaaaagcagcagttcaaataaaccggagaaactcaccatcttatatgcctgtactagcgattcaaccaacatgtaattgtattagaagctctgaggagtcttggtgagtagacagctaactttgcttaactactgttaaactttaaactcagtggagccagagtatttgtagtctctgtgtcacttggatgtactttgtcttttgatatagaaagaaaatttctgatttaattccaaagtatattttaaaagactgtttctacaaaataccaacatattttagtcaaaaattaagcatattgataattttctacaaacaaattggatcagcggctgtgttacagttgctaagggcaagctgacagtgactttactgcttttaaatttaatacacagttatgcacaaatatacattgatatgcataagtgcatatgcgtatacatgcatatacatatacacccgcatatatgatgttctcattagtatgcactcgggtaagaaagtgaaaatttttctaaggctcctttttttaaaataaaaactaatgaaagctagagaaaggtggcactagctctctttgaaaagggtttaaaagtggttatcctatacctgaattaatcactcacttaggctggtgtatttcagtttacacatcatgaagcaatagaacacagattagcaactatgatgtaatcctatgatttttacccaatggctgaaaaaaaaaatcttccaccacacaaagctgttgaaatgcatcttattccacacatacggtaggaacaatacttagcatcaggaaccaacaagtcagtttcctggcttcctgacttcttagtttaattacgtgtaggacaagcacatcctcctctgtgatctcacatctggcaagcacagctctcatgccaaggacactgatgttacgatttttatttctactattccaaggtgaacttctctcctgaatttccatgttcctactatctatccccgtgtttcctatttctggtaattatacacctcttcctataatcttttattttctgcagctttggtcttgctcacttttacacctaatactaaaatttaaattttatataactaaatattggtgctaatcatgtgaagtgaattattttaagaagaatgcattcatattcctgcattcacagacccagaaaataaagaggtaattattatgctagataaaagagctcgtggaagtatagacagatactagataacagattgttcataggtatatatgaaaaaaatattctagctccattgagttaaaatttaacagtagttgagcaaagttagctgtctactcaccaagactcctcagaacttctaatgtaattacatgtcggatgaatcactaatacaggcatataagatgctgagtttctccagtttatttgaaccactgcttctcataccatatactgcaggtgctatgagccaaaggttcatctcagaagcagtaaccaacagtaaaaagccgcctcacttacttgtgcacgaactctgcagtgtagctagagctgtgtgccaggacaacatgaatgatcagatgggcacaaaatcaagacactcaggttatgagctcaaaaattaggttcttctaaaaagtgtggctatcgaaatgacaaaagttaaaagtttcagaatatatgattattaggtgacacagatttccaagaattgagtgaaagcacttttccaggatgtccagagaatagacgaaatcagaatcatttgcagcacaggctccttgacaacagaaagctcttcaaaataagtgtaaaatccagcatacatgtgtcatgctttcctcttaattcattctgtcttccactcaagccactatcaatcactaggcaaaaggtatttggatgaaagttctccataaatactgaagaggatattttccttgtctgggccattgaagaatggcaaagataaggatggaaattaactagtgtagaaatcaagataattacacttgaaaagcagccttattatggatctttggaatatcatgaaaatcagaaattctgaaattgaattttaataataatcagaaaaaaaattgtgacaaatatgccaaggcaattcaacccataagagaagcctcttagacaaatggtactgaaataactgcataacatattgacaggaaaaaataaaacttagcttgtgatatagtgtatctcaggaaaacatggttaccaccttaacaaggaaaataagactgatagagtcaagattataaattttaatgcctgttagagaagtaaagccattaagaaacatacatcaattgaaacccaggaatggattccccggccacccagcacccacaaggaaataaagaggagacccatggcttccttctttctgggtaaaacgatggacagaagagaaggctgccattaataggagttagaagaaaccaggtaacgttttacaaaaatataaaggttcactatgctcgtgtgttggtttagaatccctaggcagttcctctacccacctgccaatgttttgccatggaccttcacagaatcttcaactggaaatgatgggtgagagaaagaagaacttctaaagtgtatgagcttcagtgaccattgaaagctaagagcagggaacaggaacccctgaggtatatatctgggcttccaataagtactaggcaggaaatactggtggctggggatgggtcagggagagctaagagagaattaccctcaggagccaaggcatagagcttcctaaagctggggacaaaagtaagagaactgaggcacacaagcgcttgacatcttcactgaatatactgctacagcctctaatgcagagaagagcactaaggtagaaaggctgggagtagaactaccacagtctgtaccacagaacacaaatataaatcctagacatggaacatctatctaaggattctggaaagtaaacagtagcagtggagaaggaaaccagaattagaagttccgctgaaccagcagtgagcctaccatttttcaccgcctggtatcaccgggtctagactcacagcccaaaactcagaagtatacaccagatgtggacagaataagctccagaagcagcattctttctagtccaaggagcaggaaagggagccccaaaggatcagagaagcagggacttacaatgtttagttttttcctagtttcccttctcttgttccctagccccagaaaaatctgcactgatggtggcagcagaaggatggcactcagatggcaaggtcatcacctaaagctctgaaggagggggaccttgttccttcccagaggagcttcaatcagaagagtaagaaacaaattcctaatacctttttccccctctctatcttctgactgttttgttccagacatagatgtaatcatgagaagtgggcagaagagaagaaaaactaatgttccagctttctagataaaagatcaggaaaggaggctccaatgaggctaaaaatgccagagagctccacaaagagagggaatcatcaaaggagcaataccataaagtcgtgcatgaagtactatgcttgcctctgagctacacctatgtggatctgatcataaacaccacaaagaagaccagagacgagatcacactggcctcaggtagtacacacatggaataaatccaaaaagtattgtgaacactatggaaagtcaggtgatattagagccacagcccacagaaggcaggtcagaacttgaggcctgaacctcacctggccaattgccagctaaaacaaaacaaatcaacattatcttttgaattaaagcaagacaaagaataccataatacaatatccaaaatatccagaatactgtccaaaatcactcaacatatgaagaacagggaaaatctcaactcatgagaagaaaagatcaacagataacaaccccaagatgacacagatgttggtttaaaaaaaaaacaaaaacagggctttaaagaacgaaatataaccttcttttcaaaagaagagcaaacagctgggcatgatggctcatgcctgtaatcccagcactttgggaggccaaggtgggcagatcatgaggtcatgagatagagaccatcctggacaacatgatgaaaccccatctctactaaaaatacaaacaattagccatgttttgtggtgcgttcctatagtcccagatactcaggaggctgaggcaggggaatcgcttgaatccaggaggcggagattgcagtgagccaagatcgtgccactgcactccagcctggtgacagagcgagactccatctcagaaaaaaaaagagtaaactcttgaaaaagcggaaagatagaatgtctcagcaaagaaacacaaaatacaaagaaaaatgttaaaactgaaaaattagagaaagcaaagtaaaatatttactggattgagaataccagaatggagatgatcaagaatcaattaatgtgaaaatatatagataggcattatccaatatgttcaaaagagaacaaaaatgaagggcaataataaaagttatagcatttatatcaacagcctcagaaagacaggagaaaaagtgtggtgcaaacatacatgtatctgaagaaataatttggtgaaagacaaatttgctgattcaagaaactcagtgaaccccaaacaggataatttcaaagaaatctatgtccaaacacatcataaccacactgcaggaaaccaaagaaaaaaataagaatatattgaaaattgccagagaaagaaactggggaagaataactctaatgactgtaggtttctctttagaaatcatggaaactagaaggaagtagaacatttttgaagttctgaaaggaagaaactaccaacaagcttttagaaaataaaacttgtaacaagttttgtttcattgtcatcaaaaagtaaaaaataattaggattcaggagctctatgccaacaactatcaaatattgctgagagatattaagaaagacctaaatgaacagagatttacatcatatttgtggattaaaagattcaatattttaagatgtcacttctgcccacattgatacagagattcaatgctattattaaaaagtcactggaggtagtgtgaggaaattgacaagctgtttccaatactgacatggaaattacagggacctagaacagcaaaaatatcttggaaacgaacaaagttctttttttaaaatcttattacacaatcaaaataatcaaacagtgtggtatttgcaaagcacaaacaaacagaaataaaagaagttagagtccagatattgagttgtgcatgtagagacaaagggttttcagcaaaggaaccaagaaattcaataaaggaaataaattcatttcaaaaaatgatacaaatgtggatatctacatttaaaaaaatacaacttaacccctaaacacacatcatagataaaaattaagtcccaacagatcatggacctaaaacataaaatctaaaactataaaacttgtagaagaaaacacaaaacaatattttttgtaaacatagggtaggcaaacgttcctagaatacagaaagcataaactagaaaaataaatagagttttaatactagactgcttctgttcacctaaagacgccattatttaaaataaatatgcaaaccaaagaatgggggaaaaattgcaacacatattttgacaagagacttatattcaaaatatgtaaagaactcataccactcaatgatttctttaaaaagcagtcacctccctcaaataggcaaaataatttaacaaatacataaatggacaataagcacatgaaaagtactcaacatcttttatcatcaaggtaatgcaaattaatgcctgagatataaatacatatcaattacactggctaaaaataaaactgactatttcaaatgttaacaacaatatcaatcaaccaaatctctcatatatttctagtggaaatgtaaaatggaacagctactttgagaaacagaatggttcattattttaaagtaaaacatatacgataataccagcaatttcactcctaggtatttatcaaagagaaataaaaatatatgcccataataatgacttgcacatgaatgttcatagtagcttaattcataccagccaaaaattggaaaccacccaaatgtataaatgtgtgtatatttatacaatgaactactaatcagcaactaaaggaaggaactacttactaatttatataatgacatgaatgaatttcaacaacattatgctgtgtggaagaattaagacacacaaaaaagcatatagttcagatttcattcatatgaaaccgaagacccaacagaactaatttgatccattcaatgcaattcctatcaaaatcccagttggctttttttttctttcttttttttttttttttttgcagaaatgaacaagctgatgctaaaattgatatggaaatgcagatgcaaagagcttagaatagaaaaaaatctttaaagaaaagagagaacacacacttctcaattccctcaattctaaagtttactatagtagtatttgtgttatttgattactacagtaacctagagagtttgttactggcacacagatagactaatagatcaatgtaatagaattcaaagttcagaaacaaaccttcacgttcatgttaactgatttttaaaaagagcaccaaagcaattcaataaagacaaaaatattcttttcaacaaatgatgctaggatgattagatagccacatgcaaaagaatgaggttggacccattccttaagccacacaaaaaaaataattcaaaaaagaccacagacttcaatgtaaggaagggctaaaactataaaacttttacaggaaaatcttcatgactctgggttagttaaagccttcttagagattataccagaagtaaaagcaacaaaagaaaaaccaaattgaaattcttcaaaattcaaaacattcatgttttaaaggacaatatcaagaaagctaaaagaatgcctacagaataggagaacatatttgccaatcatttctcgtaacagactgatacgtttacaaaaacaactgcacaagaatttcatagcagccttatttgtaatacgccacactgcaaacagcccaaatatctgtcaaaaggaacgtggataaacaaattgtagtgtattcataaagaaacataccactcagctattttttaaaaaccaagctatagttgtccccgcttatccacagggaatatgttccaggaccctgaaaccacatgtagtaccaaaccctacatatactatttttttcttataatacacatgtacttatgataaaatttagtttctaaattgtgcacagttaagagattaacaacaataataaaatagaatcattacaacaatatcctagagtaaaagtaaaataggtgttccttggaaacaagcactgagataccatgatagttgatgtgataaccaggctggctactaagtgactaacaggcagtggtgactacagcgtgaatctgctggacataagaatgactcacatcgtcagacagcacaagatgccatttgatttcatcacgttactcagcagggcacacaatttataacttatgatttacttacaggatgttctactcaaaattttcagactacagctagacacagataatagaaatggcagctactgaaaccttagataaaagaggactgactactgtaccaagacacacaaaatatagatgaatctcaaaaacattaggttgaagtaaagaagccagacacaaaagagtacacactgtaaacatttacataaagttcaaaaacaggcaagactgatacatatattacataaagtatatcaatgattgtttatgcagtggtgggtatgtggctgacaagagttaaaagagaatttattgtggtgataaagatattctatacctggatcagggtgttgtttcacaagaccatataaactcatcaaattagacaatgaagacatgcatttcaccacatgtaagttttacgacaatttcttaaagtaaaatggaaagaaagtatcatgcttcatggtgtcctatgcttctccgcctcatttcaaaaacaacacagagacatagaaggccattccagccacaagaggaactaggagattctgcgcttaagaaagttgaaggagaactacaaaccactgctcaacgaaataaaagagaacacaaacaaatgcaagaacattccatgctcatggataggaagaatcattatcatcaaaatggccatactgcccaaggtaatttatagattcaatgccatccccatcaggctaccaatgactttcttcacagagttggaaaaaactactttaaagttcatatggaaccaaaaaagagcccacattgccgagtcaatcctaagccaaaagaacaaagctggaggcatcatgctacctgacttcaaactatactacaaggctacagtaaccaaaacagcatggtactggtaccacaacagagatatagaccaatggaacacaacagagccctcagaaataataccacacatctacaactatctgatctttgacaaacctgacaaaaagaagaaatggggaaaggatttccctatttaataaatggtgctgggaaaactggctagccatatggagaaagctgaaactggatcccttccttacaccttatacaaaaattaattcaaaatggattaaagacttaaatgttagacctaaaaccatcaaaaccctagaagaaaacctaggcaataccattcaggacataggcatggacaaggacttcaggtctaaaacaccaaaagcaaagataacagaagccaaaattgacaaatgggatctcattaaactaaagagcttctgcacagcaaaggaaactaccatcagagtgaacaggcaacctgcagaatgggagaaaatttttgcaatctacccatctgacaaagggctaatatccagaatctacaaagaacttcaacaaatttacaagaaaaaaaatcaaacaaccccatcaaaaagtgagcaaaggagatcaacaaacacttctcaaaagaagacatttatgcagccaacagacacatgaaaaaatgctcatcatcactggccatcagagaaatgcaaatcaaaaccacaaagagaaactatctcacaccagttagaatggtgatcattaaaaagtcaggaaacaacaggtgctggagaggatgtggagaaataggaacacttttacactgttggtgggactgtaaactagttcaaccattgtggaagacagtgtggcaatccctcaaggatctagaactagaaacaccatttgacccagccatcccatttctgggtatatacccagaggattataaatcatgctgctgtaaagtcacatgcacacatatgtttattgcagcactattcacaatagcaaagacttggaaccaacccaaatgtccatgaatgatagactggattaagaaaatgtggcacatatacaccatggaatactatgcagccataaaaaaggatgagttcatgtcctttgtagggacatggatgaagctggaaaccatcattctgagcaaaccatcgcaacgacagaaaaccaaacactgcatgttctcactcataggtgggaactgaacaatgagaacacttggacacaggaaggggaacatcacacactggggcctgtcatggggtgggggaagcggggaggaatagcattaggagatacacctaatgtaaatgacaagttaataggtgcagcacaccaacatggtacatgtatacatatgtaacaaacctgcacattgtgcacatgtaccctagaacttaaagtataataattaaaaaaaaagaaagttgtcttctaaaattcttgccttatttgaaaatggaacaaaccagtataaaatctccatgtttcctggaagaatgctatctctgcctccggtatctgacttggaataaaagaagggaggaatttacctaaatctaagtgtcggcagtcctggagtcagcaggggttacctggagggcagagtgctatacaaaaagaatacgatctttgggaatggtatttttccttgaaagaatactaggaaaatctaaaggtttcaaaccattccaacttttgaaagatagtttaaagttggactaaatcagctatataaatccacagcattattctgaagatttctttgcaaattcctagaattttatctctttacaagtgttttatctgttggaataaaaaagagggtgtttaatttattaacttggttttatgtaaccttttgctcaacagaagttattgctttttacaatatctactctctatcttttaccttcacagtttatgaccctagtgtcaggcttagacgtgccttcactaaccccagatcataaaaatgaaaaaacatattctctaaaatttcccctaggaaagctaatattttcttctactttcttgtgtcttcttttctgatggtattatggttttatttttaatttcagcatttttatttaaattttctatcagattgatactgataaaatattttaaatactcacaaaatgagacatcagttaataccattcagatttcacaatttttaaacagttttaggatatctgcttcatcaaaacattaaataaatggacataactgaagactcccccccatcagaggtatccaaatttggcgtgtgttatttccatacatgttagatttttttatgttgtttttcacatccgccaagttcacacacacagatcgacttcattttaactgctggatattatttcactgtttgaagaaatcagtttattcatttgtcctcctgaggggccttgaaattgtttgactttctcatttttagaaacagtgctaaagagtaaatctttatatgagccacgtttcgcatatgttagtgattttctaggactgaaacatgtaagtgggattgctgggtcacaggctgtgttttggcttcaagtttactgggaaacagaaattaaaactcccactgacaatgtagaatttccatttctacatatccttgcctactgatgttttcagacttctaaagttttcccaaataaatgggcatggggtgctaacccagtgatgttttgacttacaatgtgcatttctctgaaagagaaatttcaatgtttattggtcatgacactttcctaccagctagctttgcatattttacaagtcttttatttatccaaaatttacttttggccatggtgtttgatagcaatgaaatggtatcatttactatataaattgtcacagcaagccaggcatggtggctcacacctgtaattccaccactttgagaggctgaggctggtggatcccttgagccaagcagttctagaccagcctgggcaacatggtgaaaccttatctctacaaaaaaatttaaaaaaaaatagccaggcatcgtggtgtgtgcctttagttccagctacttgggaggctgaggcaggtgggtcgcttgagcccaggaggcagaagttgcaatgggccaggttgtgccactgcactccagtctgggtaacacagccagactctgaaattagatagatagatagatagatagatagacagacagatagataaagatagatagacaggcagacaaaaattgtcagagcagccttttaaaattgtccattttattctcactaaattgtaattctacttccattatatattcctatatatgtgtgggtctacttcaaggtttttcattctgttctctagtttacttgaatatctttgtcccaacatcacactaatttgctttaccttcaaaataaatcttcaagtgtagtgggacaccatatccttccattatcttcatttataatcatgtcatatgtatttaaacttatatattttcatagtaatatttgtattagcttgccaaatgctgtgaaaaccttcttgggattctcattaagattatactgaaagcataaatcatttgggggtaagctgatatctttatggtattccatcttcccttccatgaatatgccatatatatatatctctttttatatccattaataattttctccatcaatatctcatacatttcttcttagatttattcctatatgccttttttactattttaaatattatagtttaaaactatattttctaagggctgatgattgatatgtaggaattctattaattcattttatatacagcaatcttctaaattttgactaaagattcctttagattttctacttagacaatcattacttgcaaataatctaaactatgctttttgcccagctcttatactacttttcttactccagtagctaggatcagaagtacaacaataaaatgaggcaatgacagaaggcgttctagtctggttatggtttttaaaaggaatatttctcacatttcatcattaagtacaatgtttactaaagattcttagtggggatatcctttatcaatttaaggaaatttccattttttaaaaaaattataaactaatattacattttatcaaatattttatactatgtgtgttgcgggaagtcagggaccctgaacagaggtaccagctggagccgaggcagaagaacataaattgtgaagatttcatggacatttatcagttcccaaaattaatacttttataatgtcttatgcctgtctttactgcaatctctgaacataaattgtgaagatttcatggacatttatcacttccctaataatactcttataatttcttatgcctgtctttactttaatctcttaatcctattatctttgtaagctgagaatgtacatcacctcaggaccactattgtacaaactgattgcagaacatgtgtgtttgaacaatatgaaatctgattgtaaaatatgtgtttgaacaatatgaaatcagtgccccctgaaaagaacagaataacagcaatattcagggaacaagggtgactgcttgcagggtcaggcagaatacagccatatttttcttcttgcagaaagcctataaacggatgtgcaagtaggagaaatatcgctgaattctcttcccagcaaggaataaccctgggtaaggaatgcattcctgggggtaggtctatagactgctgctctgggagtgtctgtcttatgcggttgagataaggactgaaatacgccctggtctcctgcagtacgctcacacttactaggattgggaaattccagcctggtaaattctagtcagaccagttctctgctctcgaaccctgtttcctgttaagatgtttatcaagacaatgcatgcacagcaggacatagacgctcatcagtaattctaattttgccttctccttgtgatctttattgccctttgaagcatgtgatccttgtgaccttctccctgttcatgcaccccctccccttttaaaatccctaataaaaacttgctggttttgtggctcagggttgtcatcatggtcctaccaatatgtggtgtcacccctggagacacagctgcaaaatttctctctttgtactctttctctttatttctcagaccaactgacacttagggaaaatagaaaggacctacagggctcttttgggggctggtttccccgatatatgtgtattgagatttgttttcccctttaatctattattactgtcaattatattaatgatttttccaatgttaggcagtcactgcattcctggaataaataccactttaaataagccttataaatgtgggctggtacacagcaccaagatcttggtttcaaataactctgtccattaacaggaaccaggtgaccttggaaaaattgctgattctaagacgggggtaagaaatacccaagataagcctggagcatcttacaatgccagaaagaaagaagaagtgctaagagaaaaaggaaaaacaacaacgacaacaacaacaacaacaaaaaacaagatgggagcatgtcaaaaagaccaaaagctaggataaattgagccaaaaaataaagcagtactgctttacaatgcaaagtataaaataaataccaatgcagtcatataaataaatgattgaataaataataaggaagaagagacaaacatcccatgcaggagaattcaaaataatttctgtagatattccaccctcaatgaagtggagcatatttcccatgtccataagtatgcgctacacatagtgacttcctcccaaagagtacaggagagaaagggtggtggggtggcaaagagtaactttacagcagagaaatctgacagacactacttccgccaaatgaccaagattcatctcaacagtgacaagctgggccaggtgtggtggctcatgcctgtaatcccaacacttcaggaggccaaggcaggcagatcacttgagcccagaggttcgagaccagcctggacaacatggcgagaccctgtctctacaaaaataacaaaaattatctgggcatggtggtttgcacctgtagttccaattactcaggaagctgaggtggtagaaactcttgagcccggcaggagaggctgcagagagctgacactgtaccgctgcattctggcctgggcaacagagcgagaccctatctcaaaacaaaaaaacagtgacaagtcatgttgataatatatacttttgatatggtgtgataaaaaatggcaatttaactcatggtttacttcccaaaaatatacccaaatctaatcgtcagaaaaacatcagacaaatcccaatgagacaaatgccacaaaaaacctaaccagtacttcttaaaactaccaagttgtcaaaaacaaggaaagcctgagaaactgtcaaaaccaagagaagctttaggagtatgataagtaaatttaatgcgtttcttggattggatcctggagcagaaaaaggacactacagaaatctggataaagcatggacttcattaatagtgtatcaatattagctcatcaactatgacaagtgtaccatgctaatgcaaagtattcataatagagaaaactgggtagaagatacacaaaaacactctagactatatttgcaatttttctgtaataaaaagtgtttattttttaaaagtgagttgaggatctcattttctattttcaggactagtttgcgtaacagaactttcaacagaaacgtataagcagtcaagtaattgatgcaggttgatatgagcatttgtaatatggtaagggtagtaataaaggctgcactgttcattaaatgatgtcgaaaaattagctattaatttggggaaaaatttctctctgatctctacctcatgtcaaaataattccatctgaaatttgcaaaaaattacattaaaaaactataaaagttctagaagataatgagaatgaataccttcatactcttggggtaggatggaccatttttatgcataccaatattgaagacaacactgaagtgttaaggacagaagaggcctctcagtaaactgagccagtgatatttcagcacaagctgaaacaacctcccagaatgaacagaaatataatctcagagagtttgtaaaaaatactgaacagtaagtatgaaaaacggtggtggcatttatttcctggaagaggaaattaagaacaaagaaaacaaatataaaacatctagtatgctgaggaaagttgccaaaaataaagatctgagttaacagaacaaaaaagcagacaaaattgactaaacaaacaaacaaacaaaaaaacagtgaagtaacatgtccaagctaacattacttaggtaactactggtggggatggactttggatccaggctggtctcactttcaagctcgcattacttctacttctacatatgcgctcacttagccattaaaaagaagtcatcttctttttagaagaaaatgcagtgtggtaccctgtactggatcccagatcagaaaaggaacattgctagaaaaactgctctaataaagtcttaagtttaattgtagtagtataccaatgttaatctcttagttttgacaattacatcatagttatgtaagatgtttaatgctaggggaaacagagtaaagggtaggcaggtgtgtaacttttctgtaaatctaaaattatttcaaaattaaaagcttattaaaaaataaaagaaatctcagccaggtgtggtggcttatgcctgtaatcccagcactttgggaggtcaaggcgggattacctgaggtcaggagttcgaaaccagcctggccaacttagtgaaaccccatcactactaaaaatacaaaaatgagctgggtgtggtggtgagcacttataatcccagctcctttggaagctgaggcaagagcatcgcttcaaccaaggaggcagaggtcgcagtgagccgagaccgggccactgcactctagtctgggcaacaagagtgaaactccatctcaaaaataaataatataatataatataatataacataatataatgtaatgtaatgtaaaataaatctctcaaaatgctgctttgggactatcttaaaacttgtaagtgtagagatttattgcataaaaccaaattttaaagaggcatgctttgtattgaagattttgattataacaggtttgttgatgactttaaaaataaatatcagcctcaatttaattatatagcttttctgtaaagactgcttacataatttcttctataccatttttcctttcatgtgaataaaaatataaaaaaaactgtaaacagtagtctctaaatacacatggtgatctagttgtgatgaactgttttccatttctgctacagacgtaacaaaagttctgtgaaacaaaccttgtaacagcaataattaaatttaaaggattaatagaacagcctgattttttaggagctgtcagatactgaaagaatcaggacttcagaaataaatgaattctaggagcagaaaagctgaagcatataattaaatagaaaagtcagaagagtttgactatgcaaaggaacagggagaaatagttactgaggaacagggagaaaaactaaaataaattaatgaaagtcagggctcatggtgtctccaaggaattgaaatgtgacaaatcatggaatgggaagggagatgataagaataaatatgaatagtattaagttcaatcacttaatacttaggccttgttagaagccctccaatggttcccatctctcaaagcatgagtcagggatccgttgagaccttgagggtgcacccattcccccaaccctccctacccccccaaccccatcacttttttctttctcttttactcttcaccttctcccctcactcctctcaagccagccctgcccgcatgcagtcccctggcactccaggcctttacatttgctgatacccctgccagaatccccctcccccagacatccccatggtaaaaactccttcacctacttcaggttttgctcagatactaacttttcagtgatttactactatgcctgttctattttatttatttatttagagacagggttttgctctgtcacccaggctgggatgcagtagtatgatcatggctcactgcaacttctgtctcctgggcttaaatgatcctcttgcctcagcctcccaagtagatgggatcacaggcatgcaccaccacgcctggctaattttttatatttctgtagagcagggttttactatgttgcccaggctgggctcaaactcttgagctcaaatgatcctcctccaatggcctcccaatactatgcatgttctattttaaatggtgagctcctataactaccaaactcccctaccctgctcttttattttctcatagctgcttctatgtcctaacattttaattacattgaatatctgtctcaccaatcactagactgtaagctgtcagattttgcctgtgttcactctttctccagtgcctagaatagtgctgggcacataataaatggtttttttataaacatttgcctaaccaatcaatacaaacgtgtgatttttcattaccataattaaaattagaataatgaaacattcgtaacttttccaaagtcattttttgagcaactgggcttgtccttgtgcctgtgttttctgggtattttctacactgaacttctataatgttttaaaaaggggttttgtctttgtaaaagactagacagctgtctgagatcatttcaactcaagtacattcaatgtcagagtgagaaagaattaaagttcattctttcaaggcctgttcttcctgtgagcttaaatgaaatttagttattacctgaaagagattcatatcacgaaaacttcacacgggcaaatgctcaaaatcatgatccactaagttaaaggaatcacaaaattcccaccttcccattttaaagatgaggaaactgacctacgaaagttaagttacttcctcatattcaactagaacgtcgctgacgaagtggtgagcaggagctagtcttaaacaaaagactgaaacattacagaatgacctagcccatcaacattttgaaatgcagtgaaaagtccagattggaaatgctcagtccaccatccaactaggcctttattttctccctcttgtttccatttcattgctcaaagatgcttgtgaaagtttccttatttatttgtttgtttttgggagacagggtctttggagtgcaatggcacaatctcggctcgctgcaacctccgcctcccaggttcaaatgattctcatgcctcagcttcctgagtagctgcaattataggtgcccaccaccacgcccagctaatttttgtatttttagtagagacagggtatcaccatgttggccacgctggtctccagctcctgacctcaggtgatctgcccacctcggcctcccaaagtgttgagataacaggcgtgagccaccacacccagccgtgaatgtttcttcataccatttgaacattcaagattctttctgcattaagatccctagcaaaataaacactgtgatcaccttcctaagtattttagcatgttcaagggccactgtgccttccagaccccactcaacatttggcatcttactctagccctttgatttccctgttgacagaagtatgaggccagcatattttacaaatgtcttacccttttcagtggatggcctgtcaattaactctcatgaaatcaaatggaagcagacttcagggtataaaaatgtactacttatctaattcttttactgaaagcttgcacacattccattgtttttccataagtggaggaaaaaataaatctggtgctgtattttcgtttcagaagtagcaacagcagttactccacgcatgcattccccaggtccccagacagtcatctctgatgttataagaggcacagaggcagatacttcggcaaagacagtctataaaatgaagttgctatggaccaaaataactgtattgatttttagtacaattcaaaatacaaggaaacatcagttttccaaatggcacaagctgaaaaggacaaggaaaaatatattgcaaatagtgaagagaaggaaaataataaagacaattacattagcaaacatcttggtgttcttttttcagaacactaagatggctgttgtttgttttttaagttcaaagagctgagaggtttgaattatgttgaactgttgctcatttgtggacattgtgcccactgctggaagtctgaccttcagaaaacaaagccttataatccttggacatgtgaacatcttatttaaagcctcatttttttttcaattaatatctctcactctgatggcaaatggcagagctgtataaattctattataaatacatcatttgccaaaatatcattaagtttgctgcaagcaaatattttccttagatatccttaatgaggcaaagtagctttcaagccagagacctctggatgttgtggaatgaggggacggcagtcaggacttaccatggccccctcacttgttctttgggcaacttctcgctgtagtcgggccactgccaacttctccctgaagaaacaaaaacacatgattagttgaccattctcagggtagaggtgacactggcatggccgtgaaacattcttttgaggtctctagaggaattccttccttggtttagctcacttcctcctctatactttctataaatatttaaactgattggtcatgaatgcattgttttcattgagtgtcatgaaatttgccatagattttacaatagccaaataaacgttaaatggtgagtagatgctttgcttttagttcattaacatatatcactcacaaataaatttttcatggctatagtattttagttgacttttctctatcaactttgcttaagcatttttaattatttttatttcttttgttgctctccacaccaataatattaagaagcaaacaaaatataactccttactacttttaaaataacaatagaaaatcatttgcatgcttgctacataacaggcatcatgctgggcaatgcacctgttctcatttgagcctgacaacaatcccatgggtgatttcattatgcccattttatagatgaagaaactgaggcccaaaaaggctaatacactgagtcctcagctggtatatagtagttttttggaatcaaattttagatttccttacttcaaagcctaaataaaaagtctgcttatcatttcttcagtgtgtaggtaatataaaatgtagacttaaaaatcagattatttatttattttagtactccttatttaacaatggggttcatttttagatcccttataattctgctttcacttaaaatatatccaatattcaccaaaatttttagaatacttttgtaaagtgatagatgactgcattttggacagcttttcaattgttctttaaaataattgattagatgtcataggggtaagtgaattcttctggtaatccctaaaatgttagctttagtaagtatttcccctgatattcttctactactatactactatcaagatgagaaattatttgagtgacatttcatcccttagtcttctctttgcccaggatcagctatatgcaatcagctatatgtaaacataaaggatgcagttcaatccccagaaaattttcccactggggaaaagagaagtgaaaacttcttctctcctaagtgcttggatctttgaaatgcctaggactaccaagaagacacgtgcttttgtttggttgcagctgggcagtcttttagtagaaatagttctctctgaataaatacctaaaggcacagactagaagaagggagactagactaggagacattccaggtatacaagttttgggagcctgtggcagcacctgtgagtacacttctaagaaggggcaacagagtagataggaaggagccacaaagggatggaagccatgtagagaggccaagtaatcaaggcagaaagctcctgtgtgttctctgactcaagttctgatgaacagatcaaataagttcaatgaaaagaacaaattaagggaacaaataattgaaaaagaaggatatgaatgaattctgttttaatatgaaaattaaacacatgaatttatctcttctctccccagaaactgttaaaaatgtagtatagaggtaacactggcaaatacttataaagtcaaagaaaacaggagaatcacatactccatactctatgaaccagcaattccactctgagctctaaactgaacagaactatatgttcaccaaaagacatgtaccagaatgttcataacagcactttagtaatcttataagctgaaaatgcacacacccattaacaatagaatagatatgtcaactttagcacagttacatgatggaatactatacaacactgaaaaggaataatctacacttaatcacaacaatgtatggaatactgcaaatatgctgttgagtaacagaagcaagtacaaaatgtatatactttatttcctatttatataaagtgcaaatagaagcaaaactcctataccatttgataagacaagaaaaagaaataaaatacatggatatcaaaaaggaaggggtaaaactgtctctatttacagatgacattattttctaagtagaaaatctgatgaaatttactacacaacttataagtgaatttagcaaagtcagaggatagaagccgatgaacaaaaattaattatattttactagcaacaaacaattggaaaataaaattttaaagcatctccttctaataatgtcaaaaattaaaacatttagcaaaagatttgcaagacggccacactaaaaactacaaaacactgctaagaaggattaaaggagactaatagaaacatatatcacattcatggattgaaagacttaatattattacactgtcaaaatctgtatcaaataaatctataaattcctattcactgatacatataactctaccaaataaagagcaagactaggtaacgagaaacaagaaatccaataaataattggatttttttttcttttcttggtaaaaagaagctcctggacaacagctgtgtaagaatccagagaataaccaatctggactgcagcaagaggatggagagcctcaggaggatgactccaagaataaaacaaagttgaaccaaaataaattacctatgtgttcgtaagtattgagaagagatgtagagttttattttaaagcttaagaacaagaaattggaacatgaaaacgtaagccaatggcaggaagtgacaattattcatgctagtaaaaacaaagttattctagaaatgcaattctaaacttctactagactcagctgtgaatgacatttatcattttaattattaactaaattaatttactatttagtgaaaaaagtagagaaagggaagcacagagaaacagttggtacagaaacactaaattcttatcttccataatagaaagataatacataatgtttaaaagtgatatagaaacagaagttcaggcatataattcagatacaaggaggcaaaacttagaaggtagatctagaagaaggagagtggctgtgtcggaggagtaagatgcagaggtagggaaggcagtgtgtacatcttacagatgttaccattgcatttgatttccaaagtatgtgcatgtactactttgattaaaaaacttcgcaaaacatgtatttttaaaaaccaactggctcatgttatttttattaaaaacattataataatgcattactagaaagataaaggatagattattcaccaaccgaagattcagcatcaaatgactcattgcctcggacctgagaggcacctattgagaagctttggtaaattaaggcaaaataagaagtcactataagcaacgagtctttggacaaacgtttttaagtacatactgcaaacagtttaacatgttacagagatattttaaatttaaaagtttctctttacttttgtaatgaagtataaagtacgcagaaaaatatcataaaagcacaggttgctgaataatcacaaagtgaacatgtccgtattagtcccacctaaacaaaaaaacagaaacactgccagaacaccagaagctactttgatgctaatgataattaacttcctacaccaatacctgaattcacttgccacactcttttctctgtatactgaaacatggagatatttaacttctcatctaaagtatattaaacacattgtctcatattttactcgactgtttattcaatatatttttcctctaaataagaccataaattcctccttgaccacaacagtagcaaccaaaaatgatgatccattcatttttgcaggtggtcagttgtggcgtagttagtatcttactgtaacagccggttgcctgagtggagattatatttagttcatctctttaacactactaaggccccttagtaggaacaaaataaatatttgtgatttgctgaatgaggaatcagttacagaatctaataccaacttgcctggcataacagaattttaaataatattaccatcttgcatttacatagtacataacgcaggtacactgcacacatataccctgattcccacagggtatcctctggttctggttaaccacaaaagcttttttacatacattctaaaattacgaaaagtacaacttccataggccaccagataaatatgtgagtaagcttcaacagagtaaattcctaagtaagagcactgaatgaggggactgtagaacagtaggtcccaaatatttgaatactgagttctcaaatatttgatccttttgtatgcagaaaaactgaggatcccaaagagattttgttgttatgggttattatctattgatatttatgacatataaataaaaatgtaatttattaaaatatttattaaatcaccaaaaagccaataaacccatgccaacataagtaaaacatttttattaaaagtcatcctaaacagtaattccaaaacaaaaatacactttgcaaataaagggaaaaaataaattttgtgagaagaatgatactgctttagaattttgcaactctctttaacgtctggcttaatagaagacacgtgtattttcacatccgcttcagcatttaatctgttatgacagaacatgtcataagacttctagaaaactccactcatggaagctgagtggaaaaggcaaatatcatcttagtgttatgacaaaaatagttttgatcttgcagttcctttgaaagggtcttggagatacccagggtcccaggaccaaactttgagaacttcaactgaaagacagatacggaactaggaatgtaagaatgttctagaaaattgccttgaatcctcattcttaattgttgaagcttcagagaaaggtttaatatatatgttaatggtatgttaatttctcacaagagcagtgtaacataaaagagacatttccaggaacagatcaaaagccaatcttatccccaccatcctactaaatgataaaagagtcctaatacagtgtaaatgttaggaacatcactactttatgcttaaaagagatggcctttataaactattaggactgtcacactgtaatgtgcttctcaaatcttattaattcaatttgaaagaaaaccataatggttttagtcattacatagtttttaaaaaggaaaatactatattaataaatcatgaaattttgtagactgtccacacattatattctttggcattcaataaagaaggaacaaaatgaatgaatcaacacgaatgggctatctctaaaggggcagcattctagccacttgatttggtgaaacagagagtaaaatacataaaaactagaaacaccgttttatatctgacctaccacatgagtggaggaatgcccaaattcaaacagccacgtggaaacaggtgatgcaaacatggaaaatttcagagtagtgtaggccacaggggaggcaatccccaaccccagcccggctgctagccttccgtatcgacaactggggaaattgcctaggtgtagacaactggaagttaccctgactcagggcagctaggtgatgaaggagcagaatttgcaagaacagcaaacacaaatgtcttttggggaccatgctccgtaattgttttaagacatttatgcaggaaatgcaacctattagattatccaacaaagatctctcaggggtccaagggacagttcaggggcctcccatggagtcagtgggcaaagccagtggcagctaagtcccacgacagcaagagcactccaactctaagttattttatatattaggcttctgaattatattcccttttaaaagtgggtttccaatgctaaaacacaacaaataagggattcctcagtaacttgtatattccaaatatttcaagtccttgtgtgtacattttacatcagctggagttttttttttttaagtagaatttgtattttatttttgcatgaaaacgttatttttgtatgaaagggtctttcttttctaaaactaaggaagtggtgaagttcttgacatggtaaaaacttctatgataaaatactcagtatttctagatgttatttctggaatcaaattatcaactcaatcaaaatattaaaaataaatggccctgtctttttcacagaatctcatttgtccttgcgtttagtagttcctggcacgccatattttcaaacctccatggtcccaatatatgtgtgaaaccaattgggactagtatctttttcatgcaaattcacagttcatataaacagctttgtgtagaaaataaagaatgctggatttgcaagctacccaagacaaattaaatacactcacatacacatacacccttgctcccatttaaaggcctcagttcatctgctggaaacagacaactgtgcttctgcaatgcatcactgttttgttttgtttgtggcaaagccagtagctcattatgaagtgggtattgactttatgattgccaaacaaatgcacagggatattttatcaagagctgtggattcttatttactgaacaggtataaaaaaagaatataaagaaaatacaaacgatgaaacaagagaccacagtacttacttctcttacagttaaatgtaaagacaacttttctctccaggaagaatgaaacagagctactcttcttactcaattttatatccaaatggacaattagttccaggtttctaaagcccttcaatatagccccagactatctgaactaaagatcataaacaacattttataggttttatatattcttatatattcttcagaataccactgacacctctgcaagttaagcctgtggaaatagtgttcccaatgaagccaacaggatgttggcattcgtaaaattcagaaaagacctgcaaggtttgcatgtttaaaaaaaaagcattccccaaggagaaagcagcttgcagaggaggaatatattcagtttgtgttatgtggagacctcaggctgcagggtgctacagagccatctgttgcgagagtgtcccagggcatgcctgttgggagacaaatcaatgttcccttgccactcttcaggaagcccaggacttatacccaacctgaatgggagagcatggagatgctgtgtgccccactctccaccaggcagatggtgcccctgtgaggatgccctgatggaagagcagcaacggcacttagtgtaagtgggaagaattatttctactcattgttaagtctcacggtcacaaataccctatatatgcaacgcacttaaaaggtatgaatccagctcacgtcaagcaaactgttaatatgtgaaatactctgtgagttgatgaacatgcaggatgatctgtgtgatcacttgatctttccaggaaaataaagtataacaaataaacatgcttacatatgaatttaaaaaggaaaaattttcttgggcatcttagcaatccaaagtcagtttcctttactgtggtaaagatattgtgatattaaagaatcccataatactctccatacaaaactctaggttcatgttagttttgatttttaggttaagtttctataaagtatttaaaacttacttatgtttatgtattaaatacacctatattggtttttattaattcagaatattttgctaactgaaactatataatccaacaataatggaaatttttatgcattcagcaaacacttaatgtgagtttactacaggcctggtaccattctagggtctgagaaataaacacaaataataatacagttccaaattcaaagacttcaggattgatagacagagaaagcatgcctacgcacatgcctacacacgagtgtcataagacgcagtaagtacaacactctgtattcaaagccagattttaaaacatggtaggtggctattttatcaaaagatcaaatctgaacttcctttaaataagaaggcactttctgctatttctaagattttttcaatttcagacttttcagcaacaaattacataggagaacagatctgtcctcacaaatattttaattaggaagaatgtctatcacatattctatgttattctctaacttcattaagtcttttgaatgcaatgctgttagacttttgttcagcaccatggtctgccactttggtgccaggattttattccaggtcacttctttgagagatactggacctattttacttttgcatttaaaaagataaccataatagctgatatttattgaatagttgctatgtcaggcactattctaaacacttcacatgatatacttaaacctcagagaatcccatgaggtaggtattattatcatctctatgatataaaagttaatcaaactttttggattaagaacccctttacactctgcaaaaaaattactgagaatcccaaagagcttttgtttttgtcagttatgtctattgatacttaccatctccaaaattaacttaaaaatatatattaatttaaaatagcaatagtaattatattacaggttaacataaacataattataaaatatgactataattttcaaaaatataataaaacaagtggcactgttttatacttctgcaaaagtctttaatatctaggtaacaaaaatgacatctggattatcatatttgcttctattaatacattcaatatgctgcaatgtcacatatggagtggactctggcaaaccactgtatactcatgagagaatgagaacaaagaaggcaaatatcatcttagtattcttataaaattctaagtattcttataaaaattcttttaaaatattcttaaaaaataacatcttagtattcttatttaaacaaaatagttataaaaacagttttgaccccgtggatctctaaaaaggtcatagggcccccggaggctcctggtcaacattgctaacatgcagcaatgcctgccttccatggataaatggaggctgctcatgcagactggaaagcatgcctattatcccactgctcaaaagtttaaatatggccattcatgctttaacaaatatgtaaaatagcaatgaatatatatttagctataatcctatttgttagaacttgtgcctctgtagctaccattgcctgttaccactgtctctactgccagtgaggtcatcacaaataatgcaagaatttggggtctccatggacacaacacatttttgaccattttaatgtgaatcaatgggaaaaccaccattacaaatttccaggaacacattgaattccaaatactataaatccacatttttgcagagtagaagaaaaatactaatcaaactcccaatataaacctatgctcaggcataggttttgttgtcagttaacaaccccctccaccccatattgtttccctgtgaagatatcaccaaatgtctatattgaaattagatagatgattactctcatttatgccttggggtacagagtcatacactaaaatcttaaacagaagattcaattaatcatcaaccttccccatttctggtggatcccaagaataagagcccggtggcgatctggtatgcatgtggggagaacaggtttgctcctctgaggaggccaagacccattctctccccacacagaagtgccctggggagtcacccgccgcagaggccatgacaatgtcgagtgccaggtgcacctgtcgtgtgggcagatggggagaccagcgacggcagtccctgagtaatggttaagttaattagcctttccatggcagatcatttaattactcatcccctctgacagggtgagaggagattttagaaaacttttagagccgcaactcatatgaaagaaatgtctttatatacttttttccaatacgtaacatcactgttgcccccaaaactttaaaacagcaacaaaatcactctgattatatgctttaggagactctatcaacatccataaagcataaaagtcggtaagtttagagcgtgttctaagttgtggatcttcacaggattttgtgcagtgaggtcagtcagcaggaaactcaacaggactggcatgtaaaactcaccaacattggaaaagcacaagactttaataaattgcactatgccaattaaggaatgtaccccaatcctcccaaaaattaacacagagactttttaaagaattcagtgtgttggaatacagagatagttagtaaacacaaactaacaaaaatcctaattttagtggcctgactttctgaaggtgtgttatccacaggcttgtccttaactagctttctggagctcctggaaaataaaacgtagccctctacatccttatcctatatatgtattctcaaaattgttcttctgctctcaagaacggtgcctcgaatgacacccacattttcattcattcgttcatttatccatccatacagtcactcatgcagtccatgaagtaacaagtgccttcttacctatttatctccttagtgggaggtaagtccctagaaggctgtgactttgtggtctttctgcatccagagcacaaacatatccttaataaatgaacgatcatgcttcagaacaaagatggtctcactgacttgaggcaagattacaaacgccttcgctcatattcaatatcagaaactaatcgcatgttccagatcttgacaaaataagccaataaaaccacacaagctacctgtactccctactacaacagtcatatgtgtagcattttgtacattttagatgctccatataatattggtagtaaatatccagtgaagaagtgcatttgtccttctgggttttctcctttttatttctacttggaactgtgagctttcattagaataatatatgctttcatcctcaaatttttgataaagttggaagagcctgaatttagcacaatactgaattaaagtaacccattttctcctcctcctctctggtacagagtgaaatcccaaagcactcctacctaaaatgtttctaaaatacatattagagcaaaaattcgcctaattttaatacagatatttctaatcttaactcttgcaattacttcttcctcgagtgtaaagtcaaacacttcaaaaaaaagctttccttgagatatatacttcttataaatcattgaagaaacacttaatttcttaattattgtggaaaatctaggtttctgaatgggtattccttatgttgccacgctctctaagaaacttggaattccctatgtttccaggtatacccctgcctctgcaaccccactttgccaccctgatatttcttctttaaattttaaaattccactaaaataaatctaggtttgtgttatgtctgacaattaagacaaacttttaaaaacaacagaactttattaataatgttcaagttgttccatcaattttggtaacattcaaaacagatgaactatatgtagcttaatatggaaagggaattcttgagggaaaaaaaacatgctaatcaagcatgctaatcatctcctaaggagcattacatacctgtggggaaagggggtgacgatagcccttacatgacaactaatttagttttcacgactttcaattatctatgcctctgaaatctcattctgtctctgttttgacaacggccccaacatagtatctgtgaggaggcttgagccatttatctaggctcagaaaaagaaggtttgtgagttccaaagggaagagttgaaggaggtactgatggaatccctgatggactgtcacacaggaaagtttatacactaaaacattccttcatttgtggaatgatttacacacacgagggtgagttcagctcaacaaaatggtggttttattatcattatttttttgagatagggtctcactttgttgcccaggctagagtgcagtggtgtgatcatggctcactgcagcctcaatctcctgggctcaagcaatccttttatgtcagcctcctgagtaactgggatcacaggtgtgggtcatcatgccctgttcttttttttttttttttttttttttttcggagtctccctctgccaccaggctggagttcagtggcgcgatctcggctcactgcaacctctgactcccgggttcaagagattctcctgcctcagcctcccgagtagctgggactacaggcacgtgccaccacatccagctatttttctgtatttttagtagagacaaggtttcaccatgttggccaggatggtctcaatctcttgaccttgtgatccacaagcctccaaaagtgccccagcctcccaaagtgttgagattacagccgtgagccacggtgcctggctgccacactcaatttttaaaaaatgtttcttagagacacggacttgctctgttgcccaggctgatcttgaattcctgggctcaagtgatcctcccacttcagcctccccaagtgctgggtttataggcataagccgccacaccgggcccaaaaaggtggtttttaggctaaattggaaatgctatcaatctattccacaaatattatgttgcttactaagttggaggggctttgctaggctctatggaaactacaatgatgagtgagactcagttcctgcagttacagagcattcagtctcagaaaacagataacacacctatggttcagcattatgagttggaaagtgtcccccaaaaatgcatatattgaagtcctaacccccagtactacagatgtggctttagagataggggcctttacagagttaatcaattttaaatgaggtcactagaatgggtcctaatccgacaggagtggagttcttaaaaaaagggaaaatttgaagataaacacacacacacacacacacacacacacacacacacaggaagaacaccatgtgaagatgaaagcatacattgaggtgacacttctacaagccaatgaacaagaaagatagccagcaaaccaccagaagccaggagagaggcatggagcagactcagaggcaaccaaccttgtcaatgcatcttggacttcagcctccagaacttcaagacgaacttctgttgtgtaagccacccccatctgcagtactttgttacagcagctctgacaaactaatacatccagatatattttaatataaaatctatcaactatgtatgtttgtacataatccatctctatacaaatatacatatacacatagcctgggaagatataatgggtgctccaagcaaagtgtgatgtattttgggcagaaggagtatttgattccgaccaggagaatcaaggaaaccttcatagaggaaatggcagtcacattttacaaaagttaagagcacaaaagtcagatgtcaaatatgaaaatttataactctagagttataaaatctttactgcaaagtgggtttttttccaatctaaggaacttcttcaacatgccatttctcaagagttgaagatgactatatgaatgattcaaatggcacacttcatagctaaacatccacaggcacacataatctcagccatagacatttttggtatgtccatcttcatattctttttactaagtctactgctatgcccagtataagatgctacctcagtgctttattaggggaatattgacttagttcatattccagagtggagacggtttgcaaacacatgtatatactctctggctgccccattattggagcatatgttggccacttgtgggtgtaaggagttaggtgacctgtggtcttgaaactggtctgcccataaccaagccttcactaactcaggtctctacccaactgagccattattaaacctcaggagcactataaatttactgacttttataaaccattcaactaaatagccttctctaaagcatttggtaagagtaatttgatgctctgatcatctgccaattcattttatgagtccataacctaacagaacccatctcactttcctttcagagtcattttcatcattgagctttgtatcctgtttagattcttcttttctaatcttttcaggactgtatgagttggatttctcctggttgcaagtaacagaaacaaacttcaggtacaataagaaaggggaggtatttattgaatgcggtatggtatttcaggaggaactgaaccaccaaactctaggagaagcaagagctgggtaagcagcaggggtctctgcagcaagaatttatataccacttggcatgacactccaacgatgccctagttgagctctggggactcttggtttctattccatcagttccacgttttaattctctggagtaagatcctgattggcatagcataggtgaggtacacaccctgaagtgaccagctttgacctgggagcagggtcatatagcacagtcttagatgtggtcctgtcccttataggttgggggcagttctaagagaaggaaataattgttagagtctaccacatgggtcgaaaatttatacttctactataccatcctttctttgaaaagcactttttatatatttcttaattaatccttacttggacctgtagcaaaaaaataaccggatctctttttgtttttggaactcaatagtttttgcatccatttcaattatattaactccatttgaggtatgccattaaataccttactaacattgagcctacatcttgttttcttcatactatcttgaccccttcctagttattgtgacttaacaatttatattaagcacattcttcattcttccctctacaacacttaaccagcttaagtctatatatttctgtgtattcccactgtcaccaccatcagcacgttttatactgtgcacattcctagaaaagttaactatgaaacactgtgtacatgttcacaaaattgtataatattagagccagagagtacagtcttaggaggcacacaaacaaatcagaaagtatctttctgttctattcctatccttcacaccattaccaggaagactgttcaaaataacaagatttcaagacacagacccttttaaaagaatgtccattgtaaaaatccagagaataaaagagaaagccagacttccctatattctttgtaaaaaatcaaatcgtgaccaaatgtggacaatattcaattagtacctgatttgacaagtagctgaaatcaacaataaagtcaacaatgagaatcttcagagggaaaaataaaagaacctaataacagacagcctagaatcttaagagaggtgaaatgaatggaaccaatctgtaaaataatatctattccactacgtaaaactctgaaaggaagaaaaaattcttagatgtgtaaccacctaggacactctcaagagaggtaaaagtgtttcagaaaacaggaaagcaattggtgggcaaacaacaggaaatgtttttgtagaaaaaaaataggataacaaccaggcaggaaaattctgtcaaaacaggctactggaaactttctgtttatacataaataaatctaagtattcataattatcatctatttcactgacacagtgagagagaacaaaataagaaatgagggcatttcttgtatcttaacacaagagaggggaaaagcaaatagtgagttcagacacagagccaacaaaaagccacttcctaaaggatatgagatacccatcgtgcccgaaggcagatgatagctctggtgctgagcacagtctttgaacatattttgtttacatttaagataaaagaggataatgataatgatgaacacttataaagtaattacattccgagtactttacgttagttattaacttgtttaatccttaccccaaccatgacgtaggtgctattattttccccattttacagatgttgaaaataaagtacagagagattaagtatcttccacaaggtcccagagctacacctggacacaggcactcttggcaccaaagtcctcattcttaaccttaatgctatgctagcaacatgattctagctggagttatgatttttatattacatataattgttcagtaatccggacacacacacacaaaacctccatgaatttcatgggaacctctcaaaatccattttaattcatcatgggagtcagacactgttctgcttgagttcagactcccagctcttccacgtaccagctcactggctagggaaagttactcacactctctctgtgggagtgtatctttatttacaaacacacactgcccctttctgttgggaagattttacttccccaccccactgatactagacttggcatctcacttgttttgagcaataaatcatggataaaagaagcacacataacttctgtgcagaaaacactaagagccagacaagatctgccatgttctctcattatgatcagcaatggtcaagaaggacactggcctgggtcctgaagtgcatataccttggagcagagcagctgacccaccacaggcatctggtgggcaataaggatgccactgtagttataacccactaggatctggaggccatttattaccataacataacctcctctctccactcatatactctctgtgccttaatgtcctacctccttctagcgttgctgtgggcattaaatgagttatttttataaagcatgtagataagaaacaaagtatgagtgagccagatactaacctgaagagtgcaattagagaaaagaacactagaggaaacattaccaatactaatcaaatcaaatgcttttctggttctcaaatccttttgactgagttctaatgttacactggtcaccctgagagctttttgcaaacttcttctcttcaatgctcccttcttgatccagtaataacacatttatttacatataattcagggctttactcttgctgacccaaaggctccagacagctttccttctgcaaagtttggttgtttacttagaccatgaagatattcctccttttcccattttcctcttttccctcagctatctttttctgaaaccgacttcaacactagtttcccatatgtaggaggcaattttagtgagatattaataactggtatctctttgtttttacaggtaaaggattagaaatcactgtgacaagtttgtttcttgagtttttacaggcttcaatttgctaatgtacaaaattttataataaagcatcttaccaattaatgttccacacaaatggtttttaggggatgctgctgccaaccattccaaatatgttgtaatgagcagatagcaagacatctcatgcccaagggaaagatattgtgaggctccctccaaaccatcttataaatcatagactactacacgaaggtcttcgagaacaataccctcattttagtgacaagaaatggaggctcaaagaataaagaatggagaaaatggaggctcaaagaggttgagtattttattgagaaaaatcaaagtgagttaaagagtaaaactgattacaacagagtcatccatggattcaaactagtcctctttccagggatgactgtgtttaaaaggaaaacacatggaaatatgagtacctctgtctagactaaaagacatgtttaaaaccaatcaacatattcaccctttgttacctaacatcttactgggttttaatctggcccattcacaaaagtcaaaggggttactagggaaggtgacaattaacagagcccagtttaactacgctcatgtgtgaagcaggttggaagggatgaatcaggatctaggcttatctaaactaagatataacacagacagcaagttactcctgctatcaaaaggctttatttggtacttacttgctgtataaataactcactagctatttgctctgaaacaacaatgattagaatggctctcatatccaacaaaacactgaaacaggcaacagacagggtccatcaaaaaaaaaatactaacggtacctatgactgcttttcactgttaacagtggcaaataaaaccaaaagttattctgcacacttaccactctcatgatctctaaatttgcttgtctgaaagaaatgtaccaaagattaataaatcttacaagaaaacaaatggaacatgtaaattgctgaggagtttgttccctttaattttatgctagtcattttccgaaatccagaagaaagacatttgctaaagctttgtgtgtcttctagcaaaaatcacttcgcatgtaactaaataggtacagaaaggacacactttttaagtgtataatgataaaactcagatatgtagtgtatgtcattctcgatcacaaaagctgtgtgggttttctctgtttcttagctaagttctcctgtctaaaagacaaaagagaaaacaaaaccaaagagaaaaggattctgcaggcatctatacacaagaaaggcataatattcaaaagtcacagagccaagcatggcagtgagtctgtagtttcagctactcagaaggattgcttgagcccaggagttcaaggccagcctgaacaacatggcaacactctatctctaaaaatatatataaattaaataaatgtttaaaaatgttttaagtcacaacaaagaatggatattgtcagagatcggaattccatttaaaaaatatatttctgctttggagaagggctcaagccattgaaaagaaaaagaaaagcactaacagacaaagttaggaactgaaatacatttaaaaggtcaaagggaaaacaactagaaatgtcctacttagtccaaaaggaaagaaaacccagcaacaaacagggactctcacaaatggagaatgtctttagcacaatacaataagaccgttgtgtgtgacaccttgataaattaaagaaacagaaacactgtcaccaaaagaaaaggaagaaaggaaggaaattcacaaatagtgcccacaaaagatggataagaaagttttaagagaatatgagcactgattaaaggcaagcaagaaaaacaagataggctctatctagctaagcccctactgcacaagcctattgtcttatttcctttggcactgactacaagagaatttcatcatatgtctaataatagtattatttataaaatagaagaataacatcttgataagaatatacctcaatggcaaaatgtctccttctatataatctgagtgtatagatgaaaaagaaatgttttcaaagtaataacaattacaaggcaatcagtgaacgagataagcacttgcagaaggagccacattaaatctattcaactgactggcttctgtgttatgtgagtccaagaatggataactgctgctccctggaaaaacctgcagtgctgtaaaaaccagcccatgccactgtgtctgtgggacgaggaaaatgttaaagaagcaatagagacaaatgggaaaggctgacaacacaactccttatacttcttaattcagcattatattcattgacctattacgtataggtcaatatgaagaaaaaggattttagaaatcacacactcacagatatggtccctgccctccgaaagctagaagttgttaaacactactttggtcattgaccttaccaatacccattttatgcaagcataaatagtgtctaactctataaagttatgttcaacactggccagtatccctatattattttgctgacatacatacatattgcattgaaataaaaaaatcaaaagagtattttcacaagtccgagtttataaacaattgaatatattcatccatatataaacatctatattctgctgaatatagatgcttcctatttcctagtttcatatacattatatgtataacttaactacatttaaataccaattttatataccaagtgcagcctgatgagctatttcaaagcctatgttgacaatttgctagagttgggaaaaaataaaataccttcaacataattagctggtaagtaccacattaagccatcactgtgtagctgctactattctacatgcttttacatgcatcgtcttattgaatccatacaaatctcttctttttatagatgaggaatcagaacttccaactgagcagcccacactctaaaccactgtactatataccccttctccccacatacctacagaggcgatttctttggagcctaatatttgttggctattaatggaaattttactttgctgtggaaacacgatcaaaccaacaatgactcaaatcattgaagaacccatcaggactatcgaaagaagggccagacaaccagactaaaacctgggagcaaacacaggctccaaactgcagcagataggagcactcctcatgagagcttaagggaggatcgcatgagagcttaaggagttcattttgtgacagggtttggccagaagtgccagaatgtcaggaagggagactcttatgaaggggatttcaaggctggtcatcagtggagagaactggatagaactccaatttctgaaaggtctgatggccataacataagtcctttagataaacaaaagtacactgcagaatttcaagacattcacacagcatggagcaaatcagcaacaaagatgatctgaacacattgcggggctcttacatttctttcccaataaaactcataaccattaaacaaaatgtactagtgtgctattctgccaaactatgagaccattagttctctggaccctgacaagtctgccttgaaatacggcagatctaggtctccacaacactgattctccatgaggaataagctagctcttggaacactaattccagtactgaccactgtatgttctttaacatgtcgctcatatctggagaagtgtgtcaggaacaaaatataaaactgttcgcagattttctgactttgacctccatctctcagttctcggctatgggctaaactgtatgcattctttataattttccaggtgcttttgaaagaaatgtagttcatcctagagggtgacaagagaaggctttatgtcaaattttacttttaaaatagttacctaaagttttaaagactgactttacttttcagaaagatgaaaaatgttaaggaaagaacaaagaaaaaatacatttagacacagtaagcaattcattcttaagtaaatatttatataaataagtgtccctcagtcgagacttatgaccctggttgttaattggccttaagacagaaattcttaaggccagttaacaaccagggtcataagtctcgactgagggaccccatccaactcagtacatcctcaatgcacgttaggtccttggtagagtctcatggaactgaagctacttaacatctgagtcttggattccttatcttcaaactctggtgataatacagtcagtcttcattactcacacaattataaattggtaattccacaattagaaattggtctgctcactcaaatgtatttgcaaccccaagatcaatactcatgatgccttcactgtcccttgcagacttgcacagagcagtgaaagtgtgagtgaccaatgtgcacattccaaactgaggtcacgcaaggggtgacgctccacagctcttggtgtccttttcgtgatctatttagtgccactttttgcatgtttgtgctttctgttggtgactgtattgattaaaatggcccccaattacagtactgaagtactaagtcctcctgagtacaaaaaggcaggctgggcatggtggctcacacctgtaatcctagcattttgggaggcagaggcggtggatcgctttgagcttaggagttcaagacccagactgggcaacaaggcaaaaccccatctctacaagaaaataataatgccagaaagtggtggctcaaaatacaaaatacaggctgggcacagtggctcatgcctgcaatcccagcatgttgggaggccgaggtggcatggatcacctgaggttaggagttcgagaccagcctgaccaacatggaggaaccccatcagtactaaaaatacaaaattagccaggcatggtggcatgcacctgtaatcccagctactcgggaggctgaggcaggagaatcacttggacccgggaggcagatgttgcagtgagccgagattgtgccatcgcactccagcctgggcaacaaaagtgaaactctatctcaaaaaaaaaaaaaaatgcaaaaaaatggtggcttgtgccttggtcccagttactctataggctgaggctggaagattgcttgagctgggaagtggaggctgcagtgagccaagatcacatcactgccctgcaacttgggtgacaaatcaagaccctgtctcagaccaaaaaaaaaaaaaaaaaaaaaaaaaaaaagctgtgatatgtcttatggataaaatgtatgtgttagacaagcttcaggtatgagtcatagtgctgttggctatgagttcgatgctgatgaatcaacaatacatattaaaaaggagtctttaagcagaaacatacataaaacaccataaggttatgcactgatcagctaaaaaaccagagccagaggctcacaggaatctaaccctgtattttccttaggagcaatggttcagtgtttaaggtgacttcatagaacataactactatgaataaggagaactcagcatatataccctaccagttgtttttaggttctgaaaaaatatacaggttaatgacctgtgaagtgaccagcataattaggaacgcaagggattttacctacctataagtaaaaggactgttctcttaggtgtctgacaaacaccacaactaaaaatatcaaactgagatacagcatatttcatagatgatgataggaaaaatgaaatttcatttgaatgtatcacttaagtcaatacattagaagtgggaaatattaagatataatttaaaatccatcaaaaggcatttggattctaaatcaggttaacattgttagacaatatgctatcaactctgctaattagaaagtcacagccttttattcataagccttcaagtaaatccaattaaaatggaagttcaagcttgggaatctcagtcacaggtctattacctctataggcttcaattatgaagctgtcccgaaagtaggaaacacagggtttcaactcaaagtccacataagagtagaaattcaccatttacattaggtatatcccctaatgctatccctctctcctctccatgtcaagttaacgggtgcagcacaccaacatggcacacgtatacatatgtaacaaacctgtaccttgggcacatgtaccctagaacttaaagtataataaaaaaaaaagagcgaaatctctgtatcaaatttaaaaaaaagagtagaaactcaccaagaaatgctcctattggctgaatctagaaaatttactttatgaaacatcagtgcattgcttattttaaaaaaaagctgtactttgataccttgattaattatgacaaattattatattcctaagcagagatagattttttaattttgtgtacaagtataacaaagtaaacccttgcttgatggagttaagaccactttaatccagatctccttaattcagaaccaagaacctagacaagtatttctttgttctatgaaaatataagaataaaaggatagcaaaagaataagtgacattaaaaaaggctaaagttttagaacattgcattaaaaactgaagaaaaaacttcaagactttgaaagcacccatttacatatgactttatttattcattcaatattcattaattccacacacacttattgagttctgctctgggccagccatcagaaatccccaggagaagcagatactgaacagcctttctgaagctcacagtctagtaggtgagacacacgtgtaaacaaatgcactgcaccgtgataaagacaattgaagatgtaactgcaaagaaaaatgttactcagcagaggctgctgctttgaaaataaccctttaaaagatgtctcacctcagcattgaaggctcctcctggggacacactttactaactcagctctagttaataggaaaactgcaaaaatgatgcagctacaattctctggaggtaggagggaaacctcatgcactcagactggattgtaccagcacctctccccttcattctcaagtcacttttgccacccaaacctcaactaatggaaagtaaccaagttaaccagaaggtgaaggcacgggtcctgcaggaggtgtttctggctgttacaagcacgggaaggaaagctccaccactgtggccaatgaaaacttgtcattcgctctcatgcaaaagagaacacaacttccatcacttgactaagccagaggttaactcacttagtcaagtgatggaaagtttcctcactttagtttttctcaaaaaagtgacactttaattatatgagcacacctattttatcctttcttacctccccctctacttataaaacaatatatctgtgattctatgtcttttcccaggtttagaatctgagtggctcatgtgcttgaggctcctggagagaaatagaatcagtggatagaactcaatctcccacatgggtcatggcgaaggcagtggcttcaagcccagcctttggtaaagtctctggtagtatcactgccagggccacaggaccgcagagcctatagcattctctctatgactaactatagaaggctctcagtcttgtggatgagaaagaagctccttcatgaaatggcttgtctccctgttaaaaagaagacacaggcaccgttgtttttgcttattttttctcactcagtcagtaccatccagtacttacttacatttgtctagtctctcctaaacgacttctggaaaagactccaaaatctttttaagcagccccaactagctacattccagagcaaagcattctttatttataaatgaaagggctcagcagtagcttctagccttatctcactcttctctagacaagggggttccatgaagacatgttccacaggtaggtttgaaaaaacatttcaagtatcaggggccaaggtcctgcttccagttcctctaccacataaatgtttagtcctacaacctgtctggtcctggttttctcattacaaagcaagaggaatgaatgaaagagggtctgtaaaatccccttcccattctctcagtctgtatgtaacctggtaatatatcttctattccaggttaatagtgaaccccaattcctttatgaggtccttatgttatacatacaatccctaatgttaaaacaggatttaaaatactattatacagtccatcatgttggattcctataaatatgggtttttcatacttgccaatcaaattaattagccaaattcacttatcaaagtccatttaatacattatgtgctggcatcttctaaaatatgttcacttattatgtttactagaaagaatttttaatgagcagctgcctcaaaattaattaatgtatatagcttccactataaagttacaagccaaatcccactaatacaatttcagtgaatagctcagactgcaaaatacagcaaaactccaactgctagcccatttatttagagaagcatgtgaatcaacaaatttacaagagcatgaaacaagcagttatgatattcatgtagattttgagtactatattccgtgaaataccacaacatggaattctagcaaatcaaggaaactctattggtacctcatatcttcctgtatactctatacaggaagtagaaatacttttctgttatagaactagactataggaaaatcaaggtatttgactgtaccagctagattctgattttttctattctctaaaaatctcacaccaaagaattattttacagcccattaactgatttccttcaaatcctgctaccttttatttatactctgtttatgtgctaaattctaaagagtttctgaaggaaactaaagtaggttaaataaaactgaaacactgctttgccaacattttttaaaaatcaaagtcaggtgtaattaaaagaaaatgattatacagcttgctagcacttgttccatttttaagaacaaatgttcagacttacctaggggatgtttccatctgcttctctcagtttggtttccatgctttagctttaactattatatgtaggcaaattaccaatgtctgactatctaacaataaataaccctggccttatttttttttcaaataacccttaccaaaactgaaatcatattttctcaaatcatattttaacagctagtcttacattagccagaaaggagacctcaccatcacaatttggagaaaataaacacctcattattgataacactgtctagagttgcgcattccggagttacgaacttagccaccatgcagatagaatacctactctcctaaaggctaaaatccaaaattaatgtgaaggtgtattttaagaaatggtaaacaataaagataataaaatagtaagataaaaccattaaacagacacccagtggccaatatattacaattggagataaaaatatatgcatttctggcttaataagttagtgacttagaacagtacaagagtgacatggaatcacagaagtgacaaaacttggccacaacaaagccctgatgaaaagcaaattgctccaatacagtgtccgtacacttcacccttgcatgcccatctctgatgccccccaaagtagctgcataactgatttatttttcatccagatggctggcgtcctgtacagacttacaatgctgactgtcttggggatgcttattcagtgagtcttgaaagccattattcactaatttcatgtggaaatgaaatttcagcctcccattgtgtacgtataacttgggtacttccaccacatacaaaaagtgctttttgccaggcgggagaggatgactggaatgcaaaacccttcctgcatgcctccctggcccagacccaagctggcatatggcagttccaccaaccacctccatatagaacactaggtgaatgctttaagcaagtcctaataatgtgatttacaaagcactcactggatggctgtcttctgcctctattttcattcaggataggagattaatcttatttcatgaaaagcattttactacattctgtttcttgcattcaccctcctccctacatcttttttaaaagaaaaaacaattttgctaaaattctgtatatctaaaaagaatcatgagtttccaagttttcttaccttactattttcttattctagaacttaatcctcaacacaggatttactttctgtttcaagcctgtgactagcaggcaaagaaaactggtctttagagagcaagttaaacgttttagctaaattcatgtgctttgaatgaaacattcccacgctgtgcttataaacaactattgatattttctgtaacttcattccagaaattgtttgcttttaaatgtcagagagctctcttcctcgccctattttgggttttatttcagtcggcagtgttgctcatcagtaataaatacaaattcttatgtagagacacactcacatcacatgctggagctgaggagctcaaagtattttacaaacatgatcaaaatcactaatgacttccagctctggaatctgacttctggatctgtctcagaagacttatttacatcatctttgcaaaatataatttgtatttataaacacaggcatttatctagtacttagcaatgaatgcaagtcatagccctggcactgacattcatttccaactgtggttccaactgaacttcccagagatgtaagatatgactgtctatggtaaccttcctcctttgattctgaggagtaaacggcatttcctctcctcttctattttcatctactctgccacataactcttcctcaccagtggcatctgcagggggacaagccctccttctttcacatatcccaggaacgtggtttgtccactaggccttctccaggcttgtctctcagatatatgaatttcagaatgagatgggtgatatgcatgtagggatattttgcatattaaaagtaaaaatagccgggcacggtggctcacacctgtaatcccagcactttgagaggccgaggtggttggaccttgaggtaaggagttcgagaccagcctggccaacatggtaaaactccatctctactaaaaatacaaaaattagctgggcatggtggcgggtgcctgtaatcccagctactcagaaggctgaggcaggagaatcatttgaaaccgggaggcagaggtttgcgttgagccgagatcacactgttgcactccagcctgggcaacaagagcgaaactctgtctcaaaaaaaaaaaaaaaaaaaaaagcaaaaatgaccaaggcaaaatagctccattctgaattacacatccaccttctgaaggtaaccaatgctgtcagaatccagcttggtaaatactctgtttttcttttcttttcttttcttttttttttaactgagagaacatatacaaaatcaactttatcttatcctggaatcacattctactataatgaaagacagatagccttgtctcaagaaaagtaaaagcaagaaagtagctctagcatggaggtgatacccaaatataaacagggctggtttcagaatttctaagcaggcttccaagaaacaatctgattggaagcagaaggcaacctattggtcttgaagctacatttgcagaaccagatcacccttcttacttggattgtgggtttactaagagtgttggagtgggtagctaacggagattctacctttaactatattaatgcaaactgtggtatagccctggaaataatactgctactgcatgcaatatcatcagccagatctttcttagaagacagctccaatctatcgactttaaaagaaatacaaatgaatgagaaaatgcttttgaaaaacagcgaagacactcaaggatgcataaatgtaaactgacaaacatgtaaacaataaagcaaaagtgaatgtctatttctcctcctctcatatcttgcagggcactaccgggaaagtttttttatagtaggcctacatgatagagtactttgtacaaaagatcagagcatgattagctcaagcgttagatgaccataaaactggagttacacaatataccccaatgtacagtttatgtcacaaaataaaaagaaagacttcctcataatcatgtttctttcacattttaagtgtttggtgtttttgactaaccatattatgctataaaatcaaaagtaatcacttttagggtcctttgagaaatccttcttcatacttatatatattttttaaaaaggctaggagcaacaaatcctggattcttccataatttaagtgcaacccccattttttaaatcatgaaatagagtttaaattggcaggagggggagctgcccaacaaagttgtacctagagagaacctttcctgtaagtcccttttgaacaaataagtggttctaatcaaattgtggatgtatgatgagattctcaaaacaaaggaagtctactcctctaggagacactagattgaatgaagcatttcatagcatttcatctatggaagaactaggccctctcctgaaaaatacttgctttggtccctaccataaagcagcaaggtagtaaaggagaaaatgctgtgacagtgttttcttttgattcagtccagtagctatggaaactatcttttaaatgccaattggtcctcttccctgcaactacataaaataaaaccatttcttaccctcacggatgccatggctggaagctccatttttcaacacgttcaactaatctaagccctctcccacttttgctcagtatttgcaagctgaagctatcatatttgattgatactatggatttaaattagaatacacatgaatgtacttctaactaaggctgcgaggagtaataatgcccaaaccacaagtaaacatttgttaaacctgcttgatgtgctccaagaaaaacaacgtttgcttctttctctttccctatatctcttcttctgaggtaaaaatgcatgtaattcccatcacttgtaacgtgtttttcttttcagtgcctgtgcatataccataggccacaagctgcaattcagggtcaagagtttccttctatttacaaatataaaaaattaagatttttcttttgtggctccctcaataggaaaatggtagacaagctaaaatataaactgatactagggtctgactgtttttctgcatggatttcaatcctatcccattcaaaacagaatcatctccagagatctatttctagatttattcattgtttaattttttgagatttgtcatttttatttccttcactatatttaaacttttctttcagtaaacaagtttgataaagatggatattctttgtgtacagcttcctacttcaatatcaccttagttcatcatctttattgtcaaattcccttgtaatctatctctttgtaagatcctccctaaaattttgagatttgcaaatgcaaaatacaacaaactgttatgttccaacatgcattaacttttctcactgatttttttcagtgtgacttttctctttaacctccaatctgtctcatacaatttattggtagtatagtatttatataaccctattttatgcacagttagcatgaatcttaaaaaattaagggctacaatacccaagacaattctaaaggacaacagaattaaaggacttaaccacaccttaagaaatgccataaagatatagaattaagacagtgtgtttgaagcaaaacatataaatatatatttaaaaaaacaggcccatgggagaaaaggaggagctagaaagagactcacagttaagactgtcacttgatatacaacaagagtgacaaggaaagtatgggaaaagtcttctcactatatgattatgggtcagttggacacccatatgaaggaaagtaactcttaatctttaattcataccacaaacaaaactcaattcctgagggactgcaaatataagagagaaaataacaaagcttctgtaaaaaataaaacaagaacataagaacatatcttgatgactttggaagaggcaaaggtttcttaacacatagcaagtactaagcataaaggactttattaattttaataaatctataaagggaaaatgtatttgcaatatctacacccagttaaagacttgaaaataccaagtgtctgtaggcaaatatgtggagaagacagaggtctctgccactgctggtgggagtgtaaactggtacaaacactttggggaactgatagaacacgtgtatacccaagagccaacaaaatactcaccaaaaatatgtacaaacctgttcatagcagcacattacacagaagacccagaccaggacatacccaattgtccatcaacgatcaactacatcaataaatcatgctatattcatttaatgaaatgctgccccgtaactagaatgaagtgtttacgactacttgcaatgatataggtaagtatcacgaatacaatattgaatgaaaaaacagcgagaaaaaaacaaaccataagtattgaattattctatttgtattgaattattctattcatacagaggtctaatatggggaaaaaccaatttatggtaacagaaatcaggatagtatttgtgcatgacaaacaaggcatggagtgaattcttggattctttttcttgacctgggtgctaattacataggtgttttcactttgtgaaaaaccagtatactaacacttgatttgtgtgctcttccgtatgtatgttacacctcaataaatttttttttaattaaaggcgcaatccctattttcaatgaacatacaattaaattttgaaaccagaaaacatagaggaaaaacaggagaatgttaacaggaaacaggccacaagtagtttcaatcagcacatattcagcaaattcctatgcttgtggccaatattttaggagtgattgaaacatttataagtattgaaaaaattccccctgctctccaggagtttataactcagagcaaaaaaggatttttttgatttgatcaggaaaaaaaaaaaaaaaaaaatggaggtggggagagtcatagcagacactaaacaattataatgctagggcagtcaactagcatatgttgcaacagctgtgctgtggggattgagaaagaatcatggttggggtctgaaattatcaagaaaggcctcatggaagagacgaatgtgaccgtggagtggaaacatgcatagcatctgaattcacagtgtgaggacccagcaataggaatgattccagggagggaggctgtaggggcaaaatgaatggtaactgagtagacggagctttcctggtgaggtaggtaaaggggagtcactgaggaagaaaacactgaaaaccaaactgtattctaatggaaaaaaaaaaaatcactgtctatcctcaaatggagcaatgacatgaaaaaaagcttgttaaaaatatgtatccctttaacaatactgcttgtctctggaaactttttcaaactgtaggtcacagcaaattagcaaggagtaaaatcgctataatgtatggtaacccattttccctaaaagtgaaatagaaaaaaagcagaaaacaccacagtgccctacacagatccttagcaagaatgtacgtattccagctgatgctgccgccaattgctggaatcagtgggtaagacatggtgtgggcaacgtaaggaatacatacaatggctgcctcatccagcttcattttgtgaaatagcattgtttcttgaaatttttgtttttgtgatttacatgtgtgtgtgtatatatttgcatttatatgcataccgcgttgaaaataaaatgtgtttctcactgcggcttccaatcaagaaagtctgaacaatattcttccagaagtggagttctgcagaattcatttgaacaaggagtctatgcccaaataacattaaatgaggagatgcagaataaatgaatgagcaaacaggtagtgttaaaagtctacattaagacatgtagaccctccccaggttgtgcttcagccttaggattatttactcctccttggattccctgtatcccagaagttactcaatccagcatccttttcaataacatgaaatgaggctggaatttaaccatttcctaaatccaattcttcctgcctgcctgatctatctagcacgttgtgaggccttgcaaatagaatcatttatatcacatgcactatttaaagtaatgttagtttgtatttttaaacactgttccatttataaacacctaatacacacagccctgcttaaaaagaatcaaataactggcaatttggggcagaactgtgagatgtcttcactttaaattatcttgatatttgtcatgtttcttcctgattttcaacacacaaatctagcttcagggtggctaatggctgttttatgatagtctcattaatgacgttgttataaaaactgtgagaagcattaaaaataaatttttacataaagtgattttattctatgttaatttcctacccctttaaaattttgcagcattcaattaaaatcacataagaatttccaaaccccttcaaattttacagcattaaattaaaatcccataagtagcctccatccatgtttccacccccaccactttaaattaaaagggaaactcactagaaacccaaggtcttacgctattaaaagcattccaatcagccacacaaagtatttattgtgggacaacatccatgaatagttaaagacccacttaaaaatatgaatatgttttctttatagaagcttatcctaggagcagagaaggccttcattcattctgaaacctggcaacccggaagtaggcagcatgaaatctctcaagtgtacactcacttcctgttttgcataggttagcctttctccatgctccatagttctgcaatttctcccttccacatcctattttctattgcggctacttcaagtcatgtgtgtctcatgttacttgttccagagttaccctaaagtattttcatatgtgactatactaggaaaagggaattggaaattgtaaagtcctatgaggggattagcagtctccctgccaatgaggtcatgtgttgactagtcacattactgatgaagtgttcaaagcaactaagaaatttatcccaaaaagctgcattgatattctggagaaactgtttgttattacttaggaaggaagttggctgcatgctaaaagggaaaactagaacttgtccatgtgcagttgctttcatatcagctggtcacacaactttcgttgatttcattacagcccctgggagaaggtggtggaatcataaagctaccttgactaagtgtggtgagtgatctgcactgcctctgtttgggactatttattcctaaatctacaccccacgccacagaagttgggcgtcttccacttcccgccctatgctattcagaaagggtttcttttcttctaccttatcctcaaacaaaaccacccagagttccatcacaaggccacctgctatttttagatggagatcctgggcatgtgccctgggctcgtctcccatgcccttcctctgcagtgtgcactaaacagggcagggaatataacatgtgagaggatttcagaggagggcctctggtccactgggaaaaaggcagcattggtgccaggaccctggtttctagtccaaattctgaggtcaactggccatgtgtccttgctcaacccatttgaactttcctaggtcttagtttcctagtttataaaatatagggacaagactggacaatgttgagctgcactgcagcttttaaattctcttcagtgtagagttggataattcatggttttacagggacatccttgactcagactgatccagcccagagcacatgtctaacccttgactgctccggttcgttccccaaccagatcaacagacccaaccctggtccttggaaaagtccatttcttccttccttcctgagttccaatttatcacatcttatcctgagaaaaatcatctgctcctcactactcagttttaaattggcagtatccctgaacatttcttggtatcttacttttaaatttgtttttcttgctcagcgtctgccagagagatgcctctaaattcatttaacctggaccgtgtcttcccctttagccattcccttcccccatcccactacctgaatcacccctacttatgccactgcccctgcccctcccacccaataggtctgcattctcatccagaactttgaatgagttaccttacacggtaaaaggaactttgcaggtgtaactaagttaaagatcttgagatggggaagttatcctggatttttttggcagggctcaatgcaattaacaaaggtccttgtgaaaggaactcgaaagagtcaaagcttcagaaagagatgtgaggatggatgtaggggtcaaagtgatacctctgccagaggccagaaaccaaggaatgtgaacaaccactagaaagtggggaaggttaaattctccctgagaacctccaaaatgaatggaaccctgccaacagcttgattttagcacttttgacccccagaactatgagataatacatttcttttgtctcaagccagtaagtttgtggcaaattattatagcagcaacaggaaaccaatacactttatctctgattgttctaggtacaaccaccttcaggctgacttgacgttagtcacccttcctccttcaaagtaactgttgattgaggacctcctatgtgccagctctgtgatgggttctgaacaaaagacaacacagattcaagctctatgtctacgaagctgacaatctgacaataaattctgacttgaaaccaataactacaaatataatgagatctacaaaggaagcacatacgcccaagggaacacaaggtggggcggtttgggaagggccctaacctagtctttggaggaaggaggttgaagctaagtcctgaaagatgaggtggcagtatcctggagaaaggactcaaggcagccagcaatgtgcttctgaagcaacgtaaagaaggcaggtgaagaaagaagacagaaaaggcagaacatgtaaagccaccaccaagggttttattattattattattattattattattattattattttactgcaacctaagaagagaggttttaaacagaggaatgacaggaaatctgaaaacatcaggatcctgagacatcagggaaggaatgccagagcacaaggagaaacaatgggtccaagcctttgaggttttgtttcaatgaacagatattccccaggaaggaatacctattaatccacagctatgtgatcaacctttatcaggaccttgacgtgagggtgaggcagccagggaacagcccaggtctaggcgagcggggcaggcagagcggatgatctgcttcaccaccgtacatttcctatgggttggagccctggacagctcagccctctgcctcaccctggacacccaccaccagcttagggcatgtaagacagcatgcaggtgtggttcctctgcctcatcctgggtacccaccaccagcttagggcacgtaagacagcatgcaggtgtggttcctgacaccatgtggagggccagccgagggcagggccacctgcttctgaggcaggctctgctctcctgaggttctcactgcctgctattttctcagtggaaacaggttctaaattgaaaacaggttctctcgcaatttttaaaaagcatttaaagaaaatacagccaggggcaatggctcatgcctgtaacccggacactttggggagccaaggagggaggatcacttgaggccaggagcttgagaccagcctggacaacacagggagcctacatctctacaaaaaattagttgtgcatgatggcacaaacctgtagtctcagctacttgggaggctgaggtagcaagatggcttgagcccaggaggttgaggctgcagtgagccttgatcatgtcacagcactccagcctgggtgacagggtgagaccctgtctcaaacaaacaaacaaacaaacaaacaaaaacaagaaaagaaaatatgctttcttcttaaaagagaaagaaaatatatgcccctccatatctcaaagtttggcatccatggattcatccaaccacacactgaaaacattctttaaaaataaaaaaaaaaacccagcataacagtaataagaaaacacaaagaaaaaatacagtgtaacaactgtttacacagcatttacattgttttaggtattataagtaatccagagataacttaaagtgtacaggaggatgtgtgtaggttatatgcaaatcctatgtggtttggtatcggggacttgagcatccatggattttggtactggtgaaaggtcctggaaccaatcccctgagcacagtgagggatgcctgtatctgctgctagccacatacagtggagtggaaaagaaaacagacaaattttttttttacccagaccctaaaactgccattgagctcccccaaagataggccaagccttgcatgaatttgccggactttatttggccacatggttttgacttcattgggcacaggagtgttaaggaggatgacaacactaaacacagcatttagcacatagcagatgccaaagtataaaaaaagcatataaaatcattcattattgactctacaaggcactctatcaaactgtaacctaaagcagagatttgctatgcaataatagttcttatttaatagatgtgaagatgagaaaagccctcattcactactatgaaatatatgcatctaacaaaattacacttgcatcccagtaattcatacaaataaaaagaaaaagaaaatataagtgaaatcagtgtatagactgtaaagaaacatgaactcaacatttatcttaaaaagcatattccttttaacagcaatgaagaccagacacaatccaaatgcatatttctgccccaagagtaatcaactgcattttgtttattggagtggttctttgaaattgaggccagaggccctgaaactatgaggaagtctctcctaatgtttggccacagtcataacccactaaaattttaatttttattttaatttctttaggaaaaataatatttcacagacctttagtccaagaattggaactgcataaggtaagggaaagataggctcagtgagttaaaagtgtccttcctatactggaagcatcattattcagaggatgatgacattttcatccccacatctcctgattaaacaaacaagagaacagaagcttggttttcagatgggagaggtgcttattatcaatgaggagagagttcctggtagtaaggattacttagaagagctataaaatcactttgcccagaggcccttaaatggaaagaaatccatctgctcatgttcgtttggatgtaaccattcctagaagcagttgcagaaaagagatgacttgaacttccattttcactacggggctctctttctagtcacagccaagtagaaaacacaaaagcacaagctcccaacaacatcacaactcatagacatcctaccattggctggagctgggtcccctcagcagcacagggactgtcagatcagaccacgagaggtctttgcgtacagtaatgctgccgtgaagcagtcccttttaaactccaatggcatgtttcttctgccctgtcactgatttagacaaaagaaggtgccctaagatttttctatgcccctgggggtctgagcccccatgagaccagaggttttttaggccaaagtcaggctgcccatgggcaccaccaaagacaaatggagaaagctttcctcaatgccagccaaaaatagggtctacaagggttctaaagttatagtgcatgatgcccataaatttaaattcatgacttacttgcaactggcagaattcgttccaatgtccagaataatatgctgaagcagccatttacaaaagcaagccacaaccctttaccattgtccttcagcaggcagccagcctcagggggtctgcagatagcaacttgtggcacgtgaggtgaagactctgtcagtcccattcattcacttcgccagccttcttagagaataatgaatcctgtgtttcagggtaaagatgccaacctcaccaagactgcctcttgctaaagtgaataaccataacagagttcctgctgggcaatcaggcaagcaatccccaacttttccactcaacgatgcaaagtacaccaagaatgcccaatgcatttcaaaatgtaacccaggttcagctctgtggctcagaaagcagattccttaagaaattctgggagagagggaaagagaattaatgtgtctagaagactcactctgtgccaggcattctgccggacctttacataacttacttcatcaaacactgatgataagcttacaaagagcttaaggcaagtattgttcttccttatttcatggaagaggcagtatatcccacaaattaagtaaatgaaggctatagaagacagaagttaatcactgggtttcacaaaggcagaaagtggcagagctagataagatttatgccctctctaccacccaaggcttcctttcaatgcccccatgccttggactccctcaccccccgtttcatcatatttatcccttgaatggaaccaggatggggaagcaatattccagttgtagaaactctggggtagagcttgagttctgcctttttcaagctaggtgacattttaaagatcatttaaactcctagtctcagtttccttatatgtaaaatgaagatgcaggccaaggccaaatgtgtattttagtgagaaaaaaagggaaaatatatgtaaaagtgctttaaaattataaattcaaatgtgagaaagtgtcatcacaaaaccactgaaggacccatgccagacatgtcccaccagctcccctacaatgtggagctcagagtaagagataaggctggactccagcatgttctttaaagagcaaccaggatatctgccttccgtcaactccaggagtaacaaaaataagcagaaattcacttctctcactggcattgactcattcattgctccactgcaaaagcctgggaaacatgcctaaaaaattttagatgatgataactatagcagctgatctccaaagatggcccccaatgacccctgtctcccaatattcatgacctggtgtaatctcctcccacagcgaaaacaggttggtcctgtggcatgctgtgatctatagaacatgagagaagtgacacaatgccagctccaggactaagccttaggaaggtctagaagtttacacttttgccctgaaccaccatgtaagtagtcctgctagagagagcatgtggagagatgatatggagggaaaaagacacccagtcaccccagaggaacccagctttccatgtctgatgcttcagtaggaagcatcagacatgggagtgacccatctcagatacttcgacgaggctgagccctcaggtgactgaagtcccagacaatatcatgaggagcagaagaaccacccagctgagtctaatcaactctcagaattgtgagagatagtacagttgatattgttgtaaaccctaagtctggagattgttattcagcaacagataatatcaacaaggaggaaaaggtatcatcatctgatcctttactatgggtttcgtccttcacatacataatctaatttaatcttcactataataatttgagataggtattaggacaccaatttataggagtttgggtgaagttacgtaagttatcctaggtcaggatttgaaacccagctgtggtttgtaactgcaaagcccattctctcaatattcttgttatgtttttcataaagtatatcacagaattactggtctctaaagagttgaagaactgggatgaataaaaaagaagtgttactaaataaacatttattttaaataatataataaataatgtaaatggaagcaatgcagtacagtgaaaaaagagctttcagttaggagcctggaacttgaattcaacttctgacctaatcattagctgtgtgaaactgaacaagcaatttgactatgaaaaaaaagttttcttttataaaataataaaataacttcttagatttttgtggtggttgtcagaataaaatactggacataaaggacttctgcaaacaaaaataaaagaaagaaaaaaggaaaaatgtcctatagatacataaagaactgctgttgaattaacttgagagttctccacttcatagttaccacggaagtattcagttcccaaatatttgtattttcctgcctccttccaggataaatgttcttataaatactgttttgtttccagagctttgggacacatcactcttttaaaaatgcaaaataaaataaactgaaagataactatttaatacatcacttctttattaatatttttggaagcaaagccatgaaaagcagaaaccctgtggtttctactgaatagctacattttcccaccccattgatccactcacttatgttagtttccttggggggaggggtgtaagtgacagctttagggaatgtgtgtacaaatacagtcctgacacagacaaacagagggctcctagtgcgaatggatacgaaatgaggtctacaatagataatggctgttctgttcagtggaatgagatacaagatgtcccataaagacaaactctgccccttgggtgggcagtggcagctaagagtattaaaatagcccttgccaaccattgcttagaatccttgcagcagcttttatcctgttttggaaaccaaatggtatctctggtagtctcagcaatttatgtaacattctgtcatcggaagtaaaatctaggatcagaatgggtatacaaagcttacattacagaattaaaaacaagtgtttaattaatgaacaaattatgtgcaaactcataagtatgaactgacagggagtaaggaacatgctttcccttaaagatttaaaattttatttttccaaaggccccaagtctgtatatatatcttctattatgtaaataaacatcgtgcttcctatttcaaagtggaaggaatgatggttaattaaacccgaaaaaagcaatctgcttgatgaaataattggaaattttaagtaaaccaaagaaatataatctgatcaatttaattttgagtttttcacttagtttggggttaatggtactaatctaacactaatatgtacaataattgtatgcttatatttatgtgatatattctcacttgtttgacatattatcattgaacaaataggagccttaccccctctattgaactcgataatataaaaatagaaattacattgaggcatctagatgaaacccttcatctgaattaacaaccccattaggaaaaattgtgaccccaaaataaccactgtagagtgattatggctcatttggcatatgtttattccaatcttcctaaattgcttgtaattgttttattataaatgttaataatatataatgtttacatctgtatttttatcaaataacatttaggaaactttagaaaattatcctaagtccacatattaaaaagcaaggtcaatattctcacaagcatacacaatttgtagtttaaaaaaatagataaatgtaaaatatcttcagtgtattataaccacctaattagaaaatgaatgtgcccacatgaaccagtagagacatatcattacctcacattcattggttgtcactctacaattaatggaagaaatgtacagtcaatagtttaaaacaaagtgaaagttcctgtttcaatctagcacactagaggccatttattaacataaatgtgctcaggtaagtgccctttggggctgcagccctcatcctctgtgtcttctctcctagattcatatagtgacagaagaccatttaatcttggctagtcaaacagtgacaatagttagataatgaggctggacacatcataattttccctacttaccctctacagactgtaggacctacgcgcgcacacaatcactactcaaaagaaaagtgcgaattttgcaattataccatgactttatctaatgtagacagccaaaaaagaattcaggaatcaatacgaactttttcagcttgaagtagtcaacatgctcaaggacactgatatgtctatgtagcacaagttaatttaatattaagataccagtggtcagaaacctgtcaagcaagagcataaagaaacacagctgaaggttttcaaggccatgtgaagtgccaacaagcaatataactaggaacaaaatggatccagatactttatgaaattgcaaacaacaaaagagaaaaacattcagaaatattcacactaataactactagtctgaatcatttgtaagctcccaaatgcaggaacagaatcataacaggcgtaagaatggagagaagcaaatacagagaacaaatgagttattaattaagcagctaaatgcatttatattcataaatatataagaaaactaagacacttacgataactactctgataaacaattctagagaaaaagcagcacagcttttcatcatacagtattgctttattcctctgccttttttgtaaatattgagaacatttctcaaaaatagaaaataatcagggaaaaagaaaatcattattccgtgtaatctcacataaatagctgaaaggccagatgcttaactttgtgtacatagacaaaggagaacatgaagattgtgaacaaacctagaggccggttcttggagaccagagagacaaatgaagggacccaacattatgtgctaaaatctttgcatagaaatgaataaactcaaaagagctggcagcaacatctgtgtgacctttatactgtgcccactctcctttcagataaaggtcatgatgaggaaaaccagcagaagtgcacctgggccacgcaaagaaccagattcccaactgtagggtgtagagtctcttttccacattgtagatactccctcagcctacataagcccattccagtgcaggaagcgctaaagactgcacagagtcactaagggcactattacttacacttgacttttggcttgaattagctgggttgcgttttaagtgcattttattgagaaagcatttggactatacagtgcccaccaaaaacagacaaaaaccaaaaacaaaacagtgcatgcttgtaaagacatccctgtctcattgggtttggaatacccttggagcacctcactgtctttgactactgcatagaagtagtttagaaatctgaactacttgtgactaggcccctaatcactccttgctcctcactcaaatccaacctctgcatcattttcagattcatgttcctaaaaccacctacccaacatcacctctgactcaaaattgtcaatggcttccaacagcatttcctaagatagcctctacaaacagcccccacaatatgttcccttaagaataaattcagtggctgggcatggtggctcacacctgaaatcccagcactttgggaggctgagatgggcagattgcttgagcctagcagagtttgagaccaacctgtgcaacatggcaaaaccccgtctctacaaaaagatacaaaaattagccaggcatgatggtgcatgcctatagtcgcagctactagggaggctgaggtgggaggaatacttgagcccagggaggttgaggttgcagtgagccgagattgtgccactgcattttagcctaggcaacagagcaagatcctgtctcaattaaaaaaaaaaaagaagaagaagagaagaagaaaaccaaaagtaacagattcagtgatcaaaactattttaagaaattcttagagagaacttctgtaggagagaaacattttttaaactttctcccagcttttcttactttttcaaccatggggacttcttttgactaacagttctacaatatccaacagaactagccttccagaaagaggggtcttgggaaatgctggcccaaaaggtgaagttcaaattccttagcatgcatgtgatgacccatattaatgggtctctgctaccgctccacctccacctcccaccctctcttccaggtgctcaggtccctgcctgagctcaagccctctgcggggtagagtgctctccctcctcatgtctaagtcccactggggtcagctgatactctccttcccccagctggcctatcccaaccacaccagcctcatccatcactttatcttccaatctcccattccactgatttccttcttctaattcccagctccacattaagtgttttgggggaatcttacaggctttgtgtcctttttcttcacctaaattttaagttccttgaaggcatttgtattttataaataattttataactaacttataactaattacatattataactaattactatgaactcatgaaacctaagatcttgtacgtatgttaaataaatggtatgttttaatgaaaataagatgagtttctccaactatgtcagtgtagcaagaggaagagggagatcatgtcaaaacagaataaaaatctcagagtaatgtaatttagcagagtgactgagggatgtcctcaaagcaacatcaggattccaaagttctacaaaatcatcaccagtgccaaaatgttgaacaagaaaccacagatacaaagtcgtggtgtgcaccaagccctgaaattgactgtccagtgaaaaaagaggatatattccctaatctgatctaaagtagacacaacgattcataggaagagaagaaaaagagggacaggtcttttggggtctgttaagtgccaaatcagataatttgctaatttctaatacagtaaatccccaaatttccttcctttctacgtgtcttctattcaacacatatttattaaacacttactaggtatcaggcactgagaaaaaaaggcagctggaaatgtcttggggaaaattgggataaagtatgaggtacagagacacaaaggtttcttccttctgaaagccctagtaaaatgagaaagcaattttttaaagtatattaatgcaatgaggatgaggcagcctaaaataagtaagtctcatctaaaagctgtcaaaagccataagtgggcagatgcatgtgatgtcaactttatgtgtttctttcatttctttcaagaaccagtgactttctgttgccaaatgttcaatattagaataaagaacaccagtggtaatcactcttttaagtccaactcattgcctgacacatggtaggcacctaataaccatctgttgagtaaactaataaatgaacagatgagtgaaaaaaggcaggaaaggaggccttccacctatgcacagaaatgcagtgtttagttggaacttatttggtgctgtaattcctttacactggaacacagtgaagggtgggttatacagatcaatcaatgccttcttgagttaattcacaactcccttaaaaacattcttattaaagatcaaaattcataggtgaaacaaaatatttagatagccctacatgattcttctcccatgtcacagtaatgcaggcaaatttaggactcctacaataaaagtaccatgccagaattttgaataaatagtccattttatacaatcacaataggaaaaaacagtggagcgagtgacagctgaatttggacgcctgtccctcggacggaggtaaaaagaactgcactacgatattagtattttaacaagtttatgttttaaaaaagtgactaagaggaaaaacaaaagtagaacagtctgggagaaggcaagctgatacaaatttgcatcaggtgaactgtgtgttatatattgaatctgactgtaatgccagtaggttgaattaattcatcttatcttacttacaatgccatgcttaacatttggcacatgtgggcatatgtgtgaaacttgatacaaattaaattagaaaaaaatgttggtagtttacatctcattaatagaaaaaataaaccagaaaaattactgatgataatgtggtctttagactaggaagaaccttacaaggaaggtgaggaggatcttttcccaggaggtatttgcaatgaaaatgagcaaagaactgagaaatggaaaagaataaattctttgctgtgtgattaaaaaagcccaatcttttctctcgcatttctataatgctgtgaacggagtgtaggggatcaagagattgttgaacccaaatacaaccctgtatattgtagttattacagaaatcaccttcaagttttccaaacgattcaaagtaccagcaaaaaccacccaaggtaggcttatctcataggataactctctcctttgcaacccacagtgttttatttaataacaccgctataacacttaagtttaccttattatataataattctaacataacagagaaaatatctatttcacagatatcaatactgctgtctttgaaaaggtccaaagatatagtatgtttctgacacagaccaggtcttaataagtgacagatgtatttattatgatgatgttccttactatgatgctattattatttcttatcatacaaacccctcttccagctgagaataagactgtgttcttcatctttgcatcccttgcagcccaagcacagtgactttttacaagcatttgatgaatttaatgttaactgaaatgtcgaagcttatctttaaactaaactggtttatctcatgaactgacctgtttgtatctcaaggaaagaataggtatcatcttccatcatacttgcggagggccacactccctctaaaagtagctgcagcaatatttaataacccagagacttaggttagctctgaactaaaatgctataatatttagaaatgaaaataatacccaggaatgccaatgtaatgccaatgccaatgtaattgcttcaggttataacttccctattaatgattgttctctgtagggtgcagggaggaggttgagagacgaggttaatgtgaaatagccagtctcatccagtccaaagtgatatgaaaattatattaaaagaccatagctgctaacatctgttggctttcttgtgtgtgggccactgtctcatgccctaatatgtgttagattttattcttaacatcttataaatgcacataatttttttttatttttatagatgatgaaacaggttagagagattcataaactggccccaaatcacatcaataataaataagggaatcaggctttgagttcagacctacatgttcccaagtttgaaggagtaatcccacataacatgtgttcttagcaacattctgagttcccaaatctccggctatttagaggccatagttttacctatagcagcaagtgctatgacttatgttcaagacctttcaacacaacacaaaatgattagcttctctcccgttctctaagcccttcccacctgctacagtacctggaaatctaggtaccgacatgcttcttaaagcactttgtaggctatgttcatgtctgagatgagtaacaagttcacagagcctgttcatttatgccacctactctctgagagaaaggaccatgtgaaaacagtgtttattaggagaaagaggatggaagggcgtaatatccaggaagcaatccccgtcggggcaacagccttcaggagcaatactgcacctctaccctgcagcaagaaagtctcaaccacccacattcttattcatctacagaaacccaacaggacaaaactattaaacgttttaaaggaacaaggtatcagctaagtatgaaatggcacagttccacataaaaagcaggaaggcttgttctccaaaaatgccccttggtaaatatttactgggtgatggcacaaataatagggccgctgattagggggttacaaagaagactgacacccctgagcccggatgatgttagccatcagcacagtgctcttaactttccctgctcaagtctctcatgttttatagaaaaatttgaggagtatgcctaaggttggaatcagcctcacctctctctcaacttcatttgaaaacctgaagctactaaagtcccttgccagaagagggctcacccgccccactatgcccaatctaacttcccaaatagatctacattgtttgcattatgtgcttttcattgacatataatcaacctagagatttaggttagctctaaactaaaatgctgtaatatttaggaatgaaaataataaccaggaatgccaaatacagagtcacaggcttgagtaaacaaactctctaggaaaaaaaaaaaaaaaactctacatgtctaaaacttgccaccaaccttcatggttattaaacaataaaaagctcccttgggcatcttgaaccttcctcataacagaccttgccctaggattacttcttggcttatctgttatctagtcatacccaaagccagcccccagccataataatctccctatggtataccaccctgcttgtaaaacttctttgaacaaaagttttcaaaatgatacacaagatcagcatgatatctgaaatgcaaaccaaaatttatgactatcagctagcattataaaaaccatttctggaggaaagtcatgaatgatattcacaactaccaagtcagaagggctgccctccatgttcaaggagtggagaaaaggaatctacacaaaggccttctgtacatcctccctaaaaattattttaaaaaagagaaactgccatttatccatgtgagatatgactggttttcaaagtaatgggtaaaaatgaccaaaaccttgattgtcttcattatggctcacataaggcacacaaactcttttttttatattctaagtacagaaaattgcttcatttctcaagtaaatatatgctagaaacttgcggatatctcaagaatgctttgtagctaaagaaagtaacatcattgcctactcattttgcttaatttgctagtctcccagcaactttgtgctaacactttcatcccattttagatcctaggataaggcaatagtccagagccctggaaagcctccacctccagcagttcaccaggccactgaagccccaggatggagtttctctccaagacacccttctggtaatatacatgttacgtgcatttcacttatcttctccaagttacattccagtaactaagcttcagaagcttcttatgaattgtttattctgtgttttaaagctccatcagctgttaggatgatttgcaatatttttctttttggttaagcaggattggtgagcattactgggccttttggtggaatccttgctatttaaaattcctgctgctgggattaatggagataatgtctttgaaagccttttgtaaactgtaaagtcctagtcaaatgtagtgtgctgttatcacattaaccatcatagcaataaccataaaccagctgtaatgggggctttaaaatgctgaaacccatttgggtcttgtctttgctccattcccacccccgggggcctacaatggtgcccaacatatgggagcctctgaaggaagttttgtttggaggaacaaatcagtgactcagaaacatcacatggttttccaaagtaatgtccataggcaaaaagaagctaagtacgacaatttaaataatgaaaatactctgccaaaaatattggggtcctggaaagaaatgctacagaacaaagttcttctaaagagaattgatttgataatgaaatctggtcctttacagtcagactgggaaggagaaggagtagagacaggtgcagaaatttattagtccagaaaatgttagtccaggatggctcagagaaggaggctgccatcccagaaaagggaagggaggctgcagtttgagagggagtatcaaacagaaaacaaaaaacaaacaaaacccccacaaaataggcaaaagctactcctgcaaagaacattataaatgcaggctttttatctagactgtgtctttaaagtggtggaaatgaccaattctgtgtcttaggagggaggtggcatgaagccgggaaatgactgaggaagggatactgatatgaaatgatttatttctggaaaatgctcttgtaagcgtttgcaggaatagttctggttactagaggggtagtctattttaggtacctatgtataaggaggagtgaacgagtgaacaagttagtggggatgaaaataaaaagggaagtggtagcgtccagcaacacgggcctcattcataaaactcagaagcctcaaggataagaagagaaattccggggtggctgcctgttactcagcaagaaagcgaacactggcttgctggctcagcacttaacctgagatgaggatgtcctaacagccctttttctctaaggggtagtgtagggtggggtggggccaaaaggagaggaggaggaaggcctgccacccgggaggtccctaggactcagcagcagagagggccttgcaccagcgctccgctctgttccagaaaatatcctatttctgaccatcaatcagcattaagccagtttgggggctgagctttaggcacaggcagttgccagtagcaacagggcacacgctcctggtgagctgggcgggaggtggcaacaagggaggggccgcctgggcaagtggcctgcagctgggcagacaaggtcagggatctcccctacacgcgcaagggaggcagtgcggagggtgggggaggggggatcgtggcattaggtggggacaggcgcgccctgctggggccgggccagggagtggcccaggcctctgacctcgctggggagcagggagggagttttcccagtggcacagctatgcccctgccaaacccaatggcctcccggcccgggaaaggcgccactccagtggcccctagacactggagtcaaggccaagcgacaggagaggcgctggccctctgcttgggaggaccacagaactcaagatctgcccctcccctgcagcccctttacgcccccaccctttaggagtctctggaagatgccaacgtggaagtgtttctgcacgtgtgtgtgttttcatttgtgcttcccacacaaaagcgaggccccacaggtggagaggagggcgtgtgtgcgcgcctgtagagcggggctcgggctgcgtgggagctgggcggggatgcgcacacacggaccgactcccacagactgtcccccttcaggtgtcctggtgcaggctttcagggaagggagagcccctaacctcgccccacctcccaaaacttctccccctgccgtcgggctatggtaaaggggaaaggacaggactcaggaccttgagggaggcattgagtcagagggcagagaggggtcaaggagacccaggcgggaggcgcggaagcatacagtctgcggggacaaggactgaacggggtagtgggagccaggtgccgaagggctggggctagggtggcggcgcgcagggggcgcgcctgggcggggagtgggctggcgtctccttacctggccttcggtggagcatgctgctgcgggctgggggcggggtgggcgctgcgtccccaggggttgactccgcagcgccttcacttcgggggcagcaaggcgcgcgctgcagagccgggagttgccaaacttgccatgtccagagcgcggaggcagcctgggccacgcgctcaccgcagcccgggcacctcgcgctcctccgctttgttgtgttccgccgccagtccccctgcgcctgcctgccagtgtccccgagccctctcctgccgcgggacgtttcactggcgctcagggaggcccctcgggtgggcagtgccactttcctcctggaggcgcgcgttaaagatctgcctgggagcgcccggcgggcggctcggcttgcgctctgatgaggaggctggggcccatcgattcccaccccctacccactccccctcccctcccctccgccgggcccccccatcagaagctgcttaggatcggcgctgtcaaatccagcccatctgctgcaatcataatcagtctcaaccgaacggttctgacaaatctccgcctggagctggagttggagaagctggagagtgaggggcggggaagggaggtgggggtgaggggacgatggggaccgggcgccctgagagggggcctggagccttctattgtctgcccctaacggaggaactgaaaagggaagcagggatccagaaggggaaatagtgctttcatttcctagtaagaaaaaaaaaatctattcccgcaggtccctggttcccttcacgcccccacccccagcctcagctctgtctgggtggaacgaatgtctgctaatgaactaaacaaacaggtctcttaatcttatcatggagctgacccagagactggcacagatatccaaagtatcataattggcaggtaagagctggaactaacagccatttgtctggagtcagaagttggttcccaagtgcagttgggaataaagctcttgggggggagaacggccgtgtagtgtagtgtaattggccaggaagcttggcccttggcctcctgttggcatttccagagataaaaggaaatctgctttgggcaagaaaacgctgaattccccttagcctcattttgaatttaaaagattcgcatatttttttttctttttctcatgaaaatactatttttcaagaaatgctattttattagaaaataatgacttcaaaaattgaaaattttccaagcagaaattgctccacctgtagatgaaatgagatgctcctttcaataatatactttgaactattccaaaaattccactttaatacaatcacatatatttgtactggtgatagattcacaaggattatctcaaaaaaatgttttcaagtataatataaatggcagtagtcctagagacatacaaacaagtcttaaagcatggaagaacacaaccaatgggattatgtctagttttatacattcttctcaagtgctgggaaatgtccaattaccttgaatgacagtatttgtttgggaaataatttgttggataaacaaatcaccagtggaaaagttgaagaaaattttaagccctttattcagataggtataagagctaagcaaaaataaatataatttactgtgaaaactgaataaaattctaaattagggctcaaatcattcttttgctttatgctatacttgagaaatgtgtgcaagccacattaagcactcacttatctaggcagagactgtgttttccacttattttatagcccagtggtgcttacaacagcactaggcaactatggacactctatgaatactgatggtttgaaattttgatttacaggtcagaattaaaactacatacatcatggtgactttatagctgaggcaaagtggagctcaagtgttactttcccagtaagcaaatcatgtaagtcaaggacaactactggttagattttacagcctttttttttttttttttttttgagacggagtctcgctctgtcacccaggctgcagtgcactggcgcgatctcagctcactgcaagctccgcctcccgggttcacgccattctcctgcctcagcctcctgagtagctgggactacaggcgcccgccaccgcgcccggctaattttttgtatttttagtagagacggggtttcaccgtggtctcgatctcctgacctcgtgatccgcccgccgcggcctccaaaagtgctgggattacaggcgtgagccaccgcacccggccgattttacagaatttttatgaatatttaagtttagagtttttcattgataatttgtttaatgtgtttattactattcaataaaaattttgctaaaattaacatggtgccaagaaatgagtatttcaaaaagggtcctctcttacagaatgaagtatcatgctggtgactaatttaactaacattgtccaggaaattgctgttgtccaggaagagaagagttgagccgagtgtcaactactaggcttctggcaccatcctgcacaagaaattggtaagttctactgtgttatttcctagcttggtggtctcagttgcatcacagctaacttatagcctaaattgacaggcccacctccaatttattaattccttggtcttaacttcaaaatatatcatctcatgtttactcaattatttattgaacaatcactatgtgtcagtgttggaatatatgaaggaaaaatcaaacaaaaattttttaccttgtggagcttacattctggaggagaagacaagttagaaaagagtacataagtaaattataatgtctattagaaggtaatcagtgcaatagagaaaaataaagcagagtgggctgggtggtgcacaagtttaaatacaagagttctcagtaaaaatctcactgagaatgctaagcctgaatgaatgattaaaggaggtgagggagcaggcaagccatgcaaatatctgggaagatggtcccaggaagtgggaaaagcaggtgtaagtggcccttaaatatgattgcacctggcaaggtctaggaacattaatgaaaccttgagaacaggacacagtgaagggagaggtcaatgagggtaggcttagaagacagatcactgggtggggccaattaaaggacttggaattttactccaaatgacagcggaggacacaagacacagagggagtgacatgatcatctgacttttgtttaatagatcactctggctcccatgttgagaattaattataggagcagagaagggagcagggagatctgttattaggctattgcaagaatctaggtaagagatgatggcttggactgggtgatagcaagaaagataatgagaattggtggtgattttgaattgctttgaatgtagagccaacaatgagtggctcgaaagaaaagagggagtaaagagtaactccaagcatttggccctagcaaccggaaggatgaagttgctattaattgaaatgagaaagactatgggtggagcaaattttggtggaagaatcagcttatatgggttaagactggaatgcctattaagttaaattttaaaaataacttacgtaaagctcttagaatagttcctgacttttcgtaagtgccatacaaatgtttatggtggtgattattattgttattaatgtttgccaaccaaaatgagatgttgaatagacaattgtaccatgattgtggtggtagttgcaaaactatattttgttataatccaattgtacactcaaaaattggtgaattttattgtacgtaaactaaaccttaaaaaaattattaaaaaacaaagaacttactctcatgttttaaaagggagaatatggaactttcccatctgagaagaagcagcttcggaagtatcaccattttgtatacccattgaaataactgatgtaaataaagatcaccaatagatgctaaagccattaagtaaaggtttgatggaaaatagtgaggtaggtgaatagggtctggaggcagagaacctaaggccgattcacgctgacttcctaaagctaaatcaaaaggaaaaccccaactttccacacttaagcaacaaaagtactggaggctgctccctttacaaaccaccctctcctttctgcgtggcagatggaaaattgaaagtatctttgattggttgctttccacaaccaatcagatgcttgcatagggtgtaacctttgtaacttcacttcagcctgattggttgcttccctccgactgattgccggccactccttcatttacatagggtgtacaccaagtaaccaatgggaaaactctaattctgtactggggctcttggatcctattcttggacccgctcccaccctgcggagtgtacttttgttttttgttgcttcaaattttttttttttttttttcttttttgagagggagtctcactctgtcgcccaggctggagtgcagtggcatgatctcagctgagtgcaagctctgcctcccgggttcacgtcattctcctgcctcagcctcccgagtagctgggactacagtggcccgccaccaggcccggctaattttttttttttttttttcctatttttagtagagacagggtttcatcgtgttagccaggatggtcttgatctcctgacctcatgatccaccagcctcggcctcccaaaatgctaggattacaggtgtgagccactgcacccggccttgttgcttcattctttccttgctttgtgtgttttatcaagttatttgcttaagaagccaagaacctggacaccctccaacagtaacaatagaatattccaactacaaatactgcctcctgactttttgttaactgcgaaggggaaaagctgtattagacaagggagaaatcacctgacatgtttctccttatgtgatgctgtatgaaaagttttttgcaatatatttttgcaaaaaaacatgtttaatctgagtctgagcaaggcctttgctataattcccaccttacaggaaataaagatgatagaggaacagataaatgacatcacaaggaaaccattaggcatagcggaatatggaacttgctagaggtcttcaaaaagtcagtgttcatagagaattaaaaaagtagaggcactatcatagattgaaagagacgtgacaaatgcaactaatgggactgggcatcagtgcaaaataagcagctataaaagacatttgggacacgattagagaaattcaaataagactggtattagctgatataatagaattttcattaatttttctgggggtaaaagtgatactgtggttataaagaaagtagtccttatttttaaaagacacatactaaaatatctggggttgaagtatcatggtatctaacacacattttggaaaaaatatctgtgaagtaaaaatattaacatttgttgatgctaagttgtgtgcagataaatattttattattctggtcttttaatttttctatatatttgaaatttttcttaataaaaattgagcaaaatatacttataaaaatccatgctcaaaaagtaattataggaaaattagaaaaatttagaacttgatgtctcaaaaatatccaaattataagatggaaagaaaggagtatgtagaaggagattaataattttagtggacatgtagaaatgaagaaaaatggaaataaatgttcaaagtacccaaacaaaacagaacaaaaaaaaatagaataaaagaaatgaaatcaaagtctaataaaagagaacacaaatcaatacaggatcaataaaacaaagtctggttatatgaatgaaaaacagtggagacataaatcaataagcttagggataataaagactatataactaaggataaaatagattttaaaaataggactactttactatgagcaattttatctgttttcaaacttattgacataaagtgatcaatgtcctaaaataaacttttaataaaattcaataatccacggaatcttgaacaatcaaatagattgaatcagtagttgaaaaaaaatttgctgctgcataaacataggtccaaaattttaaacttattccttgagataaaatttacccaagttgaatttgtttttagcatatgcaccgttatgcaaccatcaccatccccttagaacaatttatttacccccaaaaagtacctattaacattcactcctcattctccagccagaggcaaccaacaatctgctttctatccctgtagaattgcctcttctagacacttagtataaatggaatcatacaatgtttagccctttctctggcttctttcccttagcataatgttttcaagttttgtccatgttgtagcacgtattggtgcttcattccttatttccaaataatattccactgtcttcatgcaccacattttatttatccattcatcagttaatgggcatttgggttgtttctgttctttagctattataaataatgcttttgtaaacattcatgtacaagtttttgtgtgggcatatgtattcatttcttctaggtatatacctaagctgtggaattgctgagtcctatagtaagtgtttaacattttgaggaactgccaagctagtttccaaagcagctgcaccattttacattcccaccagcaatgtctcagcgttctaatgtctccacagcctctccaacacttttatcctttgtttatagtcatgctagaggatataaagtgatgtctcatgaattttattcgcattttcctgatggctaatgacgttcagtatcttttcatgtgcttattggtcatttgtatgtgtcttctttggagaaatttcttttcaactcctttgtccattttcacattgggttatttgtcttttgattgttgagtcaggggctcattacccaatcttcacaaaacttgaaaaaatacagaaactctaataacccatatctcacagagagttacagggaattttttagaagggggaggaggagaaaaaaggaagaataggaggaggaaaggggaaaactaggggaagggaagaggaagaaatatttttatcaggttagaaggactctgataccaaaagtaaatataggctgtatgggaaaggaaaattaaggaggctctcaaaaattcttaagaaaacttaatccatcagtgtggaaaattataacagtagtaataataatggttataattaaatggtgttactaaataagatttatcctgcaatgtaaagatgatttggccctagaaaaatctattaatttccaaaaaaaaatttgggggaagataaaaaaaattaaaaagataatcatttcagtagatgctggaaaattttaataacattcaacacttattcagggtttaaaaaaaaataaattaaaaaacatttcacctccccaggaataaaagggaatgcccttaacctgataaagtttgtctaccaaaaaaaaaaaaaaaaatctataacacgccttatattaaatagttaagttaaagaacatttcctttaaatttttcctctagacaaggatccttccatcaccacttcattttctctaaggtcttagagcagttattatttatcaccaatattatcagcatctccacagaaaatggaagagaacccagaggcaaatcagatatagtaagagagcagtttgtttactagataaaagaacaatataccaaaatggatagtgttcttaagatatgtaccaaattattagaagtgtatactttttaggagatcccacttaaaaatagtaagaacaaaaaaaaatttagaagatacgaataaacttaaagatgtgaaacacctttatagagaacactttgttgaagggcttaaaagaatggagtaaatagtaaaacatataaaagtgatggattggaagactcaatcttctggcttaatctttaaatgtgaaacattatcaaccaaaatctcagcagatttatacactcaacttaccagcgagtcctaaatttatttcaaaaaaggaaaaggcccaaattagccaaatatatttagtaaatgtgaaacctctaacattccaaaaagggtcaggtaccttactataaaacaatgtaattcaacaggtaagagatgtgggttaattggaatagaaagagaccctagaaacagactcacatttatggactcagggtatatgaaagaaatggcattattaattattggggaaggattactgtcaaaaaatggcaccaggttaactttctatgtgataatggaaaaaaaaaaattagaatcctacctcaggccatttgcaaaacctaaactcagattaaaaactaaacataaaaagcaaatttataagactttttgaagaatgctttggaggatactttcatatcaggcggggaagtataatgaagcactttactgtattaaaattttaaaactttgtaaaaaaaaaaccataaacaaaatgaaaagtcaaggcatagactagaagaaccatgaaaaatatgtattataaacagaatacatatcctaaatttgtaaagaaccacaaatcagtgggaaaaagtgaaaaaaaaagtggggggaagcatagaaataggcagttcatagaagatagttaagtggcaataactatattaaaactgcttaatatcagtactggggaaatgcaaattaaaacaacaatgaggtagcatttcatgcctatcataattccaaaatataattcttattacactatgtgttggtgaggatgtgtagaaagacctcttccacattgcaggtgggaataatttggatatatttattaagttgaaggtgttcgtactctgtgacataggaaccccatatctatgtactcacggaaaaggctcacacatacacacatacacacaaccacacatggaactcgcacgaaatccattatattaaatctcaaacttcagtatgttctggaaagtataaccattataaataccacctgttgataacaatgcaataaaacaaattatttaaaaataaaaatagaaaactaacatttaagcaactcttcaatgaaagagattacaaaccaaaatttctaaatttctgaaaaatgacagtgaaaactaccggatgcatttacagcagtggttacagaaaaattggcagtcctatgcacgtgtatcaatgaaaattaaaaaatataaataaaatttcagctcaaaggcacaaaaggaaaaataaccaaaagaaaggaattaagggtaacagtaaaatgtagtaacaaattaacaaatcagaatctagttgcctttcttttttaaatagatcactacataacttaatcatgaaaaaaatgagggaggtgaataaatcaccaataaacagttgacccttaaacaacacagtatgagctgtgcagatctacttatacacagatttttttttcaataaaagttatacagagtatgcctgtctcccgttctacctcctccacccattccacttctatcacccctgagagagcaagaccaactcttcctctttttgctcctcctcctcagcccatttactgtgaagacgaagaggatgaaggtctttatgatgatccacgtccatttcatgaataggaaacattttctcttccttatgattttcttaatagtacttccttttctctagcttactttcttgtaagactgcagtatataacacacataacatacaaaatatgtgttaatagaatctttatgttatcagtaaggcttccagtcaacaataccatattaatagttaagtttttgtgggagtcaaatgttattcagggaattttgactcttcaggggtcagcacccctaactcctatgttgttcaagggccaattatacaagataggaaatgacaaatgggaactaactacagaaacaaaaattaagaggcaactttatagacgtcatatacatggaaaaaacttgaaaacatggacaaaattgaaactttctttggaaaatacatttaccaaaattggctctgttagagatagaaagattaatcaactcttctagaaaaaaaaaaataccaccccacaaaaacatctctaggcccaaaacaaactcccaaaggcagaccactccaatgctccacatttacttcaggacatggaaaatgaagaaaaactttctaattatttttataaagcaaatatagcattgataatttaacctgcaaaagtcagttttaaaaaaatgaaatgacagggtgatgtcactatatatatcactgcaaaaatagtgaataaatatgaccaaaacaatgtaacactacattaaaaaaatatcacggccaagtgacatttaatccaggaatgcaagtttggctcaatattaattgatcctttagtatatgacaccctgttaataaatctaaaggaaaaaaattacaagattctctacacaagtgtttaaataatctttgagaaaactgaaaatttaacactcttcctgatgaaaataggaattgatgtatattttcttaacatcataaaacatatcatgcacacatatgcttagtcctaacatcagtatctcacttaagggggaactacttgagacactccatttgatcaggaacaaggccaggatgtccgctgcctccacttctattaaacattttattggattcaatgcaattatgcaagataaatcaaatggaggcataataattggaaaagagcaagtaaaaactgtatttgtagatgacatggtagtactcctggaaaatgaagaaaattatgataaaaaattaacttgataaaatttagattcagtaaaaattaatatatagaagtcagttgctttcacagacattgatagtaaactggtggaggatatactgatagagaaaacctcatttacattagcaacagagatgaataaatatgtagggaaaattagaagtcgaaatgtataaaacctatctggggaaacgttaaaactcctgtaaatcacaaaaatagatgtgaagtaatagagacattggctgttctataacagaatgactcaagattataaagctgtccgttctaagttactttataaaattaacacgataccaataaaaataacaaggttctttgggagctagactagttaatacttaagtttatgtgaagaaacttccaagaaaaggcaggaaaacactaagaaagaaaatccaggaagagaaaataaagtatacagtaaatttactataaagtttctaaaatgaaaacagtgtggtgcaggtgcgtgtctagacaaccagggagaaacaggtttgaaaatccagaaatagatccaattatctatggacattcaacatacaataaaggtggcatttcaaatcacaaagaagggactttttaaacaaacagtgctgggacaattcgttggccatttgaccaaacataacattaaatgtatacctcccaaaccatacacaagaataaataaatagatccaggatctaaatgtaaataatgaaaccacgccatcacaaggaataaaaaaccacaggtgaattcctttatcagctggatgaaaggaatggttacctgacaatgactcaaactccagatgccatacaggattagtaaatttgactatgtaaaatttttaaaatagtatggtatatcagctttctatggctgctgtaacaaattatcgcaaatgtagtgacctaaaacaatacaaagttatcatcctacagttctgtagattagaagccccacaggcctcactgatgtaaactgaagatgtcaagaggactgcatttttttctagaggctctaagaaagaactcatttctttgcctttcccagcatctagaggctgcctacattccttggtccatggccccttcctccatcttcaaaagccaggaactttatgtctcttacccttttctgtagtcacgtctccctctgcccacaaccaggaatggctgttagttttcaaggacctgtgattacactggacccacctgattaatccaggataatgtcttcaactcagagctcttaccatctgcaagtcctttttgccatgtaaagtaacatttttaaaaattctaagcattctgatatgtatttttttgtgggtaattatttttcctaccacacatagcaagaaaaaactcaaaaacaaaccaaaaaatatttttaaaataaattgaaagacgtctgacaaaatgggagaaaacatttgtagtgatcacaaataagaggctaatatccatccctaaactacaaaaaaaaaaaaaaaaaccctcttaaaataagggggaaaggccaaaaacttaatagaaaagttggctatagtcatgggcaaacaattcacaaaacgacacgcaagtggcctttaaacataggaagaggtagtcaagctcactcttaactagagaaataaagttttaaactacgctgagatactatctctcattcatcagattgggagacatttagatgttgatcctttattctattggtgcgactgtgggtaatcatgcagtcttatacattgctggtagaaatataaattagttcaaccattttggaggaaaatttgacaataagcaaaactctattttcatttaccatttgagtacacattctcactttttggagttaaccctgaaagtgtacttccaataatacaaaagtgcataggcactttgtttattgccgcactatcactgcccactgttgcttaaaatgtcacttaactcatccttggtcactatatatccatttgtatccctattttatggcttatccgtcaggtttggattgtatactacaattcagatttgcagtccttcattgggcttctacaccactctctgcatagaactgagtaaatgtttgctgatttgaacatttttagggctaaacaatcattttgttttcaaaaattttattttggaaaaaagttctcctacataactaatatcacatagctttattaattttgaatttaacccagattgttgtccaatatacttttttttcacagttgttactaagtttctgttttatcacagccagtcttaagtaaggaaattagatttatttaataattaaacctctatgacaatggcccagggccaactgaattcagcacagcaacttagaataagattctactggactttctatacttttcagccacaactgagcacaccgttgttctatgatagcattattgtcattaatgaaatgtataaatggaatgcaactaaatagtgcctggttaaatagttcctggggcttggtaacaaaacaaataaatacacaaccatactctgaagatgaatgttcttgtcttaatttagttattcacacaaccatcattcattaggaaattaatacaatcaggttcatgtgtcaggttcttagaatgagaagtgtatgatccttaagccaaaaaaggttcattacttcaatttttaataatacatcttctagatattttattatctgtatccagatcctctttagactgtctcctgaaattactatgcatatatatacacatacacatatatagtacctgtatttattgttatatgcctatatgctacttttactggaatacttccctttatatttgaggacctctatttaagcaaagtaataacctaagtacaaacagggaaaaaattctccctcatgtacacacatgcatatttttaaagtttgtccaaatccatcacaattgaggcttagattagcatccacatgtctgaaatggctgcataagggggaagggtggtatatatttaaagaaaacttgcatttaagaaattcattattgaccccttaaccctagcatagggatagtttcttttgttttctgttcgtttgtttatttatttatttatttattttttgagacagggtctgactctcttgcccaggctggagtgcagtggtacgatctcggctcaccgcaacctccacctcccaggctcgagccatcctcccacctcagcctcctgagtagggaggtcccggggcttagcagagtggctccaggggatggcttagaaggacatgggcacaggaaatcaaatttgtgatgacttagatccttcttatttacttatttaggagttagtacatcaaggttgcaaaacatcccaagaaaacaatttttaaaattcattctagatcaggaattggcacccacaggccaaaccttgccagttctatgtaaatagcgctttattggaatagttatacctgttcacttacgtatcctttgtgggtgttcttgagctaagattacaaaattgagcaatttgtgacagtgacgatatgggtaccactcagaaaaccaaaaatatttactatgtggtccttaacagaaaaagtgtgctgaccctgctacagaaaatattgccctcttacaagatgtcataaacaggaatgcatactttcaaaaaactattaatgattataattttgagttatactgacacaactagagcaattaaatccatgttataaattctaaggagtcttcaagtttctgatataacttgttctacagcacatacattgctgctgaatatcagtgacattccgtttttaacagtaagaatagaagtgattttagctaattaacttttgaaattaactttttatagccagcaataactacagcaagattatttctagataattaaaatacagtgctcctaatgaatggatatctactataactttgtttataaagacaagtatagttgcttatatcatttcaaattgtgctttgtgtattcaaaattatatttttttcaaaatgtaaacttgggttttttcaatctatttatttttatgaactaggactacaacagttgccaaatttctaaaatatcttataaaatcttaaaattacaaagtcactatttggtaattaaaccgttaaaaatatcaagaagcctgggcctcagaatttcttatgaaaggaatagagttttgagaggtattctggagagatattggaaattaacataaaggaaataatgaaagctgaaattgatacctacggaattgaaaaatgttagcaccatcacaagttcttaaaagttaagaactatattctaggaacttaaagaatgtgttctgcctttctactatttttggcctgtgtaggcaggatattttggaaggataggctgggttgtaccatggtgacaagcaacccctagatctcagtggcttgaaacaaatgcctatttcttcttcatgctagcttttggtggggactctgctcatggtaatcattttatgaccccagctttagagaaaccaccatcttgagagctgctggttgccatgcaagaagaaagagcatgttgggcagttgcagacccacagttaaatgcttcaatttggagtgtcacttttgctaacaattcattggccagaacgtgtcccatgaccccatccatcctcagaggagcaggagttgcaattctatcacgtgcctataaggaagagggctggatatatttagtgacaactcattaaatgtttagggtaatgattaacgacccagccctccagccaaactagttaattaatgtttgtgcttcatttccctcatctgcaaaatgggaagactaaacctcataaaactgtgatgattaaatgacttaatacttgtgaagtgtttagaacaatactgtcatataatgataaagtattattatttctttttaacttttgtacctgccaccctggtcttcagtgccaaaagcagagatgagggcaaaaacaaaagtgggcagtcttaggaatgctgacctggacccagtagggatgcctacaacagatattcttgagaaaagacccatgaccaaatgaaagagatcaaagatgctaggatttccttataagtaacattgatccagaaggtatgaaacaagccattagcagagcaatgatttatttttaacgggaattggaagataagggggataaaaacacctaaactgaaaacaggacttttgtaatatgaaggccagaggatgaacttagggtgtggtcatataatgtataacatggatgcaatcagtggaagatgctgaatagggctatcatatagcatgcatatttgggtaatacggtatatgaatgaatctcttctaatctgtggtttagaaggcttacaccaggctaaacaggagttcaagtaaatgactcccactagaaagagctacggctacaaagaagagaaatgggagcaaagtgaaagtcaacccaacaattatgtagaaacatagcaagtggtagactaatgacatggttcattcctaccagaattcctgtttcctcagtactggcagcaatgagattgctctgaatccatgatcatccatatgtattaaaacaatccttgactgttggacaccaaggagatgccaagataaacagacatgatttctctcttccaggggcttattgtttaacaagaaagacatagggtattaacctaccttaacataaatcagaatgaagtaagttttatactactcacataagcagaacattatgggagtagagaaggagcagaggttcatttttaatatggaatttgggaatgcattttggtggagatggcattttaaatgagattttaaagaagaggaagggatgaaaatggatacaatgaataagataacataatatcatgagaagccaggaaaatgggtaagattgaccatttgaaggaggtagaggagaaatagtttttttttaaaaggaagcttttgttcctttgttccttttgtcctttgttcacccccagtaattcagcagcacacactagactgtctcattctataattgtatgtatttctatcattctatagattctatagatataattctaaaatcattctataattttatgtttatgactcccttttatttacctaaaacattaactataatttttaaatggctatttgatgttaattttatttctgtaatctttaaatgtaagcgctacagttcacatttttctagatggtcacaaaacaaattcaaaagataataaagctgaaaaggattttttttttttttttgagacagagtctcgctctgttgccaaggctggagtgcaatggcaggatctcggctcactgcaacctccacctcccaggttcaagcgattctcctgcctcagcctcccgagtagctggaattacaggcacctgccaccatgcccagctaatttttgtatttttagtagagatagggtttcaccatgttggccaggctggtctcaaactcctgacctcaggtgatccgcccgcctcggcctcccaaagtgctacgattacaggcgtgagccaccgtgcccggccttgaaaaggaattttaagttaaatttttgctttatagataaagaatccagtgatcaaatgatttcctcataattgtagagtggcagactcaagaacttgtagaactcatatcctaatactgaatgtatttgttactttaaaagataaaataatcaagaaaacaacaaaaatgagtccagggttactcttgtggttgctctgtgagtatcatttgtcagaagcaaggtgaatgatgcctataagattgtgcatatatatatatatgattgtatataatataaatagaataaacatagaattaattactaacccctaaaatgtctaattgaggagtcaccaattcaagcttgtctgtgtttaggacaaataaaaggaagccctaccccatagagtagggattaagttgatggaactctttacccaacaggaggtagaagaagttggaaataaaaacagattttaaatggcttatataaattaatgactggcccatcacacagttaataagaaaaaaatagtatgtgtgggtcatgttatgcatgtttgaagttgacatcaaagaagtccttgctttgccaactctgccaaagacagatggcacgtggccatgatgcaccgtggcaattcttgcttctgtttgtgaaactctccaaaggctgtgttttggaagtcatgagaaattgctaggttcctgggttgtgaatagaagatggacattcaaggaaccaatctctatctgtatattaaccaagacaactatatctaacattttattcccaaacaggagcataagggacatttccacattctaactttacatgaagactcaggactttgaaagcccatgagaaagttttcataaggatttatccacaatttcttctttgatttgctcagatgtgaagcaggaaaccttccagacatcctgaacctctgaactttttgtggattgcccatcaacacaggcaaacattcatgaagcaattcaaaaatctcttctcactgcattataagcatgtccttacgttattcatatatcaagagcatgcccattcccaacccacaatggaatgtgagcctaattacatgttcctttggaataagatctcaccagcccaggagtgtcagaaaccctctatcatatatacgtatcttgtttccaaaatgatcttcccaagccaccctaacaggcccccttcagaatgcttcctgctgacaagtgaatctgctttttgcctttcacccaatctcagctcatgctttctctgtgaaaatatcacagaccacatctgacagtggtccagctaattaatgtactccaatgtctagcaagcatttgacaggaaaaataatctatacagtatttattgcaaaatcttcaccaatgtgacaaagatgaatgtaaactttacataatcatttttcatttgttatccaaagttgaaagtgattttcaaatgctaactttaaaattatgatgaggaagataacagctctgctttaaaactgcttggcaatggaatttctatagtataatggtttagcaatgagctagaaaaataaactctcttgctaatgtagtaaatgggccagaaataaacttctcagggatttgggtggtggggtggggtgagggaggggcacacagaggggatagtggaattggatttctggaataaatgatctgaaacccttagcacactatatcttcaaaaagcaatgtcttcctttatataatgcacgtatcaccatcacgatacgagagcaactcgaagaatcttaacgtataccacggtaaacacctacggcacccaactcagtctacagcaggacacccaaaagttaaattcactttggctgtggctgtgctccaggtacatattttctcatgagctttgtttctttgttctagaaccatccttcccaatattccttaacattgaaattatacatgttaaattaattattgttcatttaactgatgagctgaaactcacgtccttccttttgaaagctaaagtaatcttctaataaaaggtcaggaattatcaaatttacttgtaattattactaattcttctgtgacttcttttttttttttttgaggtggagtcttgctctgtcgcccaggctggagtgcagtggcacgatctcggctcattgcaagctccaccttctgggttcacaccattctcctgcctcagtctcctcagcagctgggattacaggcgcccactaccatgccaggctaattttttttgtattttttagtagagacggggtttcactgttaaccaggatggtctcgatctcctaacctcgtgatccgcctgcctcggcctcccaaagtgctgggattacaggcgtgagacaccacgcccggcctcttctgtgacttcttaaccacaaataaagtcttggccttggaaaaaggaagatctgaaacagaacaaggcaattaaaaagtgggtggaggaagtataggagtagtggagaaaaaagaaaggaatggattttctaaatttaaaacactctttgccctttcctgaaataatgacttatattctttgagttcacaagagagtaattggatatgcatgatgcaatgctggaattttaggtattttgcctaaaggttattaacaattagtaccactaggggaaaaatcataaagttagttagaataacaaccctctctcaaaggataatgaaaactggacttgtaatctggtcataataaaaatatattatgtttatattggagcctcacatgtcaagaggaaaactcacaaactagaatatgtccaacaggtggccatgactaaatgaagactgaaaaacaagttgtatgaggaccaatgaaggaatcttcctttgaagcagtaaagactgcgaaaaaaaacatgaaaaactgtctttagataaatcctttaacaggaatggtacacagaacagggagatgttataagtggagctactgatgacagcattagagccaaagggtgaaaggcagatgttgagtcattcaatagaagaggtgtctgatctcttcctatccaatgtagcagaatccatcccatactatatctgaaagatgaccactttgctttgacatttgcagtggtacagaactcactatctcaagaataccttcctcgggatggtaataagtatgagaaatgccctttctagttctaaatttcttctccacaagacaactcattccattttcaaacaattattagatctatccatctcttagtcttctatttgtcaagcaaacatctccaattcctcacatcattattaattcagtattgtgaaccttgtaccattttagtcaccagctttgtggataatctttggattgtagtgtctgtaactgacatccaaattaagtgctcttgatatggtctaactagcaactgaccccatccatatttctatttccaaagcagagaaacaagaaaatcaattggccaatataactgaataaatccaggtaaatacatatttggctttcaattagtcaggaagtctgaatttctagaggatattgaagatacagcatcagacaatgcatttgtctgattgctgacaacttttaatttccctgttcaagaaaatcgatcaatgtgtgttagctaaacacctgttatgttcaaccctgtgttagtcatcatttgatgtgtaacagaagtgtaaggccaggtacctacaatatttgtagagtcaatactaaggtacatgaaataattttagagtttttacaagatatacatcattatgtatacttatatgaaatagtctcaagttcagcagggaagactgggcccaggtgggctgaggaatgcatgtgaagaggtagggaggcaggaaacttgaaggatggttagggcttgtctatttggaatggagagagaggccacaaaggagtgcgtgtgtagaaataatgagtaataaaggaggtcaaggttagtagggacgtgtgtggttacaaatagaaatatttggatttgtaccataacatttctattacaacttcctttctcccattccaaacatgcttggttttacagaaaaaacttccaggactcagatttccatgggtattagtttgcaaactaatccctgatgagatattatgaggagctaagagagtgatgctagaattctcaagtggcaatggcaaatttcagggctgacttcctggataaccaattctttttttttattctgagcatgggaatttcagttcatccagcagaagaaatgttttttgatagatgtgacttttggtacattttgaattatgtcatcttggggacaaatggtcccaaaagccaaggtcctaaatgtgtacatctgatccaactctaagaacttttgctcagttgtgacgtcaaagaatttctattttagagtggtcttctgcaactgataccatccatatttctgtctccaaagcagagaaacaagaaaatcaatttgccaatataactgaataaatccaggtaaatacatatttggctttcaattagccagggagtctgaatttctagagaatattgaagagacagcgtcagacaatgcaatttcctttaatagggaccataacctcagagttgctgctctgttttttaatattgtacaattaactttttttttttttgcagcacactctgcttatagcttctgtggaaacttaaacattattcaatagaataatttcctggaaaatcttttgaaagtggtcacagccctgaccttgctctggtgccctgggtccaccagcatgctgtttcattacctcaggaaggtttggtgccaagagacagtccaagagttagtgcataaagaaagctaggttcataaaagaattaatatctgccttctttcaaggagggaaactgccacttccaaccattttatgcatctatcacttctcttctatcttcatcattcaacccttcaactggcctacctagatgacaggtaaaaattatagatttttaactcttaagaaataactgccgaagtcatttcttccaaaccattctcattaccaatgggaaactcaggcccagaaagcctaaatgacttttgcaagaccacagagtaagtagcagagtcaggacttaaactccacattgcagaagatgaaccagggatgatatttttaaaacttagcaatggtatgacaaaatcaccaaacagttagaatagagcctctgattgtactggtgtgccattaaataccagccccaactggattacagtgtatatcagtaatactttaagggataaagagaaaaaatgtgccacttactatcaagctatttaaaggagctaggtaataaaataatcataatttatttttactgttggttcttccctttttcatctttttgccttttttttccattgtctttcttgttactaatcctgtgaaaattcaccctctgtttggcagcccgggtcattgttatttgtgctaagctcctatattattagtctgttatcatattgccataaaaaaactacttgaagccaggcgaggtggctcatgtctgtaatcctagcactttgggaggccgaggcaggcagatcacttgaggtcaggggtttgaaacccgactggccaacatggtggaaccctgtctctactaaaagtacaaaaattagctggaaattgcttgaacccaggaggtgaaggttgcagtgggccgagatcgtgccactacactccagcctgggcaacagaacaagagtccgtctccaaaaaaaataaaaacaaacaaacaaacaaacaaacaaaaaaaaacagcacaactacttgagactgggtgatttatacagaaaaaaacattttattgattcacagttccataggctgtataggaagcatgggtggggaggcctcaggaaacttgcaatcatggtggaagccaaagcaggcacatcttacatggccagaggaagaagcaagcaaaggtggaggtgctacacacttttcaaccaccagatctcatgagaactcacgcactatcacgagaacagcaagggggaaattcaccttcatgatccagtcacctcccactgggcccctcctccaattctggggattataattccacatgagatttgggcagggacacaaatccaaaccatataagctccattctgcattcaagtgtatgttggtcttgccaaaattatcaataccttctccgtaaataccactttcaagccttgtaggttaagccctgattatgtttgtaaaagtagcttgatctacatgtctacaattgttctctaatttgctttatccaaatggaaaaaaaaacacacaatattttaggccttgattttcatcatgaatttttaaaaatctaaaattgcctcttcattgtgttatttcaaaatcatgagatatcctttcattgcttctactgataaggttgtttgtaactcaaaatcataattggtagatcaacagaataaaattatgagatacaaatatacatttgattattattgctactggttagagccttcactatgacatgcagtgacatgctcacagaaatgacaagccctaaaacttcttgctttttggttaaacactttatgattaaacatttcaatctttaaactttctaatagtatcttgaaattgtgtatctcattttaacatttttaagccacttagacaaatgactttttgccatgcttgcttgactttttttcttgcatggacttacagataaaggtggtctcatccctaatgaacatatgaggccacaagaatttctcctttttttttttttttttttttgttgttgttgttgtttatttttgatacagggtcttgctctgtcacccaggctggagtacagtggcaggaacaaagctcactgcagcctcagagtcctggactcaaaccatactcccacctcagcctcctgagtagctgagacccaggagcactcaccacttccagctaattttttgtagagacaggatcttaaactcctgggttcaagcagactgcccacctctgtctcccatgtgctgtgattacaggagtgagccaccatgcttggacagtttctcctcttgaatcatcaacagtccctgtaaagtctcaagaaaagtgtttggagtatccataatgtgctaagtcacttaggaacaaagttacacaaaacacatccccagtttttgtctctatgctttcaagatgggtgaaactttatgtttgaagtttcatgttttatgccaagcatgatgagagatagaggaatgggaagacttggtcttacaggttaaagatgtgaaacatacaaaacatgctctcatgagataattagacaaacaagtcagtgtgattgagagcaacatgctgggaactggtttagaggctcctggaggtaaggacagagtcactgttacatgtttggggtattttgctgaagcatcgcagaggcagcattgtcctcgtcaacaggagatggggcgggaggaaaggagagcagagggctgcaaccaaagcaacccagggtccaggtgacagatctcccctattggtaaaatgtgattcatgtggtagcaccgcactgggagcttcagtacctttaactttctctctcaggcttttacacctggtgaacgtctagaataactgccacagaaaatacatctatgacatttaatcactgagtgttcgagagaaggcaaagcccggacaccaagtaagccaggtacccctgaggcaaactccagaggcttccctgggccgtgaaaccagccaaagaaggcaaaattcacccaccctccaaaagacgtttgcgttcccacgcatgttctccgccctgagatagcttagaacacagctctaccaacgacttttcatttccattaacctattcctgattctttgattcaaggaaccttgccatccttagctctttggattatttatgaggtctgatttataatacaaaattatacagtgtaccatagttaaaaccttgaaggaaaaaatgcattttgtatttcttcttcttggagaggcccaaacacccctccccagggttggaaaggagagtggaggtagggtaatggaactccctctcaggcctctgaatatggagaaattaagaagaatgggatggggttgggggacagaggtagtaagcaaacaaatgacttatttttaatctagagttacccatttggagagagatacagggttatatcctaacggtacctttttaaaaaataagtcataagtatgctcatgccctaacaagttagtgaatttttccagtaaaattaaaattaaatagaaagccatggtaaattacccatttcatttctccttctagatttaaaaaaaaaaaaagaggcactttgtcgcttcttactgtgagtgcacttcagccttaatacatgcatttatgtcaagggggccatttacactgttgtctgctggagtttttcttctttcaacttagtagggaatatttgtaatctttattaccccaaataaatctacaaaatgccttttgcttgaggccttttattttaatttcagataaataaatcacattaggttcctggctgtcatattaagataagcatggatctaaaaataacaaaagtgtgttttaagctaatgtctttagattaaatagtggtaaatttctctgggtgacccccaaatcgtattgatgttgggatattttttggtacttttggagtgtttcttgaagaatataaacctgtttaaactagaagtggagtttttaagtcatgtatgggcctacttgtacagtattattcaaatccaagcttcttgcggtggcagtaaatctatcttttaagtacgaatatttccccagttacattagggatcaattttatatctttgttggttaatagtgactccatctatacagtggtttatttattaactataaagatcctagtcctgaatttctcgtcatcctctgtactgttagagcttaaagtcttaaagacaattcaaattcaatgtattccattactgactcttcatcagccctcactccaattctgctcctaatcaagccttggttcaaaatgccacctcctctgggaagccttctttggacttctgcaggacagagtctcctaaaatgtgttttatagaaccccctccatccctcaatgccccagtggaataatcttgataaatgtgaaatgtttcttgcaaacaaggtttagagtgaagaggaagggataaactcccaaggttaggacctaaatatatgttctatgatgaattaaagaacagtgggcagatttgataagaaacaggaaatcacagatagaaagtgagtgcagagttttaccctgaccctttttgtgtctccttgccccagaaaacctggattcaaactctaggcaccccctaattagacacatgcatatcacatacaggtgacctaagtaaactataatgaagatcgatcccaaggtgcaaggtgatatcttctgggtgatctggttcaatcaaaccagatgtctttctggacgtagttctactaaaccctgttgttgctggaagaaaggttcttggaagacagtgatgttatttcatcaggggcttcatggttataagaagcctgaacactcccttgcttctctaaagtatgaccagcagtctataataagtatcctttggtggatagcttatcccatagctctccctacgaccgttcaggaataacataaccattgaagcatgtggcaatacccaatttcgagagccctggtttcatctcccttgtgctggacagagggcatagctgagaggccagactcttatcctggcaggggtctgggactgtctgcatctctgaaacaactcctggtgggtaattggggagtgacatttgatgggtttccagggtggctctggggtctgcacttggctgagaatacagctatgatttagaaattcatcccaagggttgagaacagggaaagataatgtgaggcacgctagccctggtctcctttgacctcagcagggtgaatcagggatgcagaacaggaaaccatgtgctgttattgagttggcatagcgtgatgttttgctttcagagcttttattgctattacagagcactgagctctctctttgtttgctacacattctctccccaagagacagcctcttttcctcttgagggatttaaaaaacaaatcatagttcttattttattcagtgtccaccattaagaattcatgcagagcaattttacttgttgccaattaagagctcccagtggaggtctatgattacagtgaaggcaacctgtttaatactcggcgtccccttagtctacataaattaaccccatgaggatagaggcatgctaattcttaagatgcctggatgataggattcttagatacaggatacacagaaggtacatcttcaagaggctctgggcctgactcttctcagagagcatgtcggctttttcttcttacctgtattttacaactacaagataatttctagataacattttagcaaagaatatttcttcctcaaggatagaataatggcatgtggcctcgcagcaagcaatttctctctctcaatttagagctggagggaacgttagaggcaccagggccattaacctctagctaaaaatgtatagatatatcaaaattatggagaacatgaatgagcattttgagcatggatcattttatttcaatgttcactctacttagttaagacatatttgaatcataaggagaatgaaagcaaagtttttacccaatgttttcctatttctgttcttagaataagaatcacatgcaagccagaaaggaaaggtaaaattccattttaaaaatcttggatatataaaagtaattatcttttttttgctagaagggatgagccttagaggatcttcttctgactagggactatacatgctttaaaaattagtcttttactccccctggtgatgtaggaaaccatcagttcccccgccttgggaagcaagagttaagtcttttacttgggcaaatggtttgtaatcagtagtttagattcttggaagtttgtactgaggctttgacttcccctcaggaaattagtgaggaacttgggattgaggttcctacaggttgactttccccttttaccaacaacccagactcttttccccttttaccaacaactcactgctagatgcccttaagtcacccagcccagtaccagtgaagcaggtggtacaagtcatatgtattctatatttggatagcagttagatagatcaccacttccctcgatatgttccttgaaccttagagtagatgctctaagacagataggatttggagttttatttttaaagtaaaaaataaaattttatatccaatatttgcatatacgcagcacatgttagcaggattaatggctctgagaagttctacaattaaaacaaaatgtttaagacttggttttacctaaaattttaaaaatttatttgaccatggagtaccctcatttttcttaaaatatctatgacatagtgacgcagagtattggtgtttcttggaatatactcaggaaaatgcttgcatagattatttagaccactgatgctcaactgtgagaggggacgactttgtcccttagggaatccttgaaatatgcccagagacatttttgttgtcacaactgagggatactactggcaggtggtgtgaaagccagggatcatcctaaacatcctcccctacaatgaagaattgtctggccccaaatgtcgacagtgccttggttgagaaaccctagtgcagatatagcttgttcaaatgaggcttaggtgatctggaatccgtggttggtagctggcactctgcattcagattttgtcatttgattttgatcatggagacctattactcattcttcattaccttaaggtttttgataaaactgtcaccaatttgacttatgaaaatttgaaataaagatgctaacagtcctttcctgaaacaagcccctccttggctggggaccaaaccaactgcccttataacactaacaaattagccaacaagattagaaattatggctcaggagtcatgcagccagaggccgcaagattcctcacatgtccagctgctcctgtgggtaacatcattatggtaaaaccaaagattggtatttgaggtgtttttcagaccctgcattctcatggatcaactggcaccatccagaaaggtgaactggctcatcaggtcttgcagcccccacccaggaactgactcggcgcaagaagacagcttcgactccctatgatttcatcccgacacaaccaatcagcactccccattctctaacatccccacccccaccgccaaactatcttttaaaaactctgacctctgaatctcggaggaggctgatttgggtagtagtaaaactccagtctcccattaacacaaaaagaaagaatatcttaagtgaatacttggacattatctagttgagctactggcaagttgttagattgttccattagtcatttctactcataggttctttgaagctttctatgacatttgtattatgtagctgtatcattgcataatatttaagtgttatttaaaaacatgtgttttataaatgcaatataatattccagacaccatttcataatctcagtgctgagtaatcttaaatactagctatattaataccttcttttcacagataagaaaactccatttcagagatgttatttagcagccagtttatgcaggccagacaagagtccaagtccccaaaacctccagtccagttttcttcctattgtgtagtattatgctgctctcacttttttatatataattttacatttgtggcttgaaagtaatttcaatgccataagcattcataaattcaatttgtatattccacctgtttattctaaactcttaatatgaggccgcaaatggataaagattttttatcacttgttaggaaagacattttcagcacttttttcttatgtttcttgtcacaaatatatttagccaaatcagaaatagcaacaaatgatataaaaaaattctttttctcctaatattaacttttcacattagaacaaatagaagtacaggaaattatggttgtgtttcaacctgaactagtatacaggttgtcacagtgtgtgtgtgtgtgtgtgtgtgtgtgtgtgtgtgtgtgtgtgttttaaatcaagcagggagatacagagcagattaaactcaccccgacttatgctcaagtcttagactaagttctagattctgactccattctcttctttagatgaattctcagttttcctctttaggaaggatttgttgctatcaaaaagacaattgagcttttaaaggactgctcattgctagacagttatttatgaactccataaattcctttgcaacttgaaaacccagagatagattataggtctatttcaacagaatattagacaggaccccaaaataaccagttatctcaagagtgttattgcaatatatttttgtgtcacagcagatggttatgctataagaaccaactaaagttggttaaagactagcagccccctccatggaggaaaggaaactttttaatctttgcacctagtcctatattatttatccaagtcttattcaccaagtggcaacaagagtatgccttatttcaaccatgcttctgatcagtcctcaaaggtggtagccataaattaatcctgaccacaattattattggaagatctagatgttcagaacttgactctaagttagctccagtataaatggaaggccaccagttaacattagcagcaatgacaaatagcccactccatgacaatggtagcagccacaaatcaaaggcatataaaatcagagaaggagcctatactgatttatgggagcatttgtttaacttcaggcaatctggttgtgcttgtgaacatgacatgctattcccatgatcccctgtatatcacagattctattctaacttatgaacaagcacttaaaaatttaatcataaccagaaaggatttcctacactgttcactgtcactcacatattcttctctaaaaacaatttggctacagttgttgttatgaaattgtaacaaccatcataaagcctgtcactttaagtcagtgaagtcaggatctgttggcaaaaatataatcaaaagtaatttcatgattcaataaatagtatataaatctgctattattggagttcattttctttcaataccacccatttccatcttctcaatggaattattctgactatccaagtgtcattattaccttctattgttatttaaatggagcatttttattagatcctctgacactatatataaggctttgcttcctcagcagtaataattccatttctgaaggaaaatagaagtaactgtacagaaaattctaagctctcactttatgttaactccatgcctgaaatggaattttaatttaatcatatctgagaagacctaggtttttattagctacctcaagaaagtaagaaaaatagccctttccatgcaggttgttttggttcaaagagcccatgaaaccattattcatctataataatgcgtgtaagatacacttactaaccaaattaaactctaaatttctttcatcagatggcattcattattttttgtaaatttttcttttggaagatgggaaaaataaaatattccgtataaatagttgaaataaaacattataccggttatacagttttaaaaatatactttccaagagatctatggaaaatataattaaaaggatacaaccatacatgttattgctgatttaattaatacattggttcacaaaataaaactatcagaatcaggttatagttctcaaagacaaatctagcaaatattgcatcaattacataaaattaactggtgtgcaacatgacgcatgtatacatatgtagtaacaaacctgcacgttgtgcacatgtaccctagaacttaaagtataatttaaaaaaataaaaataaataaataaataaataaataaaaattaactggtgtgtccattagggtcgaacagacttcactgaatttttgttgtatcctaccagcagtttttctatgtatagaaatagaatattctctattactgtaatcagaggtctgtcttccagtataaaaacaaatataagaatataacaaattaaaacatatagcactttacccaagacctagaacgcctgaaagaagataaattttgaggttattagaatttttacagtggcgcaacaagaagaggcaacccggcctggtgaggagccccatggtgatggatttggatgaggtctagcaagaaaacaagagagttagtaagtatttacctgccatctctgtgtacagagagagcactctccccatgccgcaaggagatgaaaagaaataaaggggccgggcccgggggctcacacctgtaatctcagcactttgggagtccaaggcgggtggatcacctgaggtcaggagttcgagaccagcctggccaacatggtgaaacactgtctctactaaaaatacaaaaaaaaattagccgagtgtggcggaaggcacctgtaatcccagctacacgggaggctgaggcaggagaactgcttgaaccagggaggtggaggttgcagtgagccaagttcctgccattgcactccagcctgggcaacaagagcaaatctctgtctcagtcaatcaatcaatcaatgactttaggggcttactgagggtgggtgagacaaatgtacttaataaaacaatttcggtacaatatgaggcatcacgtaattaagcaccagcatatttatttcatagaccgctagcaagactaatgaaaaagagagaagaatcaaatagacacaataaaaaatgataaaggggatatcaccaccgatcccacagaaatacaaactaccatcagagaatactacaaacacctctacgcaaataaactagaaaatctagaagaaatggatacattcctcgacacatacactctcccaagactaaaccaggaagaagttgaatctctgaatagaccaataacaggctctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctctctaactcattttatgaggccagcatcattctgataccaaagccgggcagagacacaaccaaaaaagagaattttagacgaatatccttgatgaacactgatgcaaaaatcctcaataaaatactggcaaaccgaatccagcagcacatcaaaaagcttatccaccatgatcaagtgggcttcatccctgggatgcaaggctggttcaatatatgcaaatcaataaatgtaatccagcatataaacagagccaaagacaaaaaccacatgattatctcaatagatgcagaaaaagcctttgacaaaattcaacaacccttcatgctaaaaactctcaattaattaggtattgatgggacgtatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagcgcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaagcatgggtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaacatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagattaatggaacagaacagagccctcagaaataatgccacatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattgaggacataggcgtgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggcaaaggacatgaacagacacttctcaaaagaagacatttatgcagccaaaaaacacatgaagaaatgctcatcatcactggccatcagagaaatgcaaatcaaaaccactatgagatatcatctcacaccagttagaatggccatcattaaaaagtcaggaaacaacaggtgctggagaggatgtggagaaataggaacacttttacactgttggtgggactgtaaactagttcaaccattgtggaagtcagtgtggcgattcctcagggatctagaactggaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatatcctttgtagggacatggatgaaattggaaaccatcattctcagtaaactatcacaagaacaaaaaaccaaacactgcatattctcactcataggtgggaattgaacaatgagatcacatggacacaggaaggggaatatcacactctggggactgtggtggggtcgggggaggggggatggatagcattgggagatatacctaatgctagatgacacattagtgggtgcagcgcaccagcatggcacatgtatacatatgtaactaacctgcacaatgtgcacatgtaccctaaaacttagagtataataaaaaaataaaaataaaaaaaataaataaataaataaataaataaatcttgaagcaagcaaggatcaaataatttgggctctagttttcacattacaattttgccattccaagatgatagtttcttagaatctaacagtttttagccagacaaggacttagtatatattctgtagtctaactgaaatattttagatcagcaaagctataaaggatgctacctgagcaagcaaataagaacatgaattgaactcacctccagagactcctgtgttgctcctcaagctgagtcagcagatgctcaatgtatttattggagtccatgtattcctgcacaagcagacaaagacagatgaaaactcactatgacagtccccaccatcctaagaccctgaccttatctctacaaggagtatttttgacaacattatccctacttcccttccggttctaggattctctgcttctatgacttgcaatcatatgtaaatactattttttcatgtcctatgatagttttgtaaacaaatcacagaagtgaactgtcattacactgagtcagcattacaatcctcttattcacagaagaaaggcctaaatttcatagtcatctaaactggagtctgtgttctactgtatataaatatttctgccaattatagaaaaagaaaatagacaaaacagttcttgattttactggtcttatgacagtcatgttccagcaaaagtaatgttttcaaactatgtagaatgttttatataaatataatatatacccatattcattgggcacttgtatacactaatggacatgtccatttttcttcaactccatatatacacacaaaacagtgtatttgctttttttttattcttaaacataaatctttggcttctaaaaagacctgaaaggtatggtgtattctgctctatagaaatgtatatgtaaatttatttctctaaatcaaactattttcctgaaatgtatctgaaaaaaaattaaagaattcacgtgttacatgagaagtaagcagaaaaatccataggttattacaatggatttaatttgtgatttctgcatacgaggctcatatgcaatggtgtttcctttgctaacctggagcaaatacaacctatacaaattcttttgtattgttttcctctgaatctggtattttattccctttctgtttagaggtctaccgtgcaggcctctgcttctacattatagcagccgtcgatggaacagtattcaatgatttcaatgttaaggcacccaagaaagctagagttccatttctatagatttgaaataaactgggaactttgattaacagtgacatttttctttcagaaatataggtttcttttgaaatgctatacataatatactgctcttatagaaatattcactataataaggtgaggggctgggagaaagacaggagttgatcccatataatggaaagggaccagtcctgatttcttttgatcctggatctacccatgcggccttgaaaagccttttttaccttcccaaaatgtttgttagactagagggtatactaagtccttgtctagctaaaaactgttatgattctaagatactgtaattctgttatagataattagctaagaagttttatgcttattgaataaacatttattttcaggtgactactcaatagttatttaaacaagaccactgggaatgttaaaaacaaagcagaaagctctgctactgcaggaagttgcaacatacatggttacgcttttaactgtcctgatcaaggctaaaccatgatttagaacacttgacactatcaaatacatgaattctcaaatatgttcagccaagaaaaactaaatacgttgttcccaagtagaaataaatgtacagatcttaaagttattcattttttcttcacttaacaactatttttaaacatctgttagatgcgaagagctgttctaagtgctgcagatacagtaatcatcaagagggggaaagccactgccctcaaggagcttacagtctgtcaaaggggttatactaaataagtgaacggattcgtttcatgttggttacgtgctatgaagtaaacaggtgataggaaagactttgggaggagcagctttgtcacgtgaagactccagaagaagactctaagcaagtgatatttgagctaagacttggaagaggagaaggaaaccatatagagaaaagggagccagacattacaggcagagaaaacaccatatacaaaggtcctgaaatgtgctgttggaggaacagaaggaagccagtgggtgctgggaacagggactcagggatactgggtctaaaatgaagttggacagttaggcaggaccaaatcatgtgcaagccttagaaagcagcttggacttgtcattttgttcattctgattatctcaagtcagaagttgaagctgaaaggtgtagtgatgacaaatgagactttagtatcaaagagactgaggttcaaatcctggttttgatacttactagctatgttcccctggtcacattattaaatctctctaagccttagtttcttcatcttcgtcagagggataaataatgcttcatttatggaggcattgtaagtgttaaacaagaagtttaagtacatacataccatcatgactgccaaatagcaagcatggcctttttcagagtattatgtacctcttttcaaaaggaagatcactttacaaggtgaaggcattattcattttctcttctcttgccaaacttcaagatttttaagtgtacagttcttaggttatacacactaaatattagaataggcagttaggcagagattgataatactgatctctaatctgaatgtagttgtcactggcttgtgatttcaaagctatttcaaataaaaatactagctgcttccatttaaactagctttatcctgttttccatataaataactatgatgacaaatcttaaaccacttaaaaatgggaaactaagattattgattcttcatccctcttttcagctttattttttctctatggcattcttacttccaacattcaatatattttacttatttattaaggtattgcctcaatataacgctaacaaaaatggattgcgaaaagagacattaatcttacatatattttttgttaagtgaaattgtttttgctcaacctgaaataggaagtaccttcatacctgtatcatttctggaccctgaactggaaaagttagttacctaatgtgaaaacactatcataggattataaaataggattactcctagggggaattttgtggatccctttggagattaactccaagaaaacaatggagggtggtagcattggggctggcagtggttaagaggaaactatggtcaccataagtaaaatgctattggcacagtggctgcaagagctttgggagcaagtacatacaggaggttattgtacagagacttcagtatcccagcatgcctgcaaaggcgaaagaaaaggtccagagagattttttcagagtaaactgaaaaaatgcaacatggaacccatgaacaagtactgtaggacaagagagaggacatgatccttaatcataaaagagggtgtgacggtgaaaattatttacataagaaagatatgtaagcattttagaaagagcctcagacatgctgactagtatccagaaagatgtggtctctctgacacatgtgaagaaagttcttttttaatgttgagatgaaaagacagcagaattagattttaaaagataatagggtgagcagccaagataataaaatgacataaaataaagacagggctgagtgagctaagaatttcagggcaacatacaccttacaggcagaatggaaatctatttattgctgtcctgtgattcttattatgaggtgactctccctaccatgaaatggtgcttcagagaaagcaggcaacaggttttggtgtattggcactgaatcgttcatacagatgaaagtctatttctcaatatctcatttgggaaacaatcaaattccccaacccaggccaggtacttacatactcctcttctcctatttctacagtataagtcaattagtgtacgtatcattcagttagtgaagagcaagcatcctgtcatctagggagaaaaaataaacacccatatccacatatcccttgatgtcagtgttcactattcctaacacatatctatgaaaaatatcaatttcccaagccttgctttgttcagcatgcaacttcctacctcattcagcacaaagatactattaaactattgttactaacttgatgaacatcctattctactggtttctgttagaattacgaaacccaccttagatacaataaacagtagaattgacaacgaaaacttacatacagtcctgaggaggataaacttaatctgtaactaaattaagaaataaaggataaggatgaaaatgaatgcagatgtgattgataaaaaggccagaaaatatcagtttgtcaaacaatgatagaatttgagtacttgataagatttgaaatgcaaacaacaaacaaagggataaagaaatatttcagcacaggggaaaaaataaggacgtgattatgtacatcaaaaggactcatcactttccaggtagagttaacggaaaacaatccacacatctattggcacaagagttgaaaaaaaatagtgaagaaaaaaaagggggacttgtttgaatgcttatagctcaacaaggagcaaaaccacatagctccatagcttccagccaccccaaatgcccattgaaattagtttatagacaaaccataaatattattcccaattaagtagctcctatataacaaagcaacagaaagacattctcaggcattcatgaattcataaaatacaggacctacatcttttaattaaaaacttatgtttttatgcatatgtgtataaccaaaaggtgtctgtgtgcaggtaagtatatgtacatatactatgcattatctatgcacatatgtaatacctgagcaaagaataaaaaaatatggaattcacaatataaaaagaggcttcaaaggaggttcatccccccaaaaagatgttttaaaaagtaattacaaaacaaacataaaatcccagagagaaaaagtggaatatacattatctatttttgtgatgggcagaaggaggacaagagggaaagaaagagggaactgttaatagaagggtgcataaatcactttgaatataggggaagaaattattgttctatttttttttttttttttttttttttttgagacggagtctcgctctgtcgcccaggctggagtgcagtggcgggatctcggctcactgcaagctccgcctcccgggttcacgccattctcccacctcagcctcccgagtagctgggactacaggcgcccgccaccacgcccggctaattttttgtatttttagtagagacggggtttcaccattttagccgggatggtctcgatctcctgaccttgtgatccgcccgcctcggcctcccaaagtgctgggattacaggcgtgagccaccgcgcccggctattgttctatttttgactcgataataaaaaatgcttaagtataagggtgtgttttgcctgtgtatgtacaactggggaaagcaatttggtgatccatgttgtgattttaagacatccgtgcccttttgatgtagaaactccctgtctagaaatcagcctgaggaaataatcagatgaaagcaaatgatattcattgaaatactatttgtgacaatatgaaaagactgggtatgtcttattttccaaaactatagaaataattaaaataaagcatgcttttttcgtttgaagaaatacaattcttttttttttttttttttttttttttttttgagacggagtcttgctctgtcgcccaggccggactgcggactgcagtggcgcaatctcggctcactgcaagctctctgcttcccgggttcacgccattctcctgcctcagcctcccgagtagctgggattacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccgaagaaatacaattcttaaactttgtaaagaatatataataaagtagaaaacagtgtaatgctaagtgaaagaaggataaaaaaactgcacaatccctcttatcacaatttagaaaatatatatgaaagattaaaagtaatatcctacagtaaatggtaatattatgggctaatttaattttcttctgtaaattttttctttgtctatagttttacaaaactatatgctcattataaaaatttaaagtaatggatattatatagaaaaatacagtcccagaaaataatgtccatgaagatttgattataaattttagaaagcttgatctgaaataccacaaggaaaccatttcctttatattattctaaagctaggctcatgtttgaaacaatgaacccccctttccacttgccctcgttagtgttctgataaaagcatttcaccaaagttaggattaagggggctgaaggtggggggcaccaagttacaccaagtcatattttatgttttaaaaattttacaaaggtacagcattaaaaagacatctgttccctggctaaaacttatgcaaattagaatcattttagagatatatttcaggaagtttgcctttcacttcttttaatgcacatgtttcagggcaattagtatgaaacatttaaagtgattagaggtttatagatacactgaacattgcaggtctttgtagcataagcccatttaatgtgaatctcctattgtctgaaataggtcagttctgagagaggcccattataaatgaattctaatgatgtgaggatcttaagtatcattcatattaagtggagtttaaaataaaatcgtgtatcaaagcttgcagagatccaaaaatccctccaaataatcttcgtattataatcagcataacttatggcagagcttgtgaaatcctgccagcaattttgtgactagtaacatagaatccccaattcacctttgggcaaagcagcaccagcaaggcggccagctgttcaaatcaacacaactatctgcaattaggaaatgactaactaccacaacaaagtaatttttaagcgggggagggcatcagttcttctcttaataaaaaggtatacctgcatggtgaatgcaaaaaactcaaataaaatacccactttgggaactatacagacaaggtaataaatagaaaggtgtctcataactaactggcatctgtaccaatataaattcttccgaggagacttttttaaatgttaaacaccacaagcaaatcaatttaggagtcccagcttgaacagatccatcctcccaccgccatcttagcatcagccatcttgaattcctctttcccattgcctcctcaaacagctgcaacctggcttctaaggcagactttctagtggagctttcccattagagcaaatgatggcctccgcaaggtggaatcccaggattttgcttggtccttgtcttatgaccagtgcctacagcacttcacattttaaaatcatactctccctccctggtattctctgaaagtgtctccccgtattccatcactctgaggtccagcatggcctgtgctgctcaatcacgctctgcaggtccaatcctgtgagtctggctatttcccaaacaggtccctttggatgtgccacatactctttcgagtaggccatccttcatttctgtgtcctccaacacctaccacagcccttggaacatctcaagcactcaaaggtgtgttaagtaagtgaaagagtgaattaattgtctggatgtaaccaggctcatgagagaatctgagattaggctataagtggtcttggtcttccaaaacttttacttgtaaaggttttgatgatcatggagacattaggcagtcatgacaagatggcagaaacagtgtttttgttttgttttccctctcctctcatacaccactcaatgtgatgcttctgacagcagatgaatgggaatttttccctatacgtcaaccaaacaattctccagcagacaccagctaggtgtcctaaaatttaactcaattctgacacgatctacctggagatagcatcacatccctcagggtgagggctcagtcccataagactgccccggcttcagacaccaatcacaagtaccacagtgggctgccacctataattctgatcagccagctataaatcagggttcccaccacaacatcctcaagcttgattaatttgctacagcagttcacagaactcaaggaagcattttacttaggtttacccatttattgtaagtgatattacaaacgatacagataaacagctagatggaagagctgcataggacgaggtatgggagaaggggttcagaacttccatgctctctcctggcacactgccctccaggaacttccatgagttcagctatctggaagccccttgagcccagtcctcctgggttttatggaggatgtattaggtaggaatgactgattacatcattggccattggtggtcaactcaaccagagcttggtaggtagggctgaaagttccaaccctttaatcacatgtttggctctcctggcaaccagcccccatcctgaggctatccaggagcccacagtcttctaaatagaacaaaagatgatcctatcacccagaaaattctaagggatttaagagctctgtgccagatgttatcactcagaaaataagaaacgttttaggatctctgtgtcagaaaccaggagtcaaagaccaaatattagaacaaaaggttatcctagtaccctatctacaagggttttaggagttctgtgccagaaactgggaagcagagaccgaatatatatatttaatcctagcagttttctaaattactttttactcatgattttattctattggtactagccagaaatgacattccaaactattgataatttcacaaaataagtgcgtttttctaatcttgcaactctgagaaaaatttaggtacattgctcatctatggcatgtaaatcacatgagctgtcaaagatttcaacacagtaaaattcacaaccaaaatttgctttcaaatggagagataactgatgataagaaagcatgatgactagcaaactgcacagagtgaaaacatctctttataacctctgtcatatatggaaatttcatcagtatgaattaacagtgacagaatttagacagatagcacatgagaccattgaaaagcctcgtgacctgttatttggtaccaaggcagtagactaatgccgatcagactatgagtacagcttagcagatcttcagagtaaaacatacttcaatttgttggatactgcttaactgttccctattagatatttttccccttttaaaaaaaatcccccatctctctccagctgtagctggacacactgctcccaagctagaaattatgtttcccagtctcctgtgcttcttggggtgaacacgtgcctgagttcaagccaaagagaggtaagcagaaatggtttgtgcaatatccaggaaatccccagcctaaagacaagacactgcctattgtgcactcttcccctggccagaaacggtgaagccttgggctcagagacagtcctacatgctaaggatagctaaagtgatagttcttagagcacctatctactgaccctagtctttctacctccctttggcctaaataagatagaaataaattcctatcttaattaaaacactgtattttgggctttctttgttactgtacacctagcctatgctacaagtaatataaatattggtcaattcttttcaaagttaacatggcaaactgtgaaatacgaagcagcagtcatctctatattactttattgattgatgttgtttgtagatgttatagttttccaaagcactttgacatccattcacatttaagcctcacaacatctttgagtcatggtcaccatttcaatttagaaaactaatgctcagattatggttaagtaatttgcttagggtcagacaataacagactttaaaagtctgtttttgctcagttcagcacattttttcactgccctaaagaatgcccttcccacagctaactgccctcagagtggattttatgttggttagatggaaactagctacagaatgaccccctccaccgcagccctctccaccaatttgtagtgtgtgctggggggaatctggctagatgcaaagccataaaacaaaaatcaagaaatgagttttcaaattctaccaattgggcatctgtgtaagtttggctttggttccactttgatttccctgccctagtgcaatgagggtgagggcagaagttaagttgtattctcccattcagtattctattctattaataataatgaaataaatctacacaaaagttaaacaatttttagttatatttgacaaagatgctattactaatacttagatattcttttttaggtaaaaagagttatacttatttttcagcaaaatagtaactattgtatttctcagcagcctgtactattttcttaaatattgtttctatagcagcttgggagataaacatatattggtcaaatgaaggaattcatttaggtggaaaaaataagttcacttattttgtttttgttttttttttctgaggtagaaataaaaactaattcaactgtcctcaagttctgcaagtcagtaacatgtcatttgtcagcatggcagtaattgtgtatgtttttaaaaagtcaccataaaaatacaaatgacataattagaagagtcctcatttcaacctctatttttcatttgatggagaaacactggtagagccttatatgagtgaaaagtcttaggaccccagctactctacatgaaagaatttggccatggaaagttcaaagactaatttaaatcccagcattacatccacacacagcaggaattgaccaatgatccattgcatcagtacactgtactttcagacatttccttctacccaaatactggatcacggactgccatttcattcactacagtatatcaggaccgcctgagcctatgattatcaatatcattcaaaatctggccaggtatgttctaattttctctcccattactccccaaagctatcctgggagtccagtgaagccaggctccttgctttttctgaacaggccaagttataagttctttgcagtctcagcacctagcacaagacctgcaaataatagatggcaaggcatttctagaaaccagggtttctagaaactggaattgggttacggcatcaagtagggaaaacacatttgtttgctgctacttatggctcccatctgttcatctgagtcacctggtgggctagttaaaacacagattactgggtcctgaccccagagtttgattcagtgggcatgcaatggagcctgatattttgcatctctgagaagctcccaggtgtttctaatgctgctggtctggggaccactctgtaaatcactggcttatggtaaccaggattagtttactgattaccccgattaccacccactgtcctcctaaagagattaataaggccagtgtaaataatgccagatgcaattattctgcaaatattttcaagggttaattatgttcaggcactcttcaaggtctgggcaatacagccatgtacagtgcaggcaagtctctgcctgcatgaaggtaacatttttgtgagggagacagacaaaataagtggaggtaagtggaaaaacaaaatagagaagaggaaaggaggggctgaagtagaggggtggcatcaacatagactggtggaggaagaccacactgaagacatttgagcaaacacctaaaggaagtgacggaactaaccgaggtggctactttgggaggctcattctaggcagacaaaaccagcgtaaaggactctaggggcaggaatgtgtgccggcatgctgcaggaacagcacagaggccagtgtggctggagtgcagagatggggtgaggggaggagggtgatcatcacagctgcataagcccttgtagggactttgcattttgttctcagtgacatagggaacaattgcagtgggatttgatttgaggagtcaaatggtatcacttaagtcttgaatggatccttctggctgctgttgactgaaggaatagggggcaggggcaggagcagctgaggccactggaaggagatcaacatcactttcactagggaggtcaccaggagaatcatgctaagttgttggattcaggatctgtttcgaagatggaggtaacagaacttcatgatggattcaatgtgggatatgaaataaaataaaaatcgaagataatatttgatttggggcctgagcagttggataatgtgctattttggggtaaatttgtgcaaggggtgttgaataaattgttctcctttggcagtgaagtttgtgacgtcattacatatgaaagagtagatgtcaaccaggtcgttagtgctcaagaattttggattccagtgtgtatggatataaacatggagccgtgacatcgaatgggattacctgaggaaggaaccacagtaaagaaaaaaggacctagtacttggaggttgagaggagaaaaaaaaaaaagtaaatgaaggagaggccagtgagggaggaacaggagaaggtgttctaagaagaaagtagtgttaaatacaatcagtggtcaagtaagacaggcccccaaattggccaccaaattggccaatatagtggccattagcggcccgacaaaaacagtttcagtggaggagcctttccaaatacctcacttggggtagaggttggggaaaggtgaagaataaagacaaaattttatgccaagggtagggagaacaagtaagaacaaagctttttcagaaaatatcataaatatcatgtgattcttgaaaatcagtctccaagagaccatggggctacggaggcccttgggaaaagggtgcattccaggtcctatcccagagattcaggttcagtaagtctaggaataagatgggacccagagatgtaattttaacaagaacttgtaggaggatgttgccagttctccttgggacacttttggagaatggtctcccaaacagaatttctggttatttccgatgacttaacacaacaaaacaaaccaactgccacaaccaccatgcaaccaacacactgaacctttccttgaaacacctccaatacctattctaccaaagtgaatcagggccttggattctcttgacattcaaatgagattggggacaaggtgataaacatgaagactttttagaaacagagcagatggtgcttctcatgttggatctaggaactcttttaggaaaacctagactgcctatcccaggaagactccttttgctacacaagaggaccgtcaaactatttaaaaattttgtttcgtttttatatttatctttaagagacttccctcaagaaagaggttacttcctgcagtgtgaggagattatacatttatgcactaacacataaaccttgcttggattttattttctaagccagaaagcatttgtggatgtgcagatttcagtgtgttgcctgttaaactgcatttcttacttatgggcactgaacataaatcacccaagaggagcgaacattcctcctggagtgaggtatttcaaagactgcctctactgccgctgggtgggaatgggtggtgcccaggatctgatcacatttatgtctctattttcatggtaaaaatgtgaagacaaaagtaatggaccagatctgagttctcctggctgtcatgggctgcaggctgttgtttgtattaagcagctgaacactgtttgacttgtcttggtgaaaagaaacactagctctatcttgttgcttctcctccaacaaaaaggcagcagaacaagtgaatcaccatgactgaccagcatgttttcttcttacccctaaatctcttctccatattaagagatatactaaggagaccataggcatttatttccctgccactggcctcaggaaataaaggatggagcgcctgaagagaccttctcagacctagtattttgcacatgccctcacaaaaaataaacgtgtatcaccaatagagaacatgaaagcaaaccaaaagtcataaagcattctggaagtcagaaagaagtttccatttgattgacaaaagctgcaaaaccagaacccaaaacacatccaggataaaatcaccatgaagatgaggactgaactgggaaaaactgcaagctcagattgaacataagagcaggagggacctcttgggcaatcgtctgtgtgatatttaagtatggtattccatggccacccccctccttccagcaagtggtaggagagattgaactcaagataaagaactgttctctactgaggattagtttccatctaaggaggtagagccatgaggctgggtggggttttggggttgggttctgtgcaggtgtggaggcgtcaccagggctgaattcatgggcacctccccgcagacactgtaggcctattcaatagaacctgctctccagtcaaggctgccaactcagagggcttctaatgttatgtggagagccctgcatccttcgccagctgtagccgacttagtgctgaaaacacttgaacttgcccaacatcctccacaaagaggccaactctatagaaagacacttagcttcctaaggactggttaattggtatttcaatgtgatgccctatgccaacaccaggactggtataatgggtataggtgcaaagcaggacccatctggctggcaatcctcatttcagatctttacatctgaccatgaaaaggccaagctggaaacaaaagggtggcagagtaagaatgagggcctctgcctcctggaaacagaggaatcccttcagggggctgtgtatattttcactgtgcagctcctctttctcgtttgctatcttagcaagccctgtcaaggaagaatgtggaaaagggaaacagtgggaaaacaggaactcctgatactacagaacccttttctccttcaactttacctccagagactgagcctatgtcatagttgattctctaataccagcataaacagctttcaggagaatcatgcctcagtcaattgccaatcatacagggaagattttaggatggtttaagaagatggagagaaaggatttatgaagtagtagatacccatccctgccccacccaaaataaacaactcagtagcatatacttctcttttttccaataaagagactgtcgttaaatacaatctgtttcttggcttcttctgctctcaactctagcttgtaatatgtgaagtaatttgagattatcctcagaagttccacagatatcttgtggtacaaaatgattaccaatactgtgattaaaaagtgcttttataggtggtaacctggagggctgatacaacctgatgtaaacagcactgctgccttgtttgaaaggtaattagaaagccattttgttctgacagtggagaatccgattcaggagaaaagtttcttctctcctgaggggccaaaccaaatatgtgatggaatatagctgtggcactctttgaaccttctcattggaaaatctggagagaaatgggacatacggcaacttttaagttgaaagcccttgtgcccagggcccctgtctctgtgccagtccatccctggaagagcaatggtgcaatgcaataactcagcgctgcccttcacatgatggtggctggtatgctcccctgggttctacctgggatgaccaaatggtacccttagcctccactgaacacccacttcacaaagacacattatcctgacaattaagatctaatgcaacggttctcccactatggacacagaccagcattgttaacatcacctgcaaatttcattagaaatgcaacttctctggcctttccccaggcccactgaactctgggggtggaggggcccaacaatgtatggttttaggagccctccaggtgattctgatccactaaaccttaagaacgactcttcaatagtcaaattaacccatcattacaatcattcattccaggtgtgtgagccacccctccccccccgcccccttccaccccctgcattttcaagataaatcatttgacgctatagtgaatttgaattactatcagcattgatgaacaattcaaggtttcttttcaaaatatctcatttttgagggtagagggctgggaaatcagaccttgcatcaggtgaaacactgaagtttaattaaaataatgcaaaaccagcaacagctgccctgctgtgaagcctatgtttgtacttaatgatttaggtgctgtttttcaggacgagagaagtacccatgataaatatgatgcaggtgcacccgggatgttacctttttttttaagtatctcctctcaaagcgttatgcagctaaaaccattcaatcagtggactatgcactatttgggatttgaagagacacctggaccatgtaagaattttgtattgggacggtcacctaagacagaaattcctttttaaaatatacatatttgggatagcaacgcagacagttcacttaccagtggatagtaatttaactattctaatgcttatttttcatgaaaatcagccactcttagacaaggcagatgtgttaaatcaatttaggaaggcaatttactatgatgaggttgttaaagagtcaaacggaacatcaggaaacttatgcaaatatttttgggaatttgttctgagtatgcaaatgctatataattagttatcatgcttttcatgcaaaattaaatttgctataataacgaatcacactcaagaataaggctagttaacatgaaaagaaccctcatttttatgactgaaagactgcaaattgagggtaaactgcaggtgaatctaattccagcctttaggattattattcattccggtcaaacgaaaccaactgcaacaagggatgggagggctctctgactctggacagcacatgtatggatgcaaaaatcacaaggagtagaagcaatggagtgttgtgctttttggactaaggctgtctcagctatcattagccagatactcttttaccctctaattattttggaaggactcagtgctatcatttaatatttatcagactagcaaagccaaacttctattttggaatatctctaaagtctaattactgctcagtcccttcctgccccagactgacaatttggagataatttggacttccagcatgttggctcttcctgcctcactctgtaaatgtccccacttgtcacggggctctctagacctcctctcgctgtcaaagtcctatgtctgctatatttgccaggctatgtaataattaggcccttggctgggtgcggtggctcacgcctgtaatcccagcactttgggaggccaaggtgggcagatcacgaggtcaggagatcgagaccatcctggctaacatggtgaaaccccgtctctactaaaaatacagaaaattagccaggcgtggtggtgggcacccgtagtcccagctactcgggaggctgaggcaggggaatggtgtgaacccggaaggcggagcttgcagtgagccgagatcacaccactgcactccagcgagactctgtctcaaataaacaacaaaacaaacaaacaaaaaaaaagaaaagaaaaaggccctttatgcctcctggccacttgtagaccactcccatttggccaggaatgagacatgttccatagcatgaaactttctgtgatgacgctggagaagtcctgagcaaaccaggtgagttggtcactctaccacaatcacacgtttccccatgactcccaggctgtttgcccattcctgtgggtgtcagttttcctaactatgcttcaaattcctcactggagtaggcttagccataacttctagtgctgcagactagccctaaccccaggagtcgtgtatgctcatctgctatccactaaagaagtggaggctccatccagtgagcctgatcactgacccatgtcttgccttatcccaggtggactgctcaggaataaaggggtttccagctgcctgaggactgacaaagggttccttctgtcacctccccagatcggagcctcaaagataccagtttgcatcacagccacccccatcccaccctcacccaatctgtgattagactcagtgcccttcagtgggactagcactttacctaggttaggctcagttatattcttgctttatacctactccacaccggatcattgtggaggtcccaggttttacctaaaaataccttgcaacctactattaaaagtgaagactgcacctgaacattcatgttgtctttacacataggatcacaagatactgttgatacagaatctagagttgtcaagtactttgtcatattaagcttacaatgacaaaactaggttttagtagcatgattttaggacaaaaaggaacccaaagccatacatttgaagactacatctatcccttagactgaaaagtcagacatggtagaaatgttttataaaagaagagaaaagcgggaaatgaatgccttgctgcccatagagacgtccagttttctgttgaggctggctgttaaaagtacctgactccattggtttcaataaatagctcaatcaccttgttcttgctaaagctcaagctcaataacccaatattccctagccacatacaatgcatttaacccttttcctcattatcccacttaagctaaaaaacaagacaaaacacaaacaggatagccagatgaactcttaattccaaaacaatatcaattgaattcactccatttgctagtactgccttctcaaccatgccttgtcttagctcaatattaattaggtaaaacttaatagtcatgcaacctggcccacatcaaaaattatatacctataaaaatgtgcatttttctagtttttatacatttcatacttcgtctcataagtcattctgtaaagtgagtgtcattccctcatttgtcacttttgtaaagcccatcttataaaggtttatttagcagaaaggctaatagattttattaataggcatagtctttccaacctgtaaaaacaccaatacttaagtcaaatatttttgtacccactatgcaaatagtactttgctaaaaacatcaccgttagcctaggagaatgagacaaagcatagatgcaagaaagttctatgcagtaagtgatacagacattttacagcaaaaaggtatcatctgtgattgagatccagaggcaggtagaaatgaaagcttagagagtgagcttgtggaaagataattgataaactacattttacatgatactttattttcaacactccattacaaagtttgcttaattatcttttacaacataccagtaaaacagtgtgtctgtctctgtattactgatgagaaacctgggctcatagagttcaagtaacaatatctgagtgggtagttgaaaacaaaatgttacactaaatcattaaaagtaaaagttgaaaaattatctttctagtaattttcaccacccatccaggatattcttctaacaattgcatttgagaatctatcctgggggatgagaccctaggacacatagaagctatgtggaccttgagtactttgggtctatttccttatttataaaatgaagagatggggccagatcagtggttagcaaacctcagccagcactagtaccacctggagagcttgctaaaacagactgcagggtcccacccccaagaatttctgattcagcacatctggggtgagacctgaaaatttgcatttctaacaaattatcaggtgaggtggatgttgatgctgcttgtccagggaccactttgagaactactagactggtctttagggcctctaggattttgagtatggaaagacagacaatattcttaacttctagaccagctgcaagtaagagttccctcatttatccttccacctattcattcaacaaatggacacttgttggtttgtgaacaagtgtgttttcaaatagttccaagtttgcctaaaagtagggaaaaatctcaattatttaattgatatcatttatggatatttggcaattttctttaactctatttcgtgatcatgtaaaatcaggaaaaaatcaattaaatcaggaaatgcatgcaaaaattattaacagtgtctgacatagagatctcagcaaacattagttctatggatcagggaaacaatttacatatcatattgcacttttgcctctcatatttttattccagctgctagcatctatcctatttcagcatctcagggttttcctcctcatcctttgttggagaagctgatgaagttagcaaggcttgggtcacggtaatactgagggagggataggctgggttaaagaggagagaatgattatatgcgaactatatgactggttcctaacaaaagttaatggattaaatacaaaatccctgcccttcagtgtgttccagctctcattagtgccaactgcatctcaaggcacacctttctcctgtgccacctatgtccttggcatacagttggagcaggagatgggggcgctactggcagccaaagaaatggacagaaccagtgtgattgtctggggaatctgacagagaggtaaattgaacttaatcactgtcccagccaaatcacatttgtaaaggctgaggctctgtggacacctgttataaataaagcaattcctaatgtttttctacaagacctgagcctttggttgatctcagtttctcagtataagaaccatttttctcacccagggcctggcatcagcaatttggtgttatgtcccaagaaattccccaaaactcctgggatggcacaaagttgtcctagctatgtgagttagactctgagctccagacagaaatactcatttccaggttcagcttctaaaaatacctgccttcacgtatgtcctttggctccgggaggtttccaaactacaaccaaagtctgagatgaaaacttaaagaaggctagactgcatgaaatttacctcacctatcccggcacaagccagaactggatgaggcgtaaaccaggcctgctgtgcaaacagatgcattctacctctggggatggctcaagggaatcataaacaccccacattgagagggcaggaggcctgagtggcatttaggtttctctgaggcttattttgtgaaagcaaaactgactcactgagaaaacattttaaaaatatttacttggaattacataaaaaatattttaaatgatttttgttttttcagaggtaggaaagtctgttttatagctggctgctgagtcagacagaatagccggaaagactttgggaaacctcagcctctctttggcctctgcagttgtgaggccgggagatgtggttctgaaacccaggcaagttgctgaagcacacagaggaattcccagaatttcctctaaagttttcacttagatgtcacaaagaaggcctgatttcagcgaaataaaagtttgttgcagagtcacacatgagcaccagttgtaactaagaaaatatatatatacattctaaagcacatactgtattccaagtgcttttttttttcttttcttttttgagacggagcctggctctgtcgcccaggctggagtgcagtggcacgatctcggctcactgcaaccttcaccgcctgggttcaagtgattcttttgcctcagcctcccaagtatctgggattacaggcacccagataatttttgtatttgtagtagagacggagtttcaccatgttgaccaggctggtctcgaagtcctgacctcaggtgatccacatgccttgacctcctaaagtgctgggattgcaggcaagagccaccacgcccagcctgccaagtacttttaaaatgtattcatttgattattcactcgaattcttctgagcacctgttatgtgtagtgctaggagccgttggatataactgtgaaaaaaatggacgatgtctccttccatcactgccgtattcaatctacctgggagggaggaaggcactggaatgcagaaccatagctttaccatgttaagccactttcccaactgtacacagggaaagagccagagaaatttgaacaggattttgcgtctccaaagtgtgtactctggcctttggggaaggatggatccaaacataaaggaagaagaaaactagatgactccagcttatgaagatagcatttatgtattcccctaagtgcctacataaacctgagaataaggtactcttctaacagaaattggcattcctttttagtacagggactttgtgatgtttcctgagggatttccatgtactgcaactcattttaattatttcaaccctagccttccctaagctcttgcatctctagtttctacagccaaccatatactggttttaggggtgttgaattgctcagttattgttgggtgcaggcactggacatttgttattttggagtacatcaagcccccttccttgtggggatcactcccccgcagctctgtgcactctatctgctcccagggtagagtttgtgacctgaatgaaagctagttaacacaccacatttgcctggagatgtcaactggttcaatgatgggcactggacctaatcagaaccaatgagactaacatgagaatggcatctctgctagccttggcctcccaacttcagcatttgagtactcactgacacctggacccatcatacattgtgtttggatatgacccccctcttaaaaatgcttgcaatgtttatttttgccggatgtcatcaaaaagaagttgttgatggtgtgtgctggagttggtaaagctgaaactacccaaatggctgtcactagagggccaataatgatgctgtctttcagcacttcttgttaatacgtaactagaatcatgcagctctcttctttaatttgttctggacagtgggccactttagggatgaactgctcagcatttctggcagaggaacagcaaccccttaggatatccttgattgaaaaactataaggccgggcacagtggctcaggcctgtaatcccagcactttgggaggccgaggcaggcggatcacgagctcaggagattgaggccatcctggccaacacggtgaaaccctgtctctactgaaaatacaaaaattagctgggcatggtggcacatgcttgtaatcccagctacttgggaggctgaggcaggagaatcacatgaaccagggagttggaggttgcagtgagccgagttcacaccactactgcactccagcctggtgacagagcaagactcagtctcaacaaaaaaaaaaaaaaaaaaaaaagagaaaaagaaagacaacaaagctggtcacagagctggtaaactggggacagccacagcaagagtcctgtaacagcagagaacagtcctccattccctcggagacattttccagctctttatttgaaatgctttgcagaaacctggaattctggacattatggttattaatataaagactcctatcattccatagctcccatctccactgacctctaccccatctctaatgacctgttacagctttgacgtcactctcagagcaggatttaatgatgactcatctttgatacctcttcctgcgtaaattcaacagcatcctggctgctcacagtagagtgcatttaccagaaacagcagcatttcctgggtgcttgctggaaatgcagcatctcagattccacttcagaccaactgaatcagaatctgttcaagaatcggcttctaacatactcgcaactgctgctgctgctgctgccgccagcctgggaaccacattctgagtagcaggaatgtagacctcagtgtttcctaaccgtactgatcataagttctgttggggagcttcttcaaaatacctgtttctgggcacaacttcaaaccctttgaatcagaatcttcagaaaagggactttggtatttacagccagcccaggtggttcttctggatgggcaaacagaggaaacactgggaatctaatttagagttctaggccgagctctcagctgcctgctcttctcctgcctgaatttgttgcttaacagatggaagcacaatacagcttccactagggctgtttctttttcccttttgttcctccaaagacttgctaccaaatgctgtgtcttcagcatctggaattgtttttttaccttctctctatgcagttaggtaagaaaggaccttggaaggattcaaatcccaattctaggcaaagatatgttaatagtcacatcccagtggcaatgctgtttaatgttagtgttttgaagacaaaatgcagattcctggccctggttgttctgcaggttgtagccttaataaactggttggtctgagtacataagttttcttgaggactgacaaaatgcaagaacagtgttagtaatggaagaaaggaataaaaatgataaccctgtccatctaggatgtaggaaaacagtatttgttaaggttttctacatctttgaaaaactggtaaataatatagttgcctaaaattcttaggatctttgttaattgcttcaatatttttccttccttagccttggattttttataagacagtagcgacattaatacctgcagggctcctcatgtgaagactaaaagtgaatgcatagaccagtgcttctcagtgggggatgacttcatatcccaggagacactgttgtctgtcatacctgggagagaggggctggtactggctgttagtgggtaggagccagggatgctgctaagcatcctacaatgcccaggatagcccccaccgcagagattattgagccccaagtagtgcccaggttgatctagaccaaatactctccacatcttcagagcttaatgatcatcaccctgttgtctctctaccaacgttgggccccaagttacccgattggtagaaccaagatttgaaaaaatgttcctctgcctccagagctgtattcttttcatcccaacgtgctgactcccactggtagcagactatggtaattttttcgtgttgatttataggagtgctgcaaattgcaaatcctgttctcagtcccccaaattcgctgcgtatctgctctcattatgtcattttcagatggagaatagagggttgaggcttggagcaacagaggaagcagaatatagagagagttgacatagactgggatttttatctattttgttttaaacagagtaactgagctcttataagaatcaagagatttaaaacttaatacattttaggggggaaagccgaagactcaactacagaggcagaaggagaagtaggctggaagtaactaacaatttctgacttgtggtgccaccaggtagagctcctggagtctccactgcctgggcagtccttgacatcctttgagagccaaagtgttaaatatgtaagagcactggataatgaacacgtaattggagcatgggaaaaatcagacactgtgaactcgattatgatatgttggtaacaaggagtgaaagcacctaacctattcagtgagattactgatgaaaaatatatataatgaaaaaaatatataaatattattcaaagggtagactagctgcagtgcctcatgtttaatttaaaatacacttgcatttcaacctcagatgagcagttctgaaatgtcatgaaatgctgggaactttcatggaaagaaaaacttgcggcaatcataatattagaatttgtttgccctagggtgtccataatcttagaacaaaaaatactctttatgtggaaataccttgtagttactaggagccttttattataaagaaaaagaaaggcaataaaaaggaattcattctaaggaggtgtttagagtttcctttaactgtttcctttacccacatagcttgccgttaatacttctctattaagctttcagaaagaggaattgcattttccacctcgctgaagaggcatgagagtggtacacttgggctatactgagatggaggcttcgctgacagcagccatccagatctgggtctgctttcctttttcaccttattagctattcccacctcatagtccacaggcctgtggagggggcaggggacaaccaggggacagccacgtggacagggagcaagggaggaggggctggggaaagcacctaaaagaagagggagtaccaagcatgccttaaatatctcacaggtttccagttggcctagcaaaaaaagagatgatatagagatgtacacaggggagcgccaggtagaatctacctaccaaggacaccactggtcttcataaagaatagccaagtgttatggaagagaaaaggagaataaatctgacaaaagtggggggtattgaaagatgggcaaggtgtttggaaagaaacagaaagggaggatgggcttagcaaatgagcagactatataagcccactggaattgtcaaaattaaggttacacacaagggagaacatctgtatcatgacacattgaaataataagtatattaatttacttatcacatccaatgctaagacagattatgtaccttttgtaactcctgaattctccagaatttaaaaaatgctaaagaagacacacactgtaccccaaaggtgagaaaaaggagtggttgcccaagacccctcttctgttcaacttcatgaattcacctgtggaatcttttaaaatagggattctgagagattcttctggtttgtgaggaatctgagttttttaaaggctctccagatatacccctgaacaaccttttaccggaggggccagcgtctaagacactatgaaagataaagagtataatactgagcattattttccagattttggagggaatgtggccaagaaagcaagacctttttttttttttttttttttttttttttctgagacagggtctcactctgtcaccaaggctggagagcagtggtgcaatcatggctcaatgcagcctctacatcccaggctcaagtgatccttccagctcagcctcctgaatatgggtttacaggcatgcaccaccacacccagctactttattttttgtatttttttttttttttttttttgtagagatggggtttcaccatgtgtcacaggctggtctcaatcccctgggctcaagtgatctgcctgcctcagcctcccagagtgctgggtttacagacatgatacaccatgcctggcttacattgtttttgttttttttttttcttattaaatgtatcaataatttttttatttaaaaaaaggacacgttttgtgttgccttttaaaaatacatgttgtagcaagcatataatatctattaacaaaaagaaaaaatagtttgcaaaactcttaattataactttatttgatatgtaactttctgcatcatatggtattagtagcagctaaaaaatattgagggccaggcacagtggctcatgcctatcacccaaggctttgggaggttgaatcaggaggatcacttgaagccaggagttcaagatcagcctgggcaacatagcaagaccctgtctgtacaaaaaactaaaattaaaaaaattagccagttgtggtcgtgtgcacctgtactctcagcctacttgggaggctgaggaaggaggattgcttcagccccgggatttaagtttgcagtgagctatgattatgccactgtactctagtctgggctacagagggagaccctgtattaaaaaaaagaagaaagtattaagcatatactatgttctaagcacatattaactcatttaatacatacacagacatacatgcacacacactcccactgtaccatgtgctattattattcttatttcacagatcaaaaaatgagcaaatatgtgtgcaaaagtatgtgtgtgtgtatgtgagtgtatgtgtagttttaggtaaaagaataaaagatatcctaattgtcgttgactgatacagaattttttaggctataattagtattcttgtgctgtgctgattaagacttttatcagttcttgggctaaatataaatatttatactccttttttgttggcaggttttaatagttaaagatagattcgtggagagggtagaagatgaatagcaaacaattgatggagtcttctaaagtttaacattaatgattaaacaacatgatctgatgacttactcagcaactcaaagacaataaaacataataaatctgtcaattagcattttcatcttctctcccaacagagcttaatggcacctgcaaaatgcaattttcaacccagagctctttgacattttctgtttcctcccatgtccctctcccgttgttcccgttatgactgagagcagcaacgtgttctgctccatggtggcaaatgagtcacctgccattgaaaggaaagcaattattgtgtcctctctaaatctcagggatgacttgggtactacttttccacttaagggcataaacagccaacccaggaccggttttaagtggctgaaccttagcaacagcagctgggctacaggttgatgtcacctgaggtgcccattaaaggtgtggaaagctgccagacaagaatgacttccagtaactacgacttctccctggagggagcacaacgcactgccacacacaaagtgacaaataatgactgcaaagatagcatcttgcctttatcttcctggtccttcggtttgaggacagtgacccaggcatggaggttaggctgtttcttggatgggtttccagctggtgggagtagatgctatttacacaagtgtcaggaattacaattcttcctcttccaggcagctatgtttagctcacatgtgtgtcacacgtgtgtagaccccaacaccaccatctctgaactgtcaagtaaggagattctgggtgatgagaaaaagtgtgccctcagggagacttcagatagtaccttggagctttacatctaatgaggacatctcaattgtttttctaagcttcagagtcaagtgccttgacaaaatgggcccaatataacatttccccttgagtcatttttaaatgcacctttttcttcagtgagctaaagaaaactgccttataaacaccatcaatgtaccaaatgaaagattccattctaaataaatacggcaagcctccattaaccagaatccaacactccaatgcacccagttaaccagaattaggttcactacctcatttttagaatcaaaaaccaatacttaagagcatataataatttcagccaaaaaaaccccacaaaattttcaggtctttttatgcaaccaattatctcaggggtgcattttctatctacctgtttacacagaaaatgagtttttagaataatgattctgaggcaataatcatatagtcaatatatataattattggtatacttgtgcttaagacttgaaagttttagaaaaaatgtccactgtatttgaaaagaaaatttttaaggattctgagattaatgataaagtaaacaaatttatattcacccttacaccttgggcttctagtattccagaaaaaaaaataataataagtgtttcttttaccctgctatttgctctgcttctaggggaggtctggaagctttccttcacctcacagatgggtgacccaaggtgggaggtcaaatgacttgctcagagtgagacagcatgtcaatacccaatgcagggttagacaccagagctgtggactaagcccttcacgggcaaatccatcactgtagaggtatactgcttgaaaccatttttccaaaaggttctctctggagggaaaattctggtctcaagaaatgaaactttgattacccagcaatgggactccttgccagctcttttttgaaataattatgaatctaaaacgtgcccttgtttgctctgaattttcctttaatgtttactggcaggatgaatacaaagcctccacaaattaagtcttcccagaattagttcagaagtgcactttctattactctgactagcagctcctagagtttcataggagattggaagttaattcttttcagagttgctccaggcaaaaaagcaggggatgataatgtttaggtacttttctccctcttttttagataaatcccaggtcctgaagtctgaagaggtcattagtcagcagagggtatgatacatcggaagaggaaaggctacggagtcactgggggctgggtttgaagcctggcttggggcctttaatgcattagcaatgaatgttaatgctctctgctttcttccacgacgaggaaaagccatggccttgacgagctcaacaaatagagtgtggaagtgaagtcacacagaaagactcaacggtcctacctttctacagctactatccacattagccacactctgtcaccttgtcagccaccactgaattactagtagaattgagagtggtgacaatctagcatcttcctacttactttcaacattttccataatcatatataagtccttagagccaatcagactgcattgctgaacaccatgcaagagaaaacttctcaaatctcctttgccaacatttttatatcatattgattttgctcccctacacagtgagggactgcactgggtgttgtgtggaaatgaaagtgattaacacacaaggaaggtgcttgtttcaacagtacaaactggaatgctacagagaagattcggatggccctgtgcaaggatgacacccaagtttgtgaagcactccatatagaagggaaaaaaattaaagacacaagggaggactttgcaacctcctatgtgcatacgcagattgagtagaaggcgctgtgataagggctataggagggactcaatttgctatcagaagaaaaggcaagagaagaaggccgttagtgatccgttgagagatggtttatttcaatggttatgtgtgtggacactggagccatcttgcttggattcaaagcctggctctgtgacttaatggtcgtttgacctagaccaagtctctcagtcactttgtgtctcaggtttctcacctgtaaaatggggataataatgattcctgtttcatagggcttttcagaggatcacgtgaatgaatacatataaagctggcactgtcgtattagacatttcttttgaaagctgaattggaagtgctcacggtggtggtaaagtatctgtcatggagggcatgccatgcgacagatgctagctcgggcacttttatgttcatcatcttatttaattgaaacttcccagcaaatagatattatcacccagattttaaaagctattgatcacgagagttgaatatgttgtctgacatttcataggtggccattggcaaagtggagattcaagaccacgactgtccagctcccaagttcatgctccttctgtccctcagcactacctttgaccatttctccgtatatgcatataaaaagaatttccttttattgagtatatgtagattgggcttggttatcaagctgttctccagtgataactacccccttgaaggaggctgctgcccgttttaacggtggaatcgcagtaatgaagcatgtggagcagcagatgccttgccagaaaataattagcaaaattcctgaattagggtgcccctcacactgctgcagtgcagaaaacagtgaactgattgatgttagatttttttatcttggtaagaaggatcaggtttgctcctttacagcatgtggctgagctgggtctctactgtgaatcaaaaagaatagaaagccaaactcaggtccatttacttgaggtcattcactacctcctataataatgacacacatttgctgagtactaattgtgtgatattcattgtgctaagtgttttgcataaaatgtcttaagtttcacacggcccagtggtgcaagcttgttgtcattcccattgtttaagtgcccaaatctagacacggagcagtaaaataacctgcccaacccttcctggtatccatggaatgtctcagtggtattgggatacaaatgaaggcaatctactttctgagccataatcactgcgttatagtctcttacccctctcactcttaatcaaagcaaaaaaattggcttcaaacaagcaaattgctacacttgacaacagaaatataagccaaatctgaattattagattgctagtaattcttatttgactattaattgggtgctttagctgggctgggtgtaccttttgctttcctttagttggataattgcaagcgaaaattttggatattaccattcatgtacagagagaggtagaagtcagcaattacactaatccccttaatcctttatgtactttacctgcactgtaaaattccttgattttaaatccgccacttgttctataaaaaatgtatagactaaagaaccacaaaaaagttaaataaaaatttttgcctgatgatatattgattgtacatacatatctttacttttgcatattctatgttgccattaaaagatccattaaaagctgagttcaaataattattcactgctcacattactatgataatcaattgcctgttatgaaaattattgccatctttaagaattgctttgctaagtgaagtaattagaactgatattttattttctagttcagttccaaaaattgattttatatgctaatcagagtgtgaaaattgggacataaattttataaacaaaatgaatggctagtcaggcttcctatttgacactttatatagtatttgttgtttctcaaggcatcttgctcttgagaacacactgctgattactgtatctgtcagaactaggtaggataagtttttcattttacagagtctcaagtatctgaagttccaagaattaagaggtgtgggccttcaatcaggacagagggtggaaaatcacaccttctgtccaccgaaatagccattatttcttgcagccccaacagaaaagcagaggaaagacaggtaccatttaccaactgtcttgagtgtgcctggtgttaaactcctgacatatatgttttttctgttccttatggttatctggctaggtaattactattattattactcttacatataaggaagcaaacagactaggaatttaatttgtgatcgcacaccaagtaagcggctaagttgggaatcaatcccagtctgcaggttcacaaggccatgcttttcctttcctttaacaggccaagtgcaaacagctgaagtgaatacacttcagcacaaggctcgagcttcatgatgattttgccctttggcacaaatgtcttggtaaatgtttcaaaagaaagttaatgccttcacttggtttttaggtgatcatgaattgtagaggaagatgcaggaaaccacaggttgaagttgcatttagaagcaaaaacaaacaatattttcatatatattactggaattatgaggtgaaatgaaaggaagaaccaaatttggtaaaataaaacaagatggtagtctcaattccagctccgctaataagaaaatgggaaattttgaatacattccctatctgagtctgaaacagctcatttgtaaaatgaagggttatgctctttaggttaagagtttctcttctggctacacgggtggctgataaagttgatttcatctccaaaagtgacagggagcaggcttctgtttggcagaggtatatccctaccgggtctcactgccacaggaacagaaggggcactcgttaaatactgtcaccctgttttgccctcatgatcctaggtgtctcttagagagacataagtgacatttttataataaataccaaacaacaaacattgtcagatcctttaggggcttggtcatagatcaacagacttcctgtggccatagctagaactcaggcctcttttcaatttgttttctgatcccccactcttcattttatcatcataaagaacccaaattattaatatgccagtaggacaattttaatttttcacatagtacatggactcacactcaacatacctgggtttaaatccagctgctgctattgtgtagctgaacttcttgaacttcctctaaacttttctggccttggagtcctcgttagcttgagatttctcatgtcctttatgctccagattcaggacaacttgagatgcaggcttaaagaagaagtaagtaccaagcttgtgtgctgcattaatgctctgctaaatgtctgtgctatagggatgagttctaatcagactgacatagaaagaatttccctcattattatggggtaaagttcatacattacccccagtactttagaatgggcttatatttggagataggatctttaaagaggtaattatgttcaaatagggtggttagggtgggccctaatccaatatgactggtatccttgtagaagaaaagattaggacattaccagagagagacaagtggatgcacagaaagatgactgtgtgaacacacagcaagaaggtggccatctgaagctaaggagaggggttgcagaggaagccaatcctgcctacatgttgatctcaaccttctatctttcagaattgtaagaaaatgaatttctattctttaagccactcagtctgtggtattttattatggcagccctagcaaacaaatatgctcattataccaataatcaacttccttggatagaatggaccattcttatgatgaatttcatgctgtagcacgggatgcatatgtttaaacaattttgcccctaaagttaataaacactatataatatgggctatactcagatatctaaacattttattccttcaagtacaaacatttgaatcaaacattcaaaaactctagattttaatattagcaaataatagattcttggaatatttaaagagcatgattgaaggataagctgaattatatgggtctattgcattttttttttgttgaaatcaaatatttgaatttcataatttggttaagaaaaaatatagcaagtaccatcacagacatttggtttttaatgctgtgaagcagtggagtgaaattctatctatagagtaatagcaacatgctattctctaaggctcccaacaaatgttcaaagatgtagagttcctatataaacataccaattctaaatgtacacgaatgattctgtcattgcattctaattcttagtaacagaatgtagtaagtaagcattcagagcctaaggtctttactcacatactaggaacctgaatcatgcacccccatcttatagtgcagctttcattctgaaagattaaatcctattgcaccatcattaatcaattcttctcatagcattccagcaaaaataatacaatgagtatcaggttcttttttggtacataagaagacaggcatagctgatttgctaaggcaggaggcctgttatatggtgttatcaagactaaaactaccaagtgttttctgttttagtccgaaaagatttattttctctttccaagagaatgtgctatgacatatatgctttctttaaaatacaaggccatggccaggcatggtggctgacgcctgtaatcctagcactttgggaggtcgaggcaggcagatcacttgaggtcagaagtttgagaccagcctgggcaacatggtgaaaccctatctctccaaaaaaaacaaaaacaaaaacaaaaattatctgggcgtggtggtggtcacctgtaatcccagatactcgggaggctgaggcaggagaattgcttgaacctgggaggttgaggctgcagtgagccaagatcttgccactgcactgcagcctatgtgacagagtgagactccatctcaaaaaacataaaaataaaaataaaatacaaggtcactttcccatttctatgatcctgccttataatcagttatgtgcagggaaaaatcaaagaaatttcaacagaattaatataatctaaattattgagaatttatcaattttccttgtttctcctttcttatgtctcttagcaatagagagaaatgagaagttgtgtaccttttaaaaaataaatgtgtcagaagaaagaatctcctagaaataatgagaagtttatggaactttttctcttttgatctttaaaaagaacacaaggccaagtcactggggaaaaaaaaaaattctatgaaacaggtcccctgggctgtgaatccatggccccaggctatttgtaataaagcatataaagtgtataggttgctctggtctttgaaggtctttcaaagatgaaataattccatgacttttgacatttgagaatctttatgggtgtgaaagggacctaattgaacaagtgggctaagctgccaggaacagagatggagtagccatattttaaccaagcattgtaatatggtcaatggcagccattaatttatttctgccaagacagatggccttctccttgataccaatggggaaaaaataattaagaaaatctagagccagaatggaaaagatagctgtcttttgacaaggtgattcttcagtttgcaattaacaactgataaaatgctatgcatgttaactttggggaagaatagctagtcatttgaaatactaatctcactttcttttcaaactaccttttactggtatctgccctttctgtcccatcctgtaagtaggccatacattttatggaaaacaatttaaaagaacatcagtagatatcagctataattctagaaacctttgtgcggtctttggttttacatatatggtttcagaagcaaatccaatgggcattgttaagagtcacatggtttagcttccgggtgttagaaagcaaacttccactcttgtgccctacagacactctcttcactggagttctcaaaatatatgatccctggccagcaaattattatgtttttaaaattatactagctgccatacatatcaaggatggcttttcatggggcaaaacggaatcatttaagaattacatcagatcacagcagtagcaagttattcacaactaccttgagctgactagcaatttttttgtagcttggaggtaaatgactttttgttgaaattgaggataataaattctagctctcattttagtaatgaaaagcagctcttcgtctcctcatcttcaagaatgtgcagagaactaatctcccctcaaaggtcctttcctctggccagactaagttttaccaaaagaacacatggtatttcaaacattggaagacttagccttcttttcttcctcctctctttccattccacaaatatttattaagacttcattttgccttaagttggatcctctgtaattgccataatattctattattttgacttacaacagtggctctggataccccctgacaatgcataagaaagaggagacgagtaagatacacaatctgtctgtaaagatcttataaacaagttgacaagccaagaatgaggtaatgaatgccctataacaataatccttgatgcacctaacttgggtggcattaaataataaaggtaataagagttcagagatggcaaaaatccctagtacaagagtaagcagtgatttctttttgaatgaagagatgaatataaatcttaaaagtacatttggaaaacaagacattgtatcactgaagcattctgtttcttatgcttattgcacctgtgttttcttcctcatctcagcagccagctcacatcctcagaagttatattgtttccacacttctcatgcaacactgcaaaaatggttttacttaggtactattctagtcacctgcttcatacaagccactctagctgttcatacatcttttcaatcagattataatatttacctatgacattttttaaccattgtcaattccattaattctatttacctgtgaatgaaatcactaagaccattagatcaaatggattccttgttatctcctacaaccacattcttttaccccatggaaaaaaaaacacttattaaagtatatatacagctataaatatgtcagaatatagcaacataaaaatgaccaactgggtcagacacagcacctatctttgacttgtcattctggaagtgagcagatttttttttttttttgtacccacacacctgaagatcatgactaattcccctcattaacaagaactccttcaggcaatgtttctaagggggataaggtggagtgggctctcttgcttagaggaatataggatgctccactgggaagagaaatacataattcaaagaagaccttcaggtaattttgatattttattcactccatcttcaggtccacaccacagaaaattattactctactgtacatatttcttcttgatatcaagctcagtgagtaccaaaatatgttctcttatcaatctgttatctgagaatgtatctatataatttaaggttatccatatttcataatactggtgttcaaatgtcctcccaaatttgccagctgttaagtaaagtagcacagcacccatgacacttaaccatgctagattatccatctttgtacccgtatctctccacccacattgtcaactcctatctttcctgtctttacatttccagcacctgggacagagcctggactttaaagttatatagaaccacattaaattgccattttttgccacttaactgtggttgcatagtagcaatttcataaggttcaacctaataattgtaagccatgactaatgaatagaattttaaaaaggatctaaacattcttttttttttgagacggagtctcactctgttacccaggctggagtgcagcggtgcgatctcgacttactgcaagctcagcctcccgggttcacgccattctcctgcttcagcctccagagtagctgggactacaggtgcccgccaccatgcccagctaatttttttgtatttttagtagagatggggtttcaccatgttagccaggatggtctcgatctcctgacctcgtgatccgcccgcctcggcctcccaaagtgggatctaaacattctttagggcttcagggaaaggaaatgggggaggggagggaactaagatttactgagattttgatgcagtaggtctgggatgggacccaggaagcagcattttaactagtattgcagatgatcttatgcagatgacccacggaccatgttgtgacaaatgatgcctttagggacacaaagggataggataagcttctggtcagttagaaggcagcaggagacaaggctactcccaactcctccttttcatgcaaatcatcttcatcccatccagagtaggctgtgtgagccagagtcagagaggcctgggcagtttgcatggctgtccttagcaggtcttatactagtatgctttttttccagaggtattttgttctttggaaagtccctagcatctttgtgcctaccaattaacaataccccctccagccaccatctgcactgtgtatatgcaaggtggagtcattcagctcttgcattcccaagtaatcctcttttaggaaaagggttctctaatgtgctcagagacaaaagcacccagaggtcactgtgttctttgttcaagtggctgcaatgtctgaaaacacaagggacttcttgacagatttcacagtgttgtgattaattagtgcccacacttgacaggctaggaggacaccagaatgatccctgcaggatggtgcaacatctctccatgtcacagcagtgagggacaggtgaatgatgatttctacaactagatgggaggtagtgtagagtgggctgcaggctcgtcagatctcaacttgcttgatcccaccttctaaggtatactaaaggtgaaggcttattcattgaaaatcagagacacaaatcctccaaggcaatgcatcacagattgtgtggtacactgatggacatgctgtgttaatgactgcatttgttacagtttgcacagtgcatcctgctaggcagtgctcataagggacagcacattaaacttatcatgttatgtcactgaacatatcatgcaatgtgatgtagtatcagcatactattcattgcatatgtttcccagggtttccagattaatagctatcttgaagaatataaaaaaaattcataggtttaatatacacatatacatgaaggtaagaaacatgttagtagcaaaaaatgacaaatagattacctacaaaaagaaacacatgtatctgcacatgtttaaaaaaaaaaagaataaaacctgtgctcagagcagaggattatcacagaggccagtagtataaggcaaatataaaagggcaaaaattaaaaaaaaattctactcttcaaaaaattttattttttatgtctaaaactgagatgggactatcaaaatctgaatttcatccatccatgcatccatccatccattcaaccatccatttaccacccaatacatattgattgaatgcaaactatgtccagatactgccatagacaggatgtaatcatatgtaaaggacatcccaagttccctgtactcacggaggttaaattctactgtgggagtcagacccaaacatacaagtttaaatctgaattcacgtcgccataagcagtggtataaatgttgaacaagcttgggagtcggaaggatgtgatttgtagcttttgccatagtgtaagtgcacccatcctggacaatttcagtctaacaatgtgatgtcaccggatgaggagttggaaagagatgtgtacagttaactctctggagcagtatgagccagccccagctcacccttgaatgtgatgtgaagaagcaaagttgggtaaggggccagagactgcggggaatggtggatcttttaggcaggtgtcagtcattctttgattagtgacatttgaacagagacctgaataaagagaaaagaagtaataaaaatatggccagtcacagcggctcatgcctgtaatcccagcactttgggaggccaaggtgggtggaatgcttgaggtcaggcattcgagaccagcctgaccaacatggtgaaacccctgtctctactaaaaatacaaaaattagctaggcagtagtagcgtgcctgtaattccagctacccagaaggctgaggcgggagaattttttgaacctgggaggcagaagttgtagtgagctgagattgcaccactgcactccagcctgggcgacaaagtgaaactttgtctcaaaaaaaaaaaaaaaagggtaataaaaacgcgaggcagggagttgaagatagtgggggagaagagtgagcacaaaggcagcaccgagcacagaggaagcactgcactgcagcaaaggtactctctgcaaaagggaaaacaggatgaccagtcaggagtggtttgtattcatctaggcaagaagtgcaaatcgctggacgcagagtggtagaagtagaagtgatgtgaaatgcttagatttgggatacatttgtgaggtagacttacttgaagtcaccaatggattggatgtgaagagggtaactgaggagtcaaaggcaatctcgagaaagactcttagttagcttttgctgataatatataccaccattagatgcaatggggaagaccaaggcaaaagtttgtgtagaggaaaaatcaaaagctctgtttgggtcattttaggttagaattattgacagacatgtggagatgtcaagcaggtagcgggatatgcaaaagtctaaaggtcagaggaagtcagggatgaagatatatgaagatatgaatttggaagtcatccaaatatcgatttcagtgactatgccctcagtgcgtcatttgagaaccaatgccttagagaataatgacagagattcagcctttaaggggcccctggggaggaggcaaccttttatagaaagaggtgtgaatcattgccccaaaatatctcctgttaagctctccctatttctgaaggtacagcctttaaaagataacccattttcaccacccgggaaatgaggagcacctctgcccagccgccccattgtctgggaagtgaggagcgcctttgcccagctgctgtgcaaccctccaagtgtgaagtgacagccttgtgtgtgatctttctgccctccccaagtttgcgtttttgacattaaagtttacttttaaattaaaaaaaaaagatactccattttcatcatagtcctgttaaaatccatgttaatacttactaacaaactaatagagatttcccacctgtcaacttgactagagaactgggtatttgatgttcagaatatggagcaatggttcttaaccctcggtacacattataatcaccaagtagagttgaaatatgctgacacctgaggcccatcccaatgattctagtttaattgttgtgcagtggtgaaaagtatggatttcttttaaggtgtaaactggacaagggacaggaaaggtggtgatggaaccaaagagctgaaggtctcaataatgttgaggatacttgccaaatcctctagtaagagaggagttgtgatctgcttgtggggtgatttcattgtgactttgtaggtggttcaagatgtaatatgggagtggagatggagtaacgcaaaagatcactggggataaaggaagtgcagttactgaaggccagggtgttgggaaattcctaggaggtttggggtatgaggtatgatagcaggcacagagatggaagatgactgagccaaagaaccaggagtcaaagtcttcaatgactgaggagactagaagaacaattatttgaggacagcaagaagcagcagcaggaagtgtttattcaggactgaacctgaaagtttcatatccaatcaatgagagacttctggtaggtttccctatcaattatattctaaatctgacaatttctcatcacttccaccactccaccccactctaagcaacgtttgcctcttacctaaccatggagaaggaataaaatgacccaaatatggtagtagaaagcagggacaatacaaccctcaaatccaagccatgaatttgcaggaatccaaagaagtgagcaaaaacacatctatttgaaagggctgcagggatgcaaaatcctcagaatggggtctatatgcagggaaggctattaagtggtatattccaagaagaggagagattgatgatgacagactgtgaatttgaaaggattttcagaggatgagaggggatgagaaattgggccacatacgagtttgctgagacgtgtgagattaagagatttgggtactaatggatttccagcgctgcttaaatttctggtgttagctaagggaaaacatgttagaaaagatgtgattagtctcatagcctcttagagaacagtcctagggtgatggtctgaaatattctaattagccatatggcagcttccagggctgcgggcccctcacagagcatgtgttcgcaaagtggcccacgcaaggagcactgggtgatatggtcatcggactgggccatggccctcacgaaatacaaggatgagaacttgtgaataaatgtgtgcaaccaagcttcatccatggatggcgatgcaacaggagggccacttgccagtagagtgggaatcaccctggtatgcattactgagtaacacatccagttaatgacactcagcaacagcttgctcagcagaagacttgagtcattttaacaaatagaaggctgggtgaatttctgtgagctctgacaagtacaaactgttttcttagactcgttgaggactgagtgttgtagttgcctcatcactgtggtgggccctgccctgaaaatgaacatgcttactgcaccaaaggttgacagccacctgtgaaatataaaacaaccttactccctgatttgtgaaattatttatgttaaaagttctacaaagctatgtacatagagataaggctggaaggaaatactcctaaacgtagtaatgttacggataatgtatttttttctctttattctttttggtgcttttctcaactttctactataaggtcataaaactttcaaaattgtgtggggggagttaattataaagtataaatattcagccgggcacggtggctcacacctgtaatcccagcactttgggaggccaaggcgggcagatcacctgaggttggaagttcgagatcagcctgacccacatggagaaaccccatctctactaaaagtacaaaattagccaggcatggtggcacattcctttaatcccagctactcaggaggctgaggcaggaaaattgcttgaacccaggaggcggaggctgtggtgagccaagattatgccattgcattctagcctgggcaacaggagtgaaactccatctcaaaaaaataaaataaattaaaataattaatataatataatataatataataaagtataaatattctacaatggcattgaaaaggaaatctgggctgtcctaagccatccatgttgtctggctgctgtcctctccctccctgtccccctttcattctggcctcccctctgacctgtatgtgtattgggcccctctgggagaattcaccaattcttagcaagtgcctttccctgaaaattgctttctgacctacaaggctgggcccacagcatgcacatgtcatggcatagctctgccttctgaccaaatcagctaaaccagaagatagagtccttctttggtaattttaatttatcacagagattataattgggtttaaaatatgttcttgaaccaaagtgacaaaccttgagctctgtggcagctaccttctgcgatggggcaggagacacagaaaactggcttgcagaagggacaggatgaaatttagcaggcagagagaaaagggatgtggcacagggatagcattctacctatgaggatccctgtttttagacttctcagagatctgccattaccgcaatatgcttacaccacttgctgagtgtctgccgctcaagttagctcctctcactttaaactagaaagttcctgtctctcatcccttctctccctccttccattgctgaattaaaaatttaaaaattctttaatgaagtaaaaactcattcaagtttcaaacaagtgatcttcagaatataaccacttaataagcagggagcaattcaatacgtctgtgtgtgtagttttatttggggagtagagtttagaaatcattccaatattatacatcactatgcatttgttttactcatgtatctactgtgacaaaaacacaaaaactgcatttttggggtgggagtagtttttggaaactatgaagaataaagttacagccctactatagccaacatcaccatgttttcacatccccaaaggccctactacccacactgtggcccccattagcccacacgtcatactacaatttatatgctattgatcatgagaaatgcaggcccaaaaactaccttgaagcaaaaaaaataaaaataaaaaatctttttctcttgactccccccttctccatgctataaaatatattgcagacaacattttcctgctgatggttaataagtgaaggacaattcaatatccagtaaaggtgatttattttatcaagactgtgacctgctgcccagctgggaaggatttacaagaaataagaagacacatgacaaagaaaagctgaagtttagaaaattcccaaagacataaagcaaataaggaaaataagtaaataccaaaatatttcttcttagaggtcttccaatactggtgtgttctctcttatgctgagtaatgtaaaatatgtccttccaaatataactctcaagcactttttttcccaaaagcagcttactttgagcacacaaccctctctatcttacactccttaacaatctaaaaatgctgtgtcaaatcttttcactgttttttctctgcccacaaaaagaggatattttgatcatttttaggcagtaaattcaaggcctatattcccccattctgtagcatttggcttaggggaatcactatcttgtttccctagaagacagaacataaggtgagtgaatttgccttttccagccactaccctggctgccctaggaagaagagagtttccagttaacgggaggaaaactgcacattagaaaaggctgccacagtgggcctgacttctgctccgcacagcagcacacacctggttcatactcagcctctccttctcccacttgcctgactgcctgtgttcctggatcaagtggcaagtttgcagtcttccttgaattcccccagcactgtcttcctcgacggcacttgacaaagcggagaaatgaatattctgcttcctaatgagaatacacagttttaaaacatcttctccttccctagcactgtgagttggtgccattagcttgtcatgcttgttttttgtttgttcatttatcatggaaactcatttcttccactttgaaaccattaggttcacatgtttggcattttacagatcctcttggcagaacctcttgggaagcacaaagaaataagtccagagtagcccattagttttatgtcttaaatatctcttcaaacagttcacttccttccaatgcctccatactattgtaccctcaactctagcctggtctatagaactatcctcttctctgaattctgtgtttctggctggcctatctcttatctactttcagcaaccagggtaaacttaattatatttttttaaattttaaaataattttaggctcacaagaagttgtcaaatcatggcagagatttccgtgtacctttcacatagctttccccatgataatattctacataaccacatgcataacattcaggaaatggatattagtccaatcctatcaactaaactcagagtgatcctataaaaatgcaaacctggctgggagtggtggttcatgcaaacctggctgggagtgatggttcatgcctatggttccagaactttgggagcctgaggtgagaggatcacctgagcccaggagtttgagataagtgtgggcaacatagtgagatcccatctctacaaaaaagcttaaaagttagctgggtgtggtgacacacaactgtaatcctagttactcaggaagctgaggtgggaggatcacttggacccaggattttgaggttaaagtaagctatgatggtaccatcacattccagcctgatcaacaaagaaagaccctgtctctaaaaaagaaatgaaaatatataaataaatagatatgaaacctgaccataacacccctcccctactttgctaaaatgtattatagcttcccatcactcttagaataaggaccaaaatccttaatctggtccacaaatagtctgaccagcactttggtttggccaagacagttctgtttcccacccgctgtcccaatgaattatcccattttacatgtcagcaccctcaaaattgtggtagtttagataataaattatggtcatcccacagtgagctctggatggtctggtcctgcctacacagacctgtggcttttgttttacacctgtccccttctcggtctgagcccctgtgacacagacccccttttagtcctcaggatgggaggaggatgcataaaagccacaagacctttgcacatgttgttgtctccgcttggagtgaatactatttcttcccccttcacaccctctccctctctctccttcccccttcacctgtcagctcctacttgtcttagctcagagaaatcttccacagactagatcacatctctctattaaatgccctcaaacaccctgagccacatctttgaattgcttattacagttgtaatttgacatctgtgtctatacatgaagagtgagctaaaagaaggtaaggcggagtatttgtgtttgtagaacatcacatccccggagccagcatgaagctggtggacaattactttatagttatcgactgaatggatgacagcttagttgatgggttcataaacaacaaaagcaaattggttaatagcttcaggaaaaaggaaaaaaaaaataaaaaccactcacagggttttctctgcagactggtacccctatggcccatttaatgatttaaaaaccaagctttggaatgagacgggcccaagtgtgaaacttggtacttgtaaactgaggacatttatgccagtaatataacttctttgagccttaatttttttcatctgtaaatagtagtggtaggagtaatggtaatagtgttaataataaagtcatctactctataaaagtcttatgagggttgaatgagaaaatgtaccgtgcttaacacacacatcattaggtaagtgttagctcttattactatttggctaaaggtgtttcaaagacatcatttcctctgtgtctaagatgatttccttgtttcctaaaagacacacaaggaggaggtaatgctcttcacctggcatggctctctcctcacctgtgcccccaccccaggacttccccatcctcctgtgctatcctccttgcagcaatccaggccaaacctgggcacctgccagaccactctctctcatgccacacattggatctcaggaaagcatgtctgctttctcctcaaaatatattcagtatcccaccactccccaccaccccataatcaccacctccaactgccagcttattgcaacagcttccaagtgggcctctcttctctagcctttgtccttcagaatatcctcaagagggcagccaaaatgatgctgttaaaatgtaagtcacatcatgccattcccttcctcaagcccttccaaggttttccattttctatgaaaaaaaatgcaactggcctctggaggggtgacaggacctgcaacctgcctcctatcttggatcccccatagctcgtcacctctctccttcaggtattccctcaatggagaccctgtcaccatcacccatttaaaacctaaataaccaacaaccttcacactctgtatccccctccctgttttatttctccataactttcattaccttctatacattttcgttatattcttgatagcccaactccctgactagaatggaagccccatgagggcagggatttttgtctgttctgtccttgctgttcctctagcatctgacactgtgcctgacatgcataagttgctcaataaatacatcttgaatgaatacacaaaagaataaattaatgcacaaatgcaggaggcatcattgctctcagggcaagagctgtcctccacatacaatttgggatacgttatgaggcatagagaagaggtctgaaggcctttctagagtgtgttgggtagaggcaggggaagaggagaaagaattagctggggtgggctatctcttagcctcctgaaggctaaacagacttgaccctgacattagacttgctgagtggctgagtgtagtggaggcatggggatgggtggactgagggctgagcaggtacaagagagcatgtgttcacattcagagaatgctctgcccaggtgggcctgccagacagagatttatgtggactgccaaaactcagggaaacatctgctggagaagactctggccagaaatcccactggcctgagggctaacatgaggcacttttagtactagccaagctcatttcccattgtcaatttgaatgaaatttccagaacatgtactggctcaggatacattgtccagatgttggcaaaataaaagccaaaaaggaatatttaaagtcggctgcttctcttgtgactccacagctcttttgccaaacatgcaagcttgtcttgttagaagctgaagcctgagccaaggtcttgggtggacaggacttgaaggaaactttgggccatattcaaacaatcttggactgagtagtggtcactaaattctccattagaatacagctattcacaaactcaagggaagtgaactgcgaagcaaaaactcagagcattagtattgggactttgtaaaatcagcctgcaaatctgaggaaccaaccatgctagtgtcaccaaaaggcatgaaggacatgtgggaggaagtaatgggattatcacctactatctgagacagaaggcatttttggagtctttaagactagaaggtaccttagagaccctctgctcccagttttccatatctatctctaccctggacttctgagctcagtcctctataaaagttggccagagacggtaacatcagggcatttgctgaatattgaagtcacatcaacctgacttctcctcaatttgatatagacaggagacagggaaatgctgggtagaagagggtggttcccagcaaaagccccaccttcaagcatggagacccatggccctaagtgggaacaggcatttgtttttgtacccaaaaagttgccttttggcctgagacacacccctatcctgtcacataaactgcaaaccccaggctccagaagcagatgaggtggtgagaaaagcagaagaacagtggaatgagacagcaaagaaagagagaagaggaacatctcaacaatgagaggctcagctggggatagtcagaaaggagttcagccactggacagtcaaactcctggggaagatcatcttccgactccatccccacttccagctccccatccatcccactaagagctacctccaccactcagtaaaacccctatccatccttcaagacctgcttcttccaggatgctggacaagagctcaggatacacaaagctgtcacactggccctctatccctgcaaaaaggcaaagggtccattgaggtggttaacactcaagccatctgtgaatggcaggctaaaagagcacactgtaacacacagctacttgggctcctgcacctgtctgcatgtttcccctcccctcaggggtttgggcagtgaggtgacagaacaggaaagccacagccctgtcacacatctcccatttcaaattcttctcccctatatgcattatataatacttaactcaatcttcttctttagagacaaacttcctttcctatctctggtagattagttctcttttttttttttcctttttctttcccttttctctctttcctttttttttttgagacagggtctctctatgtcacccaggctggacttgaactcctgggctctagcaaaccttccacctcagcctcccagtagatggggcaacaggcatgcaccaccatgcctggctcagttctctttttgattcttgcctacagggttccctgttgttatcattacatatcatgttgggttaaggaacaaaatccccatcaggcttggcctgggggattcttagcagttggtctgacacatcacccaatagataagaaggttctaaaggagggaattaaattgtctaacatcacccaacttattaacgatagaagcaatttcacagctcaaaccctctgattcttaacagaatacctctaccaaaattatgaggataggtaaaatatatttacttctattttttctagtttgtgcacaggactataaataacttctaatacattaagacattaaagttatacaggaagcatcccaaaatcttagaaaataatgcttggtcaatagagcgccaaatgcacataagacacacaaaaagacattctaaagaggatgctaaaattaccagaatcattaactagatatattctgagtttctatataatgtcatcatcttagctgaaaaataaaacaattccaggtggttaatatggtgtggaataaaatatttacactttttaacatttgtatttaaaatactcatttgaggccttcacatagaatcaaaaatagaaatttaatggttcattgacctttatatttataacttctaaaattctggataagagaatacagatattttatccaaatgaaatcgtaatctttttgtagcttaagttttctctggcttggtttggtaacagcctgttactttacatgagtgattataagcctatcttaaactgtagccattgccctaaagaaaatgtttatggcctgactgggataattgtattctcctattaaatatcactccttcagggctagttactgttgagtataaatgtgccactttatatgcaaataaaatgtcctgagatttgaataaaaagttctgcatatacctactgacaaatcaacttattatgattcatatcagcaaacagaacttctcaagatataagatgctaatattacatacaacaagagacagttctttccttgaattttgttttcaaaatgttcagatacagctggaaatgtctttactcatagatatagcagattttgggtttgcattctgagtttcatttttagtcaaaagatcttacggtattgtgattacttattgccaaccttttttttttctttttgtatattttagtctgaccttgatttgtcttcagtccttttcccatatacccacatacctgggaaaaatcaactttttctcagatactctagcgcaaaggccaactcaaagttcagcttttccaagaagccttcttaaattcgacctaggaaagcatagtttcctcaaaccttgcgtgtggagtataatcacctcacatatttgcattttctttttatttttttaacctatcatctctgaatttgatctttgagcaaaagtaccctcaggaaaactatcattttgctgttcacatttgaaggagcagtgtttttgttttctgtttttttttgagacagggtctccatctgtcgcgcaggctggagtgcagcggcgtgatcatgtctcaccgaaacctcagccataaggcttcagagatcctcttgcttcagcctccggagtagctgggattacaggcatgcaccaccatgcctggctaacttgtggatttttgatagagatggggttttgccatgttgcccaggctagtcaagagctcctggactcaagcaatccaaccatctcagcctcccaaagtgctgggattacaggcatgagccacctcgcccaactagaagcagtgttcttatatctcaaatcccatctcagacctgtgccttgtgtttttaacaacctctcaggggtactgtgcaacaactcttcagaaaagcaaagcaaaacatattatgtgtattggggccctgtctgtgcagagatagtaatatgagataaacatggatgatttaagggagaaactatataaagcatttaatccccattttctccactttccctacagctctgctgtccttgcctggagctgtcagaggaaaatgggagaattcaatggcatgatgttgaaaactgaactctgattttctggccaatccatctacttccctagagttaaaggattcataggtgaatgggagctgcaggaccgtaggaaaggacatctttgggttatatcaccaaatcaacacaatattgcatgtttgggaagttcattgcttttgttgaaactttgagaaagcccaatacccaacaagaagaaagtcattcactcaggagttaaagctaaatacttacactttttgagaaatacctaaaattttatgattggggtctattgtacttcttaattagaatttagggctaacaagagatattataacatcaatacttgcattatatagaggaggcctttaaactactgtctagggaattcagagagccatgttcctttacaacattccttctcgtgcaattcaaagacaattgatagctagaaaatgtcaaggaaccaagattcttgaccaacttgaaaagcaagacttggataaatggcattatgagatatatttgcactaattgtttcaatttgactgaagtatgtcatctctgctagattgtaatttccacaagggtgaggctcatgtctgcatatcaccccttatttatactcagaagggtccctattacctagtgggccctcaaaaatatttgatggatcatggaataataaattaatgcatgcttgcccgaccctaaatattgttctatttcttgtagattcttccaaaattatagtcactcaatacttattcctattagttgggtcacacacatacacagacacacacacacacacacacacacacacacacacacacacatacacagaggctaatgtgaatatagggtctttccttatagcctttaaaatagaataaattcttatgtgcatttaataacttagattttctgcttgaaagcaaataaatggagtaaatcagtcccaaaaattagaataatttctgtaatacaaaattaaaccaatttaattaacattttaatgttaacaggacacagctaagatcacccttagaataatgaatctatgtaaagatcttcatggatagaaaaggtacaaatgggtttgcatgaagcttgtacctacctctgatatttgggacaaaagagatgggtcactagaaaggtttctgctttagaaatgacctccttatcaatctccttgtttttaatcttgccctataaattccattcttcaaaatgaagtcagagtatctgttattatctcaaatgtagcttccttgcttaaaacacttcagtacttcagtagtcctattgtcttagagcaaatttttggggtcatttcactggcataaaaggcctgacctaaactgtgttcctttctacagatagaatttcatttcatatcactcattgccttgagctatgtgctgtggtaataccaaagaactggtgattaccttgctgaatacgttgcattaattcaagcctctgtacttgtgctcacactatttccttttcctggggtgttgtcctcacctgtcttccccttgtgactccttctcccattaagacttatcaagtctcctctaggaggtatttaaaatggccttctgctatggtccaatataagtctgcatacattttattatttgctgcattacattgaaattaaccagttacgtatctgtttcttactctagactctaagtattcccattacacctctttatggttatctttatggttctagctcccattttgaaatcagttattatcccaataaaatcaataagtgttgaaccaggctgagtgcagtggctcacacccgtaatctcagtgggagtttgggaggccaaggcaagacaatcgcttgagggcaggagtttgagaacagcctggccaacatagtgagaccacatctctaacaacaataacaacaaaaagccagggtatggtggtacatgcctatagtcctagctactcagtgctgatatgggagatcacttgagctcaggacttcaaaactgcagtgagctataatcacgccctgtgccccagcctggacaacagagcaagaccctgtctcttgaaaaaatgtgttgaaccgcactgagtatataacattatcttgttcttttgcccatctccatcatttcaatgttctgttgtggcctgggagtttccagaaagtaacattctcttttcttatgtgaattgctgaactaaactactaatattcttcagaattatagagtagtaacactataaatggctgttaacaaaagccatatggctaacactgacctgttactaaataagagtatattgaggactcaggtgggaaaaatattcaagaattagttagcttcatgtgctaatatttataagaaataattacattgcaagaaacgtgttaaagcatctcagttatgtttagtagtaactaaacttgacactatttgcatatttggagtacttctactgttttttcaacttaagagctcaagcaagttttatacattcataaaaaattataaaatcatttctttatttcaattttcaaggccaacgtattgtgtagactttcttataattgttacaaactcagaaaaagaaagatttatgaaagaaacattgacattcctttaacaatggtagttttagcaggcaccttggtattatcagatattgcggctcccagtctccagtttccagataatgcagtgacttaatcagtcctctctgaagtgcaaagcaggcaatcttctttgtcctttgtgcatttctcacgtcttacaactgccccacttcaatattcctgtgtgtcacctaccccacatccgtcttaccctatatcactattctttgtaatttattctgggcttagttttgttactacactgaaatcttatgcataattatgtgaggttgctatggagattttgtgtgatttgtcatgaggaaaacctattgtgtttgagatgattctccatactaatgatcaagaatccatttttttgcccatattttctctgggattataaccaactgcatatatttgaatatctataagcaaaagttattctataaataacataagcagaaaaaagttattgaattcaccattaaagtgaagcactttagtgcaaccagttcaatttctcatgatttagaaagaacttctaatgtaactctttttgaataccagctgaactcttgcctgaatccttttagaagagaccctgaagaagttattctataatcacatctcttaaaattctgtcactaatactatatatttggctatacaataacttgaaaatgtaattttggagaatctgtgaaactattgtgcaaaattaagagaagatatagccaccttattcgaaaatgtttattcataattcttcaattatacagactttttggaggtggaaactgagggcgaaattgattatttggcattagtcaaaggcaattcagactaaagactgtgattgaacaacagaaggtaaatatcacaccatataacaaagtcatgattttatacctctcttgtctgaccgccccaccaccagcctaggatgaggaaaagcatgaaatatcatgagacaatgcacatgaatctctcctttagcccccaggtcagcaaagctaatttcaggatcatgattgatttttagagagaaacattcccaattcaagtaggtagaagtttcccaagcaggcagaagagaattgtgatgaattcggcagcttgtcatcaggaaagtggcatccagaggataaatttagaagttaagaagtgaaatctcaaatcaaaggcagactaattatagaaatgttttctaggcaactatttgtctgaaaacacaactaaattaccaatcatttctggaaagagtgtgtggttttcactcatgataatttgttgccatgggtacccagtgtagaaatctaacaggaacagagatagcaagtaaggagaaggagagagaggggctcagtgagatgctctggaagaggaagatcatagtcagtgtttgcgtgacaaaggactccaattcagtcgactatctggtaagtctggacagcaaaggagtcctttcattgtcttcatgggagccaatgaagtaccctcctcccagaagccgagaatagtctatactggacatgcaagtcagtgtctgaaaagtgtcagagcaggtgatagatcttaagggattattctctatactacaattgattcaaagggagaggagcttctggaaacaatgaatgatcatttagggaggaaaataggagaacacttttgtaagaatataaaaggaaaataatacctgccttaaaaggctggtgagtagaagatcatggctaatcaaattagagtggagaaggaatttagcttcagcaactggaaccaatacatggtttgaaagtcttcccattaaaaaaaaaaaaaagtactagcatatagggaagactcacatgataggtgcaagaaatcaatgggcagacccaagcaggagacaaggacctatgctggtgactggagaatcttactgaggtctttagaggaagtcatgggctcctaccacagggttaaccaaaggttgtggcttttctaagagaatgcatcagagatgagaggaggagcttcaccagcccacaaccaatgtaccctacttctaattcagagaaacttgtagtgagatctccagtggctttggaattctgcatagaaagctagagaatgtgagcgcctaagtagccatgtccagttgaagaacaggtaaaagggaaaggagggcaatttggagaggaagaagatgtcaaagtattaggttgtcttgatcaatattccttaagcagagctgcaaagatagatcctcagggatttcctcaagacccaaagtcctattttcatggtttcacaaagtctcaataaatatctttaaactcttaatctcatttcagtggcattaaaataaatactaagcatattctaaatgtattagtgaacaacttttgactgaatactgccatgtggtccagtgttctttgcacttttatttatgatgctcttgttaaaagtgaagaaaacggacgtgagcttaatggacaaatggaatattcctgccacaagaaaaggccaaaatgatataatcccatgttaaactaacagtttgtagcttgatgggttgaacattggaaagacaattgggttgtcatccattacaagagtctacaggacagccaaactcagaagaacctgctcctagtggaaaagaccattaacaaatatgcaaattgcaaataagtctagcaaatgtcttagcaaaatagcaccatctgttatattaaatccagttcatatatttgatttctattggttttatagttttgaatttataaatttattttgattctgcacttaagaaagaactataagcataaagagtgtatggtaagaagaaaaataatcaaggaattgagagaagcataaatctgtttaaaaaatgaaaaaaaaaacagtgtaaaaaagtctagagtatgctgtggcttacaaatactgatgacatctatagggagtgttaggttaaggctgtgtttcgagccatatgagaacaaggatgggattgtcttattgcttgaagccgatgatgtaatgctaatagaagccagagagaaagcagaaccattcaacttctatattgcttccacctttgctatcaagacaaacgatcaccgtgttgaaaagaagaggaaaacatgaagcccaagacaagtgaggagatcccaagggagatcagcaaactgctttgcataaatccaagtctcagcaataaatgacaccctggggtaatgaaaggacttcagctgagactgtggaagtttgctggcaaactctggggaatcatgatgagtcagaggggccccatattaagaacagaaaaatgtgtttgtttgtttttagaacatgtcaggagtttttaatttttaaaatcaaaagaaaaagctgcatttagaagttacaagtcagtttttagtctggttatcatgttccctcaaaaatatttctagaatgcaatgttttaaaagagagtgtatgaccatctagaaaagaaatcaatggtcactaggagttacaggggcttcctaagataaactcccattcatatctttttggataaaggtaacaagactgagaggcaaagtgaatctggattgcagccagatatgtaatcatgtatttctttgttgttgttgttgttgttgttgagacagaatcttgctctgtcgcccaggctggagtgcagtggcgtgatctcagctcactgcaagctctgtctcccgggttcacaccattctcctgcctcagcctcccgagtagctgggactataggtgcccgccaccatgccaggctagttttttcgttttttgtttttttttttcggtagagatggggtttcaccgtgtcagccaggatggtctcgatctcctgaccctgtgatccgcccgcctcggcctcccaagatgctgggattacaggcgtgagccaccgtgcccagccataatcacgtatttcttgataaccaagaagcaggctatagaagtggggactagatgatcattttgtgaggtaaaattgaggaggtacaaggtggttgttctctgcctaacaactgtgctgaaatagtatatcatgaaaagcctgggcttcaagtcagaaatctgagtaactctttaccactgactagttcggtggtcccacaaatctaacccactgcccatttttgtaaataaatgttggaatacagccacacacaatttttttttttacctattgtctgtggctgcatttgtcattcagtggcaaagttaagtaagtagttgcaaaagagatcatgtggcacacaaagctaagatatttactatcagcctatttacaaaaagagtttgtcaattccctgactagttacataaacaactaggatgtttcataactttacttatactcattttcatcatcgacattaatctacattaacagaaattgattactatagcatagtgcttcaaaggcatctaatgaaataatgtatgggaaagctccttatggattgtagtgtgttgtacagagataaggcatgtcttatgatcactctggctactgaaagattaatagcaatattttcatgttaaagacatgccaatctccggtacaaagaagactctcaaaaatactagatggacttttggatgaatggatagatgggtggatggatgaatgaatgaatgacagtagtaattatacctcgcttatcactggctatgtaacagggacacatactgttttacatgtattaccttgtttaactgttgtaacagacttgtaacattatttacattttgcttctgagtaaaagagatttaaacaatggcaacatcatcagaagcaataacaaatatttatacaggacttatgacatttagccactgtgataactacttaccaaatattatttcatttaatccctcaattacctcatgaagtaggtgttggtatcatcatcatcatcatcatcatcgtcatcatctaatcatcattattattccatctttattgatgagaaaatagaggttcaggaaaactaacagacttcccaaaatcaggcatctggtaagtggcagagctggaattcaaaaccttgtctgcttgactctgagcttttaaccatcagacactgagacaatggatttgcattgacatgactcaattttctaaagataaatgtaatgtcttattgaaataattaaatattcttgactctgaagtgctctgaccttacaacaaaccatgaaaactagtttttaaaggactttttatgctgaactagttttagacttcaagaaaatttgcaaacatagtacagaattctctttatatctcccatccagcttcccataatattaatatattaaataaaaatgacacaatggtgagaaccatttagttgtcatttctccttagtttccttcattcgctaacagttccttagtccttccctgggtttcatgttctcgacactttggaagaatattgattagttactttgtacagtgactctcaatttgggattctctgattttctgtttttcagaatttgactgaggctgtgcagttttggcaagaatatcacagaaatgatgctgtgtgctcagtagatcacagtggagctcgtgaggtcattgtgtcttttttttttctttttttttgagacagagtctcaatactgtcacccaggctggagtgctgtagcgccatcttggctcactgctgcctctgcctcccaggctcaagcaatgcacctcagcctcctgagtagctgggactgcaggtacatgccaccatgctcggctaatttttaaactttttgtagagatggggtgtcactatattgcccagactgctcttgaactcttagactcaagcaatccttctgcctctgcctcccaaagtgctgggattacaggtgtgagccaccatgcctggcctttataatttgttttaacagactgaagtctcaataaactgacaggtaccctagctagaaacacacacacacacacaaacacatacacaaaacctcatgagagttttgactgtgttaagaaattcctgagaaccacaagcaaaagtaacatcaattctgcctttttctccaatgacatggttactgaaataagcactggttagcagaggctgagggcatctggagtttacttcctatttcttattgtttccctactagctggcgaagcacattgtctgatagaaatgaacttttggtgtatgtgtatctctgagccccatatgacaaagccagcttgaatcatgctccaaatactcattcatttccttgtatatgccaggctagactctggttgcctgtcctacctatgagccaggatcattggatgataagcactaggaaggtttttctagaattctgccattatacttagcctacacacacacacacacacacgtatatatacataaaacatattgattctatattaagattgaaagacataagtcccatgaaaataagggttgttaattttctcacatcttgctctgctcagctatagtcaatttaaaattgcagttgaatacaaagagagtttgctgtgaatacattgaaggccattgctttattcaggtgggcataattacagagaccataaggagactcccttttatttattgatctgacttctataagtttcctggatttcaacattttttcttgtttagagatatactgtctgaaaactattcaatttgaaatgtgtccactgtacaattcagtccttggaaaaaaagcctttagtaattaaagcagccatggtgtacctgctggcactaaaatatccctgtaagatgttagccatcaatatttctatagaaaatgccttattcaacaatatgctcttattatttcagttacagacacttttgtaaaagcacacatttaaaatgcacattaaaagaataggggaaaaattgatggtttgtcttaaaaaggaaaaacctgcagaattgggaaaaatagttttgtgagcacattttttgatagttgtattttttttaattttggacaaccattttgagtaacaatgactattctgagagcctatctctgtaaatctcttatcaatagtaagtaaagaagataaagtcagatgttgattagatcatatttttaaatattggtgatttaaatcttaaataaatatttgggattttgttgttgttgttaagacagagtcttgctctgttgcccaggctgcagtgcagtggtgcaatcttggctcactgtaacctctgcatcctgggttcaagggcttcttctgcctcaacctcccgagtagctgggattacaggcacgtgccaccatgcccagctaaattttgtatttttagtagagatggggcttcaccatattgccaggctggtcttgaactcttgacctcaagtgatccaccagcctcagccccccaaagtgctgggattacaggcgtgagttactgcacctggccttaaaaaaatatttgaatcaaatattggcaactaaataaatatgtttgggtaaaacctattccaatgcttaaaacattataatgtgccagaaaaattatacacagttcataagagaatatttgttaaatagttatttttgatttaatgtgactcaaaatcagaacttaaagagactttaaaagtcatatggggagtaaattggtagaagtgtctggaggataatctgaagttgcaaaaattttaaagtatatgtgtgacacttctgcttgcccaatttatcataaggaaatagtaaaacaaagttacaataatgcccatgaaattacgttcaccacagttttacttatcacgtaaagacactgaaaatgacaccaatggcccaaacagcgattggctgataaactttaagacaagtagtctcaagtcccacaccttcaaccttgaaataaacctggacttccacagattctttttaaatgctaaatgtgagctcttgttcatctgaccagaaaagaaaaccagaacaaaacaacagcagaaacatcaacaacaaaacccttcccagccgaggagcggtggctttccctgcctgaccagcagcctgggttacagacctgacctccttggtatcatggaacctaagaaattattggctattttctgcagctgttttcacaaagccacagcggaggtgaccttggggtggggtgaggcaggacccagcagacgggagctctgggcttcccctccagtgagagtgacttgaatttcatctcagccacaactggttttctaggtaagattttatttgaatatgctttctaaagccaaaaaagaaaatataagtttaaaaaccactactgtaccacccaacaattagttgttgttattgttgttgttgttttttcaaattagctcaaaccaggaaaacaaagtgctgattttagttacaaggattatagatcacataagtctggaacaggactgccatctcttattcaaacccctttgtaccagatgaattccaaatactttgtatttgttagatagttaatatagaacctatatattatgaaacacccctagcaaacatggaggcagcaactcacactcaaatacattaatagttctgaagtgagtcatataaaaattcacactagatgaattaaataaaaatttaagttacctcatatcaattcatatcagactttttaccaactgagttgggccaaatccttaagaaaattaaagaaacaaacaaacaaaaaaattggctttcagagctttttggatgttaggattgtggctcaggggctgtgcacctgtgtgatgcagacaaagctggagttcatgaggagctgcaggtggagaccccagcccagccagatgccccccagaactgaagtcagacacgtggatgctcacttgggaaggcaaagagtaaaattcaaagctccatacagaaggtagaaagagctcatcagagaaaacaaattagaggtcacatgcccttttcagcagtcaatatatatttctattctttaaaacacattttccaagaaaaggactatgtatactttaatattcatacaatgccataataatctggtaaagtgaaaatatgtccaccttatatgggtaagtgggaaatgttgccaaaaactatttttttctattagatagatcccttacccaagtgtgcacatgaattttaaaaagatgctatgtaaatggataaataaccaaaatgttaacagtgcttaatttcagggagtgtaaatttgctgatttttatttttattttatttttccttttctaagtgtttctgtattttttgaataatgagaaagtatgatttttaaaaaagaaaaacagaactctttactcttggtgaaaaatacaattattagcggttcacatgtaatttagtccctcagggaccaagtgattcacctaaagtcacattgttaatttggagaaaaactatgcttggactcaaggcctttgactccaagccttgcatcctctccatttctccaggctgcattttgaaatgaagcatgaaggatggcccctgccttcaaagtgctaatgattaagttgaggagataagaaatataactaggaagcaattaacaaacattacaagatgctatctatttaagtaactgctgcaaatccttttggaagtgggaggggtcatctaaatctcaaataagagaatacagtataacattgcatgacacgtattgcaaattcctatgaattcagaggagtagaagataaaacttagtagtcccagagaaggctctactggtaaaagacagatacgctttgaaaaggttaaggtcaggaaggatatttgtttccacaaggacatatccagacaacaagaccactgattgatggtagaaatagttctctgcatatgctagagagtaggagaacaggactggacaggtggagtaggcacagtttacagaaggctttgaaactgaaaaataagaggatgatttagaaatgatgtggaaagaaataggagccatggacagctttcatcgagggaatcacgggtgggacaaaggcacttaaactgcatgaatgttccagaagtggcatgtagggtggataggcaggtgaggatgatgtcgtggaagtcaggtgcagaactatcgaagcaatgtctgatgttgggcagcagaaattcacaaggaatcaggatcagacatggaagcagaaggctgagtcacaaagatgccaaggtttggaatggatgtctctgaaaacagtgatgacctgacagagatagatgatttaagatggggttcactatttcagaaggcagagcaaagagtaaagaaaacatgaagtgctcttgttcgttaaagttataactgtttagccatgtaggtttgagcactaaggccaaggggctaggttcaaactttcaatttgcaatgtggcttgattctgttctgatgcatcagccatgctcctcttatttcatgcaactatagcaaacacagggggattaaaaatagggaagacagacaagtcaataccaattataggaaaatgatttcataaacaagcaaaattcatccaaatatgatcaagtaagaacatgattttatatggcttaaatagcatctaaatgttttctttcgatttatttgtgcgagaaaaaagagaggttataaatatagaaaatggatgaaaatacaagtagttacatcttccctgtgtctgcttaggcattctatattttgcttgaagtgttttttaagaaatgatttatcttcattccatctgccctgtcagagacaccttggttgggtcagaatgactggtttagctgggaccccattgcctctgaacctttaaacagacagcgctttgaatttcatttcagagatcaggtgacatccaaatccacttaatgtgtaactggtatggtttttgatgtcactggagaccctgatgaaattacaatcctattagtcatgacgggggaagacaggagaccttaggtggctaatgttccattcataacaagaaagagccatttagcatttgtaaagggcattgatttctgatagttccctaaagaacaaggctcaagtgaagaaatatgaccagaaagagcttgggaaagaaatgatagaaaaggcaagattgcatttatccaaacagctttactctgtgtactttttacaacttcacttgaatccaaagaattgagtcttcatgtaaaagtggatatgaggaaggacaggaaggacatgctcagctacacagagattctgttactgagaaatctggggaattataccgtgcccttgattgataccaatgaggtgcctctaaatataaagggtaagtagaggttatgtggaaaaagggttttaatctgggtgataaattgccagattccattatgcttaatgagtctcatcagtgcatagctagactcaagaaaataagacccctttcaaagcctagtataagcaaattagaagaattaataataaaaatcctattaatgtgtatgcaatttcaagcagttaatgaagtcaatttaaaaagtttggctaacgtattttttttttttttgcattttttaaaataaaaatacctgatcatcaaaatagatttgttcttcaggattttttttctttttttcccccaaatatatcctatgtaagacttaaaggattagatttcctttggtttactcttctccagggagggccctacttagaagttatgggatatgacaaagggagtgttgcaggtcttcaaatgtataaaatgcttattgacctgaaagttacaaatgagattcattcaagcaaatttgccaagcttcataatatccctcctaagcaaatggcgactacctgaagaaaaaggttctcagtcacctgcctggtaaaacataaatctttgcttctcaacataaggtctcaggtaggaaataagaagcagggtctacaaacatctatgtgtggctcaaaacagcagtagttgttgtctctgaccagctaagaccttcagtcccaaataacagagaatctgctggatttgcaccaacaaatttttgtgcaataaaccatcagtcatgggttaaaaatcagactctcacttcttgccaattggattcttttaagccatcatttagaaaagaatctccatactcaagcatataatcaaagcatgtgggagatgagaaaaaaggtagcccctgttttgtagttaaatccctaggcaagaagcacaatcagacatctgtgcgtatttagatttccatgaaaaggaatgccatgtgctccttaatgccatgtgaaataacataactcatggttttcggatggcacccaggggcatggagagtgtaatgatgtccgcttcagaagttaggaacacacttgtgtgcaatgttacctagataatagtcacagtgtctggcacagagtaagcaccctataaatatttcttcaactctgaatggaagagtgagttctttcatacacaatctgctatgtaaagtttgtacatcctctgttttgttacaaaaataatatatgttctcactagcttgtggtttaacctctgaatcaatgaagaatgggagccactccctcctcaatttttttccttcctgggctgctaatgtgctgcccctacctggttctacctccatacctcagtgcttccttactgggcttcctcttcaaattacttgtcgccatcccaaccctgtttattttcttttacattttctaatcaaggattcattgagttgtatgacttcaacaaatgcctttatgcaaccgtgccctgaaatatttacaagcttatcattatactagattctgtaagggataatatagtttagtaagaagtgcactcatatacttgaagataaatgacaattttatggccaaatgattgaaaagatgcagaactatcattagaaaagaaaaagagccctgttgtttctggcaaaggatgtgagatttgagtggtccttgaaggatggatgagagtcatacatggagagctcgagaaggagaggctatcaggaggtcaactgttatgggcaaagacggtggtgatggaaaactatgtggctggtttggggtcaatgaggagactgctgggtctgccttgaaggtttcattatagaataatgggcagtgttgtggaaagacaggtggacccactctggaagccctcaaatgcttgattaaggaatggattttatcccatgggaaaaatagaactatgtgggattttaagcctgtaagggacttaataaaatgattcctactgactagaaggttctttctcaacatctcctcactgcaagtccattccaaatcccatgtttctttttcctttgtccactggcttaattatttctgtcagtgttaacagcatttttcttggactcaaaggctgttatccttgggaatatctttgaggtttgtctccaacttcaaaactatttgagggttcactgaccaaaagcaccttggtaatgctttaaataaatacatattcctagaccctgttcgagaccaactgtatagtggtagattttaggacccagatttctacctcttacagaatgagtaaatctttgctaatggttacttttcctttcaaatatctgtcaaccttcccatttcttttcaaacctactgcagtcactgtaactcagaacttccttatccttgactagttactatgacaggcaccttctgggttacatccttcactctaatatcagcatcttctttacagaactcatttggactccaggagaatagcaacataatcgtaattcagatcagtggtactcagatgtttcagtggaggtgattctaatgcaaacttttcttcaggagggaaataaaatatttaggtatacatttggcaaaaatatatgtatctttttttggatgggggatgacagagtctcattctgttgcccaggctggggtgcaatggcatgatctcagctcactacaacttctgcctaccgggttcaagcaagccttgtgcctcagccccccgagtagctggaactacaggtgtggccaccatgcctggctaatttttgtatttttattagagacagggtttcaccatgttggtcaggctggtcttgaactccaggcctcaagtgatccacccacctcggcctcccaaagtgctgggattataggagtgagccaccacgcctggccaatatatatatgtactatctacagggaaaactacaactctgatgaaaaaaatcaaagagctaaataaacagagagatattccatgtttatggatagaaagactgagtattgtcaaaatatcagttctttcaaacctgattcacagattcaatgcaatcccaatcacaatcccagcaagttattttgtgcataatgacaaactaactctaaaggttatatggagaagccaaagaccctgaatagtgaaaaatatcgaaggagatgaataaaagttgaagaactgagaccgtctgacttcaaaatgcactacatggagactcaaatcaggaccttgtggtactggcgaaagaatagacaaatcgattaatgggacagaatagaaagcacagaaacagcacagaaacagacccatataaatatagttaacttgtctttgacaaagaagcaaaggaaatacaacggagaaaagatagtctttccagtaaatggtgctggaacaaatggacgttcacatgccaaaaagtgaatctagacacagacctcacaacatttacaaaaactaattcaaactgaatcacagatttaaatgtaaaacacagaatggtaaaaccctatatgtaggatagtaatggtgcaatcacatgcctgggtatttacccaaaggaattgaaaacttatgtccataccaaaacctccacacagatgtttacagcagctttattcataattgccaaaacttggaagcaaacaaaatgtttctccataggtgaacggataaactgtggtacatcccagacaatggaatattattcagcactacaaataaatgggctatcaagccatgaaaggacatagaggaaccttaaatgcatagtactacatgaaataagccaatctgaaaagtactgtatgattctgactttatgacactctagaaaaggaaaagctatagagaagatgaaaattcagtgttttccaggggataaggggaagggactgggcacagaggatttttagagcagtgaaactactgtatattgtagtactgaatatatgtcattatacatttgtccaactcatagaatgtacactaagaatggaccctaatgtaactgtgaccttgggcgaccatgatgtgtcaatgttggttcaactgaaacaaatgcaccactctagtgggagatgtcggtgatggggtgaagtgcgtgtgtagggcagtgggtgggggatgttggtgatggggagaagtgcatgtctagggcagtgggtgggggatattggtgatggggagaagtgcgtgtgtagggcagggggcatgtgggacatctctgtaccttctgctcaattttgctgtgaacttaaaactgctctcaaaaatgtctactaaaaacaaacagaaaacaagcaaaaaccctacttttctctgtgctgttggtcttcagagaaaggagcggcatcttcaaagtatagtaaaagcctcacaactggagaagtaatcagcatcaggaaagcactcactaaactttctgcccaaggccaaattaactgtcttttctgcgctccgaaatactcagaagactcttgaaattccactgagtatagaacccaaagccaactggatttcaaacaattccaagttcacaaactcagtcagtctgtccctgcgcttttcttacaatggggaagcactgccaagccctgcagaagatggtgggaagcagtgcttatctggtaacggaacacctccttaaaatgaactctttccaggttgaaaattcccctgttccaacttctactatcatttgaagtgatgaacacaaaaagaaacacacttctccccacaatcttgtcctgtctttggcattttagagcttatccaccatagtttcttatgttccaagaaaattacattcttttggtattcttctagggtgttagtaatgtcttgaggaaacaatgtgggttagagatgatcagaacactgtgacatgagccgtatgaaataaacctggactatatttaaatgtctgaaaaaccggataataacccaaactggataacaagccaatatttttttaaacttttattttaagttcatgggtacatgtgaaggatgtataggtttgttaaataggtaaatgtgtgtcatgagggtttgctgtacaggttatttcatcacacaggtattaagcatagtatccattagttatttttcctgatcctctctctcctcccaccctctgccctctggtaggcaccagtgtgcattgttctcatccccatgtccacatgttctcatcctttagctcccacttataagtgagaacatgaggtatgtggctttttgttcctgagttagtttgctaaggataatggtctccagctccatccatgtccctacaaaggaaattatctcattgcattttaatggctgcatagtattccacggtatatatgtaccacattttctttatccagtctatcactgatgaacattgatgaagccaacatttttaagaataggtgtataaatgaatacagaaagtcaaaaatgggaaatgggtccaatgtctgaaagataagcacatggaggaaagagagggcttcagagtgggcccaataaattcatgtcaaggaagtcagctcctgcaggaccaaatgcctggctaggtgtacaggaaacaaaagtgtggtggcatcaccaagagggtctgggcaacaaaatcaggcacaggtacaataaatattcagtagacatctattgaaagaaagaatgaatttatgaagatttaggtatcagaaaggaagaactgattccaatacatgatggctgtcatctcaaattgagaatattcaaacctaacaaaattaatacacttatgaagaccatgttatcagaaattggaaataaattccagtaaatgttgactaacaccagaaactcagtatgttcaaacccaactaaaaccatgtcagtgtggcatcaccattcagcccctcacacaaacaaggaatctgggaatcatcctcgactcctccttctcccccgtttgcccgagtcctcatgccaccaagtttttttgcttctacattctacatactcttgaaatattgccccttgtttccatcctcatagccactgtgattcaactgtctttatcaactttcactgagaccgtggcagtgacttcttcgtcactgtgcccagcttgggtctcatccctactaccaccactacccaaactgtgggctgggtaatctttctaaaacacagactctattacagcatacctttgcttaaacccttctggtgaccttcccctgtctacaaaataaaatggagagcatttgggccctatgtgcctttccaatctcatctcttgtcatttcccatcttgatcacactgggactagaaatatgaaaggcagaataacacaattgttaggagctgagccacagcagtgctagacattgccagtggtacctgtgtgacataaaggggacactgtcgctggtatatcccattcctataggaaacttggattcctttttagatgagtacatataaccttacagctctgtagagaggcccaaaagaaattgtaagtagtgtattcatttgtgggtaggaaaaaatgtctgaggtatcagaagtaatgtttttggagttccctgcataaaaggtattaggggaaactaacatacaaaaaaagaaaattcttacagatgagtgtcttgtctggtttttctgagtcatcacatttttttcctatacactggactctctcattcatttgtagccatccaccagacacccatatacagctattatttcttattttaggttaatattgccaagaagttacataatcaaaacagaaaatctgccaaaaatcccaaactgtataactattcatttcaaagccaaatataaattatttgagattagccaaagtttcaaattattatgtgtatcagtggattctgaaaagcatacaggctggaataagcatagtaaaaatgacagagcaagcttcttgaattcttggtgaatgctgcagcaaataattttgccaacaaccacacttcctaaacctcattaagcaagtaggaaagaataaactattccattaccattcctcaaactggagaaaaaaatctaggaggaaaagccaggggaaagcacccaacaaaagcatttcacctcaaaagctctaaggtagagcaatttgaagttagaaaaatgggtttaagtagctactttggttgatttctgcctagttaggcttccagtgaccccctaatttgcctggaaataatgcagagaccacctaccgtgtgcaaagcagtgtgacatttagaacaaaggtggcagaatctcaatgttcaaaagaacacataccacatgaggtaggggactcagaagaaggaagtaagaactgggctcacttccatttacttaccaggctagggatggagccatctgagggctaagccccaaactggccttggattcatgagaccaggaaaacccctgatccacacagggagcagtctaattggctgggggcagggctgctctcataacccaccccaaacagtggcagtcacaagcgaggacaaacttggaaggaggcagggcttcccaggtgtgttatatgaaccaccggctttttggaagattagacaatccccataaaaagataccttaatagctatatgctgatgtctgtatatattagaagaatataaaaaataaaactaacctattaacctcgtgatttctatgctaagttttaaaaagttgacaaagaaaaatggtaagtaaatgatagtacagatcttactaggatatggacacatcattaagattatatccaaatgagtgaagtttagaaaagcctggactagaccaaagagataagataaagcaagtccatggaatgaaaaaaaacttctaaggctaactctgaaaaaaacgtatatatgatactctcacaaatttttttcctgccttttagataaattacagacactaaacatctgaattatagtgtagactatcaaattttgtcaggacaaccagtttggaaaacctgcatcccacttctcagcttctatctgccaagttttgcatccaattgccccttccactgcatgcaaacctcaggtggggtgtgggagtgaagagtaacaggtgtaattaacctgcccacacttccttcccaagtctagctgttgcagcagtctgggagcatcccacagccagggaaagggtattgaagggaaagcagtatctgccacctaggaaattaattgaaaagaaggaaaccttcctccgttctgtctcaccccaattcagaacatgttaattgcagagaggctaagttcattaagtgctgcttaactgttgtctgaagattatcacatattaaatgtaaaacctaacagtcttcactcttctgataaaagtttgtaagagtatttttccagaagcccaatctggaatgattgtggagcggtgacttgttaaggagcttaccctgccaatgtgtatgtgggcactttgtttctaattatttcaataaacgagctttataagaaatcctagtaataaagtaacttatgccacagaagaataaatcctggtgctctcaatatccagataacataaccatgctattaagcactgcctcgtcaataatggtagtctttgtataatgatagaactctatttacataatacaccaacagtgcctaatgcaaaacagggtttacatataacattagttgaatttacagcatgaattcacattccacctttgcattggtcagaaaacattatttcacacttcactgctctaacaaataaattaataaagctcacctcatctccagtaaatcccgacgtgcatacctcgtgattcaaaataataataacctccagtcttgtccttgcatgtcctttgaatcattctcggagagacaatcattttctggactaccccaccctgcatctgaactccagatgtgttcaaactggattctggccaaagctagagaagtctcagggatagtgacgatctcatcattttatgtcaagtgaagggaggaaagttaccaggattttcttgttttccttaaaaattcacaaaataccaagtctcatctttctagggtaagaattcagtaaaacactccatgcctgtatctttacttgaattgtcagctccatgtggacaggaaccatggccttctcatttattcacttttctgtcccttagttcctggtacagacaggtgctcaatgcctgacacatagtaggttttcagtaaacacttgtggaatcaatgaaaaaccttactaatattgcatctcagattggagaaaatgatccaaggtaatgtcagcgcacttcaaagtgcagtaaaatgcagctgtcatttatgtatcagagactttatacccatccctgtgtaagatattctgtgagaagtaaataataaaaattgggatttatagtcagatgaagggaaacagcccagtgcaaccgaaataccagcaagtgaatagatgtatgtacataattggaaagatgttcatactattacaatatataactgtcaaaaagcaaattgcagaaatatgagagagggaaaaaaattatttttggcccctttgaatctcatcctgtggaacctaaaagcaaatttctccttttagaaagaaataaaaagatatttatttattccttctatgatatttatttgtatatttatgtgcagacagacagatgaataagatttatcctagtataagaaaaagtctaaaagggcacacaccaacccattcaaactgtttataacagtgctattaaatctaaaaggtagagtttgggagaagattttttttcactttctatttaatgcatttctgcattgtctacatttttttacagtgagcaattttttttagtaaaacaaaacaattagaatttttttaatgttataaataactaactacatttgtggtatatattgagtgttttaggagctcaataaaactttaattgtctggaatataattaaccaaagacctcaatcaaccagtatttttcctctacattctactcttagaaaaaaagaagcaaatcagataaaaataaattcatatcaagaatttatggagcagttgtatttttccaaggtaagtagctttagggtcttgtctaacttccaaacattcagctctaatgtatccatctccatgttgtctgtacaatgatgagtgttgttcagacctttgctattctatctgtgctgccaggcaagcaccttgtcaggatctcaggcccaatcagacttactgaaccagaatacctggaagtaaagtccaggaacctgggttttaacaagatccctaggtaatatgtttgcacattaacttggagaagcaccagtttagaagactaacccctgagttcctgcatgatcctcaacctataaaggaagacttattttcatcagattgtccatttaaaaatagaaaagtagacattttacatatactgcaggaagtgctaaacaatgttacccactgaacaaaattaactagacatatattgaaccccctcttatcccacaaaattgttggaaatgacattagagcacaacacagtaaaagatagatagtcaaaaatttcagctccagaacaagtctgggaaagtagaatcctgcaattacttgttttaaccatcagatagtgcttacacattggcagggaaaacagaaggccatatctcaggacgaggatgacaaggcatggcacttaggctgctgccagtccccattccataccaatgacagacatcgtcagtcatggtgctttctcatcccacccaagatgctgcaccagaatccttctcaatggatatcacaggtactcatgtctcatgaatcaaagttagcacttaagaagaaacatttctaacgtccctatttgaaaactgctggacatgataaataacctgattaagagatgataaatgaaacatgagtgatttaagtcctcatcgggtgggcaaaccaaatatgagagattcaaaatagccaagaactgctccctctatccagaaatgtatttatttaccattcctcaaactgtttgtttagtgtaggcaaagattagaaattagaataaatgaacattagagccaggagaactcttatagactatctagttcaactgcttctcttacacaggaggaaatactgatctaaagaaatcacagtggccaaatcccatagctaattctggcagaacccaagtgggaatcaatgcttatctaaccaggatttctcccattgcaccaaatggcccctaaagccatagcagccactggcaccataaactggatacaaatacacatgtggattcagaaacagagaatcacatcacccctagctctggggataaaccaaactcatgtagtggcggaccatgctccttggtaagaggctatagccagccaccagggagctctgcgctgaagtttgggtaagcccacaaaggggaaagctcctccagaggccctgcacagttacttctgagagacttgtgttcttagatctccccaaggtattccaatttaacacatgcaaaatcaaactcatgatttgcacgacacatccatgccagaacaacaaacctactcctcctcgtctgatagttgtctttgagtaaaaccactcttcacacagttatgcagggctgaaagctaagagtcatccttgtctcccgcctcttcctcaatctcaaattcaacgaacatcatcatcaattatattcttagatgtcttggggatcatcctcttctctatacctaccccattactatggtagtgttaaatactctcacctgttggcttagtcttctgcaatagcttgttaactgatctcacacgtgtattatgcccctccctcgaatctgttcaccacacagtacctagagtgactttttgcaaatcagaatggtatgccactcaccttcacttaaaccattcaataccttctcattggttttaacatgacactcaagtccctacaggatctgaccgctgtctacgtctcctgcctcaccccttaactctctgcacaccacactggtcccctctcacttcccctgctcctcataattcctttgactgcagggcctttatacatgctacctcctctttctggagccatctgcatccttcacatcccagttccagatgtaaggcctccaagaagccttttcaggttccactgaatatgttacttctcacaggtaagcatttactctctcatgaataagcatttgttttcttaggagactttcatctgttaataattagacattcattggggcattatatgatcaatgtctgtctccttactcaccaccccattctctgtagtctggagagttcaggacagcaggagagatgctagaatctttgtcctctttagttcatcattttgtcctcagtgtcttaccaaaggcaacacacagtagacatctaataaacactgaattgaatgaatgaaaaaatgaacaaataaaagccttgtatttaagcataagccactgattatgcttaaattattattcacagcttccaggcacatgtaaaagtgatgcattctaggattgctttttttaaaaaaaatttttttattatactttaagttctagggtacatgtgcacagtgtgcaggtttgttacatatgtatacatatgccatattggtgtgctgtacccattaacttatcatttacattaggtatatctcctaatgctatccctccccactcccttcaccccacaacaggccctggtgtgtgatgttccccttcctgtatccaagtgttctcattgttcaattcccacctatgagtgacaacatgcggtgtttggttttttgttcttgcgatcgtatgctgagaatgatggtttccagcttcatccatgtccctacaaaggacatgaactcatcctttttatgactgcatagtattccatggtgtatatgtgccacattttcttaatccagtctatcattgttggacatttgggttggttccaagtctttgctattgtgagtagtgctgcaataaacatacgtgtgcatgtgtctttctagcagcatgatttatattcctttggttatatacccagtaatgggatggctgggtcaaatggtatttctagttctagaaccctgaggaattgccacactgtcttccacaatggttgaactagtttacagtcccaccaacagtgtaaaagtgttcctatttctccacatcctctccagcacctgttatttcctgactttttaatgcttgtcattctaactggtgtgagatggtatctcattgtggttttgatttgcatttctctgatggccagtgatgacaagcattttttcatgtgtctgttggctgcataaatgtcttcttttgagaagtgtctgttcatatccttcgcccactttttgatggggttgtttttttcttgtaaatttgagttctttgtagattctggatattagccctttgtcagatgaatagattgcaaaaattttccccattctgtaggttgcctgttcactctgatggtagtttcttttgctgtgcagaagctctttagtttaattagatcccatttgtcaattttgacttttgttgccattgcttttggtgttttagacatgaagtccttgcccatgcctatgtcctgaatggtattgcctaagttttcttctagggtttttatggtttcaggtctaacatgtaagtctttaatccatctttaattaatttttgtataaagtgtaaggaagggatccagtttcagctttctacatatggctagccagttttcccagcaccatttattaaatagggaatcctttccccatttcttgtttttgtcaggttcgtcaaagatcagatagctatagatgtgtggtattatttctgaggtctctgttctgttccattggtctatatctctgttttggtaccagtgccatgctgtttggttactgtagccttgtagtatagtttgaagtcaggtagcgtgatgcctccagctttgttcttctggcttaggactgacttggcaatgcgggctcttttttggttccatgtgaattttaaagtagttttttccaattctgtgaagaaaggcattggtagcttgatggggatggcattgaatctataaattaccttgggcaatatggccattttcacaatattgattcttcctacccatgagcatggaatgttcttccatttgtttgtgtcctcttttatttcattgagcaatggtttctccttgaagaggtccttcacatcccttgtaagttggattcctaggtattttattctctttgaagcaattgtgaatgggaattcactcatgatttggctgtttgtctgttattggtgtataataatgcttgtgatttttgtacattgattttgtatgctgagactttgctgaagttgcctatcagcttaaggagattttgggctaagtcgatggggttttccagatatacaatcacgtcatctgcaaacagggacaatttgacttcctgttttcctaattgaataggctttatttctttctcctgcctgattgccctggccagaacttccaacactatgttgaataggagtggtgagagagggcatccctgtcttgtgccagttttcaaagggaatccttccagtttttgcccattcagtatgatattgcctgtgggtctgtcataaatagctcttattattttgagatacatcccatcaacacctaatttattgagagtttttagcatgaagggttgttgaattttgtcaaaggccttttctgcatctactgagataatcatgtggtttttgtctttggttctgtttatatgttggattatgttttttgatttgcatatgttgaaccagccttgcatcccagggatgaagcccacttgatcatggtggataagctgtcggatgtgctgctggattcggtttgccagtattttattgaggatttttgcattgatgttcatcagggatattggtctaaaattctctttttttgttgtgtctctgccaggcctgggtatcaggatgatgctggcctcataaaatgagttagggaggattccctctttttctattgattggaatagtttcagaaggaatggtaccagcccctccttgtacctctggtagaattcggctgtgaatccatctggtcctggactttttttggttggtaagctattaattattgcctcaatttcagagcctgttattggtctattcagagattcaacttcttcctggtttagtcttgggagggtgtatgtgtcgaggaatttatccatttcttctagattttctagtttatttgcatagaggtgtttatagtattctctgatggtagtttgtatttctgtgggattggtggtgatatcccctttatcatttttattgcatctatttgattcttctctcttttcttctttattagtcttgttagcggtcaatcaattttgttgatcttttcaaaaaaccagctcctggattcattgatttttttgaagggttctttgtgtctctatttccttcagttctgctctgatcttagttatttcttgccttctgctagcttttgaatgtgtttgctcttgcttctctagttattttaattgcaatgttagggtgacaattttagatctttccggctttctcttgtgggcatttagtgctataaatttccctctacacactgctttaaatgtgtcccagagattctggtatgttgtgtcttcattctggttggtttcaaagaacatttttatttctgccttcatttcattacgtacccagtaattattcaggagcaggttgttcagtttccatgtagttgagcagttttgattgagtttcttaatcctgagttctagtttgattgcactgtggtctgagagacagtttgttataatttctcttcttttccatttgctgaggagtgctttacttccaactatgtggacaattttggaataggtgtggtgtggtgctgagaagaatgtacattctgttgatttggggtggagagttccgtagatgtctgttaggtctgcttggtgcagagctgagttcaattcttggatatccttattaactttctgtctcattgatctgtctaatgttgacagtgcggtgttaaagtctcccattattatcgtgtgggagtctaagtctctttgtaggtctctaaggacttctttatgaatctgggtgctcctgtattgggtgcatatgtatttaggatagttagctcttcttgttgaattgatccctttaccattatgtaatggccttgtttgtctcttttgatctttgttggtttagtctgttttatcagagactaggattgcaacccctgccttttttttgttttccttttgcttggtagatcatcctccatccctttattttgagcctgtatgtgtctctgcacatgagatgggtttcctgaaggcagcacactgatgggtcttgactcttatccaatttgccagtctgtgtcttttaattggagcatttagcccatttacatttaaggttaatatagttatgtgtgaatttgatcctgtcattatgatgttagctggttattttgctcgttagttgatgcggtttcctcctaaacttgatggtctttacaatttggcatgtttttgcagtggctggtactggttgttcctttccatgtttagtgcttccttcaggagctcttgtagggcaggcctggtggtgacaaaatctctcagcagttgcttgtctgtaaaggattttatttctccttcacttatgaagcttagtttggctggatatgaaattctgggttgaaaattcttttctttaagaatgttgaatattggcccccactctcttctggctcatagagtttctgccgagagatcagctgttagtctgatgggcttccctttgtgggtaacccgacctttctgtctggctgcccttaacattttttccttcctttcaactttgatgaatctgacaattatgtgtcttggagttgctcttctcgaggagtatctttgtagcattctctgtatttcctgaatttgaatgttggcctgccttgctaagttggggaagttcgggataatatcctgaagagtgttttccagcttggtttcattctccctgtcactttcaggtataccagtcagacgtagatttggtcttttcaaatggtcccatatttcttggaggctttgttcatttctttttattcttttttctcgaaatttctcttcttgcttcatttcattcatttgatcttcagtcactgatatcctttcttccagttgatcaaatcggctactgaagattgtgcattcatcacatagttcttgtgccatggttttcagctccatcagctcctttaaggacttctctgcattggttattctagttagccattcatccaatcttttttcaaggtttttaacttctttgcgatgggttcgatcttcctcctttagctcagaaaagtttgatcatctgaagccttcttctctcaactcatcaacgtaattctccatccagctttgttccattgctggtgaggagctgtgttcctttggaggaagagaggtgctctgatttttagaattttcagattttctgttatttttttccccatttttgtggttttatctacctttggtctttgatgatggtgacgtacagatggggctttggtgtggatgtcctttctgtttgttagttttccttttaacagtcaggaccctcagctgcaggtctgttggggtttgctggaagtccactccagactgtttgcctgggtatcagtagcggaggatgcagaacagcaaatattgctgaacagcaaatgttgctgtctgatcattcctctggaggtttcgtctcagaggggtacccggccgtgtgaggtgtcagtctacccctactgggggatgcctcccagataggctactcgggggtcagggacccacttgaggcagtctgtccgttctcagatctcaacctccatgctgggagaaccactactctcttcaaagctgtcagacagggacatttaagtctgcaggatttgtgctgccttttgttcagctatgccctgcccccacaggtggagtctacagaggcaggcaggcctccttgaactgtggtgggatccacccagtccaagcttcccggccactttgtttacctactcaagtctcagcaatggtgggcgcccctcccccagcctcgctgccaccttgcagtttgatctcagactgctgtgctagcaatgagcaaggctgcgtgggcgtgggaccctccgagccaggtgtgggatataatctcctggtgtgctgtttgctaagaccattggaaacacgcagtattagggtgggagtgacctgattttccatgtgcaatctgtcacagctttgcctggctatgaaagggaattccctgaccctttgcgcttcccaggtgaggtgatgcctcgccctgctttggctcactcttggtgcactgcacccactgtcctgcacccactgtccgacaagccccagtgagatgaacccggtacctcagttggaaatgcagaaatcacccgtcttctgcgtcactcatgctgggagctgtacactggagctgctcctgttcggccatcttggaactgccccccacattctaggatttctgagggaaagttgcttgttggctatttcagtcattcaaaaagtccacctgcatacacttgcaaaatggcgtcttcttgaaagatgtatatatcctcagatgcaggccaagccactcctctgtgttcagacatcctgctgtgatctcttgtgtcttgttatctcagactgattatccctcccaaatgtcacacctcataatttgaggcagagatgccaactacataggtacctgagttagtcccaggtaagggataatgagtagcctgagaactgttagcaacagaacaaaccagggaaaagttcctaacgttttggtatgtattagagactcgacatggaagagcagaaaacaaagtgttctcttgctctatatcatagtcttgaagcaatttctgacatccaaagctgataattaactgtactaaacgatacacctatttctaacttgggccacagccaagtggatcacagtgttttcatggtagttaaaataattacgaagtataatcttggcttgtgcacacattcgtgtgggtgcaggcccgtgagctcaccctctctcttcccctccctctcctttgccagaagactccaatgttgagcaatgaactcaattcttttcacacagttacttggctttttcagagtggccgtctagtggcttgctccttcagtcatagaatcctgaaactgaaatgaaccttcagaatacattgtgccaagagcagagcttccaggccacctaagtaatatcttgattagaacagccatctctttggagaagtgaagcatcccgattgactcctcagtactgaagcagcctccaaccccagttccaaaatatacccacaactaaggatggcaggtaacattcatgtgataacactcacctatgcaaacaaacaggaaaataaattaccctgtgtcccatgggccattcctggcacaccagctgtgaccccaaccctccaggcccactgtggtccatgcctgtgtatatgtcgcaggacaagtccatgcttggtacccttcaggccctaagacaagaaagactccttccagtgtcttctattttacaaccggaaactattttagcctctgggagtcttctgggtaccagccagtgatgactagctccttgactctcctgttgaatgtggctattatgtgcataccagggaggacataaagcttcccacacacgacccgataccctggaggaacacaggcctatttccacactagttcctccttttaatccagctcctcagatctaatgctttcctaggctaagatctttgcctggtttcttacagaaaatgctctttctaatcttaattttcctctttttctaaaactataacacttttcagttttctcttggctccttcctcatctccccagccaggactgccatctcaccaacttttcatcagcctctaatttcccctagagtagtggttcttaaccctcactgcaaattaaaatcactttgggaattaaaaatagacgcctatgtagaagtgtgtgtgtgcctgtgtacaccgttacctgtgtctaggctccatcccagaaaaactaaggcagatctctgggagtgggacttggtcacggataatttataaaggatcttcagtgattccagtgtgtattcaggggcaagaaccactgccttagaacttgtttacttaactataccttttagttttcattcacacatgcagagtgtatttattggtaatatactcatttttatgtattaagaatttcgtatgcaccaagcattgtgttgggcactggaatgcctcaccatgtagatggagccttctttgatgttgatgttctgaacatttctatcctcagccctcctattctttccacctacactttcctgagagctctctgccacgtcattgtgccaactaccatctactttctgaggaaccctgaggctcaatcttgggagcttgtttggaggttctagcagggaagcatggccactcagatatcctgaatgaaagaacagtcctcctgtattggggaagactgtccccttcaatccacagtgcagcttcaggagggttgcacatggagcggtgagggaggaaggagacacctgcctaggcagccagatcagccgaatcaaccctggcagtcaatgggggacagatatcacagccagatcaccctcacatcccgaagtctaagtcttgagtccagacagctaccctgttacttagactatagactatctgactacatgtaagacatgctggctttagtgacccatggacaaatcagacccatatgtcaaaatggaatgttttaacttcccactgagtcttccttctctatcttcttggtggccccacagtccatctggtcacccaagtttgaaatctgggaaatcttgctccccagccctcttccccgcactcatcctctaaatctaatgttgtgtccaaaacattgtgtccctaatccaggccctcaccatttctctgtaaggtggctgatggatctcctgcctctagtgttgctagctatagtctaatcttcaccagaattaccagggtaaactgtctcaagggaaaatggaatcatgtcacagttttccattactcacaagtgaaatttaaggtccttacctggcacacaatgccatccaagatctggcccctcccaattctccagcccccgctagaatgaattgggagaccaagattgctatcacagcaacacagcaggggttacaacgtccctttgccagttaggctttcttatgcccacccccatggtttttatcatgctgtcttctctgtctgtaaaactcaccaactcaccccatcccacatacacacactgattagttgtattgccattagtctcagttacatctcaaattacatctacagttatgggctgcatatggacacttggatcaatgacagaccacatattcaatggtagtcccataagattataaaaccatacatgtactgtatgtttttatgtttaaatatgttttgatacataaatacttaccattgtgttgcagttgcctacagaatgtagaacataacatgctgtaaattaaggtttatagcctgggagaaataggctacaccatatagcctaggtgtataggaagctatatcatccaggctatgtaagtacactctgtgatgtctgcataatgacaaaatagccctaatgatgcatttctcagaatacattctcattattaagtgacatatgactgtagtatacgactttaaaaacagtataattatgtgtctttgtttctgtattccccatagatggtgaactccttaaaggcagtgactataactgtattgttacagtttttgttgtttttgtctttatatatttcacaacctagaacaatggctacaacatctcaagtactcagatgcttatggaataaataaatggagacataggttcctccccttaataagcttaaaattgaataaatttatttttgtttctatatccatttatccaagtccatagtttccttttccccaaactcttatatatactcagaaaggcccattacagtcaaatacaaacaaggcaatttaattcagcattgggagtatctagctaactgtaatattccaagaatgtagagggatcatgtgtattactgaatcataatactgatgtacgatgatttataaggcaacagcgtcgaaaactgacccctagcttcctataatttgattgcctttcagaaaaagttctcagcagagaactgagtctagagtcctctcagtacagaagccaggatacgcaacccatcaaataagactggtttgctgaatcaagagccactgaccgatttgacagctccatattcaaactaaacagctctttttggaaactagacttttggatgttataccagagatgtgactgagtagaacagagctttccaggggctgaataatccattatgcttattttatcagagattcaagttgaaaccattgggccattgagtaataaactcagtttgaccttgtcaaaatcctacacctagcagtattttgagaacttgtttgttctgccacttcgttccaagttgtttgaactttagttgagcccatgaaagctttacagttatcaagtgtgcttatatatgcacattatttcacattgatccacacctgcctggtagccatcactagaggccctggaaatattcagagaatcactgaagtgtgagcaacagttaataaaaaattcttgcagttttaattacaaacaaaaagcaagcatgtttcaactctataaaattcaactggaatatccagggaactattgctgtttataaccaccataaattatattcatctttcatactgagttagtgcagcttacagattgatatataaagcaacaagttctaatatttatgaaagtgtgagttctaccacctgtttcaggagttctaacctaacctccagaacaaataaaaatgaataaacaactatcttcgcccttcctgccatgggagtccttttgttctctaagtcatgtttctatctatgaagcaaaatgaaggactactaacaaccttggtgccatatgtattaggaaggaaaattgctgtgctttgtccaaaggcaattagtgttaggaaggaatcaagaagcaagccaatattggagctgctctttcttctgagctgtgactgctagaaaccatgacaaaaaataatgtgagagattctcatcagggatcttgggccccatttgcatattctttcattcaccacttactttgtaaccagccctatactggcattcaacacacaaagacaaattagacagactcctgccttctttacagagaagcttcctgcacaatgggtggttcacataagcaataaaatgatttggtaaatgtgagaatggagacatgcattattcattcactctttcaacacatatgctagcttgactttttaaagtcagatgctgtattaggtgctagcgaactaaaaatagtccttgcccttgaagtgtttgtgggatgtgtctatatggtaaatacccaattacaaagtaatgagattgggagtatggtaggccaaatgcatggaagcatctagcgagtcccctgtctcagatgtggaagtgaaggaaatctctcagagaagatggactatccaagacaagagctaagaatggaggcacatcagtcattgaaagaggcaggtgtggggttggaagctactgcaggctacaagacctagaaccagcaagaacgtggtgcactgtaaggttttctggattaaagtctaggttgtagtgttcatcctaagaagtttcttatagcaaagctttagatattataaccctttagtataagctttggaaattatccaaatcttgcaaatgaatgaatgaatcaatacatagtgacgtttctttacagtaaccccaggaaccattttgttggatgaacttcaaaaaacacagaacaccaaattcgaacacatgaaaggaaaggaaaccaaatttatcaaataagtcaccaggaaagaagacaaaagtaaaatgtccttggccttaaagacagttgcaggaagatataatcaaaactttaaatcatgcatgaaaatgcaaaacccatggtcttgcaggcctcagtggatggaaatatttaaaaagcagatttgttcacctggtctcaaaataataaaattgtgcattttcaccattcttcttaacatattaagtgaggtaaagaaaatgtttagcagaatgcctgccagtagtaaatatcccctaaatgttagctattatcatcatttatgagacaccagttaataatttatgtaacacattagtttttctaggaaaagcatttcttatttaagaaacaaacagttcagactaaaacatgaaagttttctaaaaggttagtgaggggacctgggcttgggtatgtgagaagcagcctcccagcttctgtgctcagggcacactccacctgagagagatggattggcaggaaggcttatgtaattaactcaatgtcatccagaaagtcctattcacggaaacacccttcaatgatatgagggcaactcttctcagaaataatggccagtgctgaagatttccttgaaaacaaagtatccaaggcttatttgggtcagaacaggtaagaccagacatacctttcccattcaatggtactggttaccactcggccttaacatggttaacgtgcaggagagacctccttctagtcatgatttaagttgtgtatttaaatattttgagtgaattcttggaattatcagaacattatacagtagtttctagaaaaagtatcctatgttcatctaaataccttttattttcctcaagccccaactgtcacatacatagcaaagatacattatcctgctgtgtttttttagagacagggtttctctccgttgcccaggctggagtgcaatggtgtgatcatagcttactgcagccttgaactcctgggctcaagcgattctcctgcctcagcctcctgagtagttgaggctataggtgtcccaccacactcggctattttttaaattttttttgtagagatgggttccctctatgttgcccaggcttgtcttgaactcctggcttcaagcaattctcttgccttgacctcctaaagcactgggattacaggtgtgagccactgcaccaggcctattcctctactcaacgtaccattttagcaagtttctttctctcaccatctccttcacattttctttctctttcaactttaccatccattgcctttgagaataacacagagaaactcaatcaccaacacatgtaaaatccaatggatatggatagcaaagttggcaagctgaggaatgccataaaaattctgcttggagtttaatcaaggtaaagttcaatgaacgttgtccattcaaatgaaaggtacaaacaaaattgggaagcataaagtaaatttgaaaaagcataaagcaatattggtaagcataagcataaatctcaatgaacaaagtggttgcaagggctttttaaatttgcagggactccatttacctggcctcagctctcccagccaagctgaactcagctcgttttcaccaaacaagaatgacttatcctacactcactaattctttcccttctcaaaacctgtagtggcccctaaatgcttctcatatcacattaaaacacccaacatagaattcaagggtatttatccttggcttttgaagatactagttaagacatatagtgtattagtttgctagggctgctgtaacaaagcatcccttggcttgtagaagtatcattctgatatctgcctttatctttacatggtgttctccctgtgtgtccaagttcccccctttttataaggacatcagtcatattggatgaggacccacactaatgacacctcatttcaacttggttacctctataaagaccctatctccaaacaacatcatattctgaggtttaggggttaggattttaacacataaatttttggaggccacaattcaacccataacatacagtactatattgtcattattattatttggtggcatctgtggaactgtaagtataatgggaaggacacatgcttgtcgtcagacagacttcaattgaaattcagctctgccatttactctgagcttcctgactgcgtgagatagagataaaatccctataatgcagaatggtgtgaagactaaatggggaagcaacttctgtaaatatgtaaggacagacctttgcacattacacccaactggaatgacccatatcaggtttgaactttcttctaataaaccaaagcataacacaacataatcaaacttgtttgcctattccaaaaaggaaaacctgtaagataattcataaaaatctctcaaatctctctgtttaagactctgaacactctctcttcccataacgaaatgcgtttcttgttcattcatttatggctgttcacccaactctatagaaaccaatctaaatcaatctttcttatggcctcttttcatgtttgaattcatctggccatttgatcgcaagctcttggaatggaagaacaatgtattcaatgatataattaagtatttgaaatattttgatataatatgtgaaaatattttctgaagacagccttcatgttaagcaccttctctatgtaattcattgataattagggaactttgaagcatatctttgtttcccagactgttctttctcattgacctggtgtccactgtctactaccatatgcttgttgcctctgttatctttattctcaaaacctccttgcagaaaagacacagatgtgttttgcggattaagcaataaagtgctctggggctgctgggtactattaagcaggttgtagagtgcacagggtgtccccaaaacacaggagattttcatatttatcataattctttagcagatggttgtaggtctgttttaatataagtctgaatgttacaacaattttctactctgtataaggagtgttttatctaatttgcatagggcactgcatgggctggccttggccttgcagctgataaatctgatatgtaattccccccaagagattctcaggcaaggagatctaagccagaggaagggaactctgtgcattttctgacttcagcaatgtgagagattggtttggggagaatcttttgacaagtcctgtattaaggagtggcctcccctctcagtgttggagaaaactgtagtcaagcaggctctggggtgggtagtgaatctgccagcattgcacgctactcacaagagagatggaggagcaaagccatggaaaacgtactgccctggtgctactagataagatcagagacctgatcctcagggaattgacaacagtgtcttcttcactcatatcacagctgaatcatctagaagatcaactcaaactcatcaaaaggaaaccctcaataggagaaacaagagatatgtaatattttgcagacatctgtcacactgctatgtgataaatagcttggagtacctaatgcatgcagggcttaaaacctagatgatgggctgataggtacagcaaaccaccatggcacatgtatccctattaaacaaacctgcacgttctgctcatgtctcttaaaacttaaagtaacataaaaataaaccttagagtggtgcattttaatacttcaaaaggagagtttgttttttaatcatctaaatcatgtcaatacaaaatattaatagcaatctgaccaatgatgatggccaatgacatcagtatgaaccatatttttaaaaatgtaattagcataagaattagaggaaaatatgtctgtttttaacaaatgcatattctggttggagagcataaaaaatagcaaacaataaaacttcctaggtggcaaaattatgtgatatatcaacattgacatctttgcagaaagacttaaggggtgattgggagcatagccaagcagatggagactgtgtgaaagcagaaccaagtgggaaggcagctcaagctcaacaactcctgaagcatgggagggcacagcacccttcactgagaggcccgacagggtttaaacacttgacttaaacttagccaatcacaggcaccaggaaacagccagggtgagaatgctaggggaagtttataaagtggagctgggctgggaattggcatcacagataatggtggaaagcaatggagatgaaaaaagaaacacaaaatatttaagaaaggaggaaccttgtagaaataaagaaacagacacctatcacagagaccgaggccgctgctcggcagatgcatttccttttagagcacgccctggagccttgagacaacatgctctcgctcttcattttaggcagccctgatgaggttctgcttcttacaatcacagctatgtaacaaaagctataggaataccaggaagaggaagaggcaggccaagggaacagcgaagggcctgggacaggaagaggggtggaattttttgtggaaaagcgggggaatcaagctatggaggactatggcaggtagagtaggtccagggtcttcattgcacagattaagaatgactcattgaccctaagattaaaaaaaaaaaacaaaacataaaacagctgtcattataaagttggaggaaggccgggaggcagttgaaggcagggagaaaagagttctaagattctgtacatatagataggcaagaattcaaattgccaaagccaacttgagcattttgtggggggcattttatatgaggttttaaattttgttttcttctaatgtttagactgaagagaaattcccttcaataagaacaactttaacagattattaaaagggacagtgtgaaaccttcaataatatttagaaatatgtgtaggagagctaatttgattcattcatcacattttcaagtaactggtgcgggctccataacacagtacagactacataacacagtacaggcttttgtgtattaaaattaatgaaaaagtagggggtacttatgggtctcagtagttctcccaatttaaatacacttaaataactgtgaaaactggtcagtttacacataaaatcatgccaatttcaaacagaaaagttccattgatattgaccacatttttggctcctattaaattgctacataaatatataaagcaggtctgtaatactatatgtctgcaaaaagatatttttggcaaataaaactcattttattttctaatttcaatcttccttacccagtattcttaaatatataaaaattatgtttggttctaaatatccaaatacccccactcccacacacttttttccacattgcttttatccatccttttacagatttatgcataaaatagtttcagttaatgaggatcacaatttttaatctcccaaaatccagcttcccattgtcacccagagcaacatctgaagtttaaatgtaaaggatcagtgattatcatgagctgaatggtacccgctgcccccctaaaaaaaaagatatgcccatgactttacccctggagcctgagaatgggaccttatttggaagaaaggtcattgaggatgtaattgtgttaaggatctccagatgagatcatcctggattactggtgggccccaaatccaaagataagtgtcctttttagaggcagcaagagaacagatctggagagaagaggagaagtgagaaggagaagatgaccatgtggggatggaggcagcgactggagttagacagcctcaagtcaaggaatgtatgagccaccagaaggaagctgaaattggcaaggaaggattcttccctagatccttcagagggagcccagcctcattgcaggcagctggcctccagtgcagtgagaaaaatttctgtggtcttaaactaccaagtttgtggtaatttgttagagcagctctgggaaactaatacaatgattaaatggtatcgatttatttttaaatttgcatttcattaagtttgtggcccatataaaaatgctgattttttttcttgtgatattgtgatttaataagaaatatttatttgttctgtatccctgctccctggcacagagcttctgaagcttctgaacccttggaatttcctgagtgatacgaatgagggcagcagcttttgttattcacaataaacccctttctaactatacctgagttactctgatgaggtgactctttgtgggaccctagatagtttccggatgggacctggttgctagaggaaccaaccatgaaattagagggttgggaggtgaaaggggctagagattcaactgatcatcaatgaacaacgatttaatcaatcacgtctatgtaacagaacgtccacaaaaaatcctaaacgaaaacagggtttggaaagcttctgggatagtgaacgcattgaggttctggcaggttggtgctccggagagagcatagaaactccattcccctgctcctcacatcttgcctagaatcttttccatttggctgtttcaaacttgtatcatttatagtaaactaataatagtaagttaacacttttccctgagttctgtgagctgttctagcacattatccaaactgaggagcaggtcatgggcactctcagtttgtagcctgtcagtcctatgtgtgggaggcccagaacttgtggttggcacttgaaatgggggcagtctagtgagagtttgatgctaactcaaggtagttactgtcagaattgagtggaatcattggacatccacttggtgtctagagagttggagaactggtcatgggtgtgtgaaaaacccacacatttggtgtcaggagtgttctgtaggtagaaaccaatcatcatagttggtatcagaggtattatggagtaaaagtagcacaggttccttaacttaatttctaccataattaaaaaaaggatattgggttatctcaccctggtttcccagtcagggctccaacctgggctctcataataacttcctcctttcctttttgacttttgttagcttccattgcccatggagtcaagtttattaagctccctagaatggcaatgaagtcctcacttactttccaaacttatctttttctaaaccttctcttggacctactgtactactctaatctgcttgtggctgccaagcttgcctgtcatgatctctcgagattcagctcaagggatgagaccataaaatctcttctgcccttccagggggatgtcaccctgtcagcgtcatcaaggaagctttaaaattttgtgtcttcctaaattaataatctctgagtggttttagttaggatttaatccagagggttggattattggtggaaaagagggaaactgaaagtgcttaaaatgcctcagtgctaaagaagaaggactcggtgtatagttttagtgaagacaagcactgtgcactcacgcctactgatggtaccaaacacagatccagaaaaaccctaaaataggaccctgaggcctggtcttccagggatgaggaggagaagacaaagaggatggataacaagtggagaaagacaggatttggtaactgataaagaaaacttactttcctttagattgtagggaggggagagttacagataagagatagaggtcacaggtaataatttagtaacaaagtaaactgtaaggcaaagctctttggtagctgatagggtttggatgttctgttccctccaaacctcatgttgaaatgtgacctccaatgttggaggtgggcctagtgggaggtgttcgtgggcctggatccctcatcaatggcttggtgctgtcctcacgataatgagtgagttctcattctgagttcatatgggatccggttgtttaaaagagcctggcacttcctccttctctctcttgctttctctctcaccaagtgacatgcctgctcccccttcactttccatcttgattgtcaacctcctgaggccctcaccagaagcagatgccagcaccatgcttcctgtacagcccgcagaactgtaagccaaaataaacctcttttatttataaaatacccagcttcaggtattctttcacagcgatgcaaatggactaatacagtgacaatgcatcctgacttacttacctggccacatttttctgttaagaatttctagtgacttttgaggaacagaaacatttttttaaattgtggaagtaattagccagagttaacttttatgtcccaatgaagaaagattcccaagctccaggtggcacaccacttatctttgaatagctttgagaaaaagaaatcatgccacaaaaacaatgtgattcattgattgtacttcagacagcaaagaaagttctagggtatgatttagaaagtgagcctgcaaaaactctttttcaagacaaataatgtaaaactaggttcactaggattgaggcattcattttacaaagaagtaattatgagtaattaaaatgtcatgcaccaatgatgattagtgacaattggcattgccacagtattaaaaaatacagaaattaattgaattaaatttactttagccagcacctcataagagtaaagtaaatggcctgtggcagatatgcatggccacagggtgtagcaagtaatttcttataggttttactaaatgtatttagtctagtcaatgatgttttattgagttttgaaaattttggatgtctagtgtttaacacaagactcatggttcaagatgactatatttcatatccatgtgaaacgtactagattttcaggaaagtccatgtattgtaattctaagaactcaaggctggcaccagctttaacggcggatggtgcaaactgctttagttactgtggcccttcctgtcaccacctttgcaaagtgctgccatggagaatgtccccactttgggcacgtttcctgtgatgctccaagtcccatctcattccaccagtcccaaattcccttctgagtaaaaggtagtatagagggttagcatcatttaagtctatccttatgccatgaaacacattttactgatgtgtttaatcagtggggttcccataagctggtctgcagtcaggtggatgtgtgtgtgtgtgtgtgtgtgtgtgtgtaggtgagttttcaccagtcatacctgagccccttgactgccatgtgatgagccttggcccttgcccctcagctgggcagcccaggctctgtggctcctggtcttgcctacacacctgggtagcccacaccctactttctccaggcctacaaaccccagctatagtgtctcagcttccctacctcctcttagaatattctgaattgaatgaattaagagactggcttccaattttgctaacatacttacctgaaactacattttgatcatgactgggtagaaaatgaacatttgggctccctgtcctgttgaactgttgaaatacaggcctaaattgagcaacattaatcaagatcacaattatatgcaaaacaatattatgaaataaaactttgttatagtagtcccccttatctgcaggggatatattccaaaaccactagtggatgcctgaaacttcagacagtaccgagccctatatacattactgttttttcctatacatagatacatatatagctatgataaagcttaatttatgaagtaggcatagtaaaagattaacgataactaataattaaatagaacaattataacaatctatgcactataataaaagttatatgaatgtggtctctcatttatttctgaggtttttcatttaatatttttgaacctcagttgaccataggtaactgaaacagtgaaaagtgaaactaggtaagcgaggactactgttttctttaattgtaaaagcagaaaaatgatatctttttatacttgtgttatatcagggaaaatttgtccattgtctttcttgcaaataactatgctttcctcttgacttttgggatattcaggtcttttctttcactaagtgatgttactagcagatggccctgctgtcttccgctctttagccatcatttttacccctagattacagaatgaacttccaacttttcctccgtctatcagttctcgaccagcattaaatgaatagttagatgtgtgatgagattagtgtttcactcccttgcctctcttccaatctcaggcttcccactaaacttagaactagacctaaactctctagtgtagccaataaggccaaatacaacctggcccctcctatagggttacatctcattattcacagtagttatgtttcataatgtcattgccaacattgaattagcaaatcctgaaccattgctccttggaaaaatactgagttacgtttctctgagcctagggtcacaacatttttgtcaactgatcaatacataaccttgttttgtgtgtgtttctgtttaaagacactttatttagcatagaaagttcatttattaactttggactcctggtcaacagcactataacttatacttgaacaaagcttatctaatacacatactttctacataaggcacatcacagccttcgtgcacttatgaacaccagacagcacttcggcactactcttcggggccattttaaacagtgacatcaaccaaaagcacaaaaatgtgaaaaatgcagtactaagcagacctcaaaaaggacacttgtgtatagtaagcaagtgaaaccagaaggcggggcattgtcttgttcaatctcaactggggacatgtgcatggggagacttcaaattttttgccagtctaagtctgcaagtgatagtgaaagcactgtgatgattgattttggggttataagtgaatttcagtgagtagcaaattcataaataaagagtaaagtttttctgactttatcttctacaaatatcctttgtgtttgctacactccagctatactggcctctatgcttctagtccatgtccagctcacttctgcctcagaggctttgcacttgctgttccccttgcctgggttataccctgcacaaaccccaatctaatccccagcatctatgacagagccagatgccgtaggcactcaatacatagttggtgaatgaatggcaattgttttcttaagatgtcatttcttgacaaaatagaaaacacaggcaactcttcgacagtactcaaaattcaggggaataatttacaggtctgtataatccccgaattgaagatccattgcttgtaaaaagcactctctacaaagctgcagcccatcatcttttcccatcatgttgggattttatttagtcacacagcctaacatgtcatcaataagtcaacagcagtgtctcacattggaagcatccctggaacagttagaagaagagaggctttaggcagttttacctgagtattgatacagattgctatcctcttaactacccgaataaagacactttcctttcatttaactaagttgatttgtactaacagaaagaatcattttgatgagttttggggagtgcttttggagaaagataaatgtaagaaaagttatgcagaagtaggctgcagggggctgctctggagaactggaattcagcctgagtctctgaactgcagtaggtgagaagagacgtgaaatataacacaggagaatagagagggcaaagggaagggcttcagaaaaagaatcctccccctttttacagttttgcccaaggctggacctgcctcattcattcttgatgtggcatcaatttgttaaaaacaaaccaacaaaaaacttccaggaaggaaggaagggagggagggagggagggagggagggaaaataacaactgaaaaacagttaggaaaaagagtttaataatttatcagataaataaaagatcaaagttgggaatctgtctggggtaggaatgcaggtatagctttctgctgagtaaattcagttctctcacagactcagccagacactgtctatactgtcccattcccagaaaacactgactttggccacagtttagctccccttacagcaaagcagcaaagtctatattcaagccccaccttgcccttccttccaggggacctgcattattcctatcaaacccaaactgttctctctgtggctggggacagccttcactggttagcacagtttttaatatgaatccaaccttctcacttctcttttgagctttcttgtgtctcagctctagcatggagagcacttacagaatatccccctaaatgggaacatctggtttgccaaagaggtgacctcatacatgagcctcttgaaagcccatgagcctgagtcttgtaatggggaatgtttatccgccaggtatgaaagatgaaatgagggctccaggaatttcgtcttaacttgcaagggaggaggatcttttgttcaggtgctgaacagtgaagattttcaagttttcttaggaacacaaaagtgtttgctgtcaggagaactatgttgttttccttgagggcttctctgtacacaatggaagcagagaaaccaaactaatcctggtccctcctgttggcttctttcaaaattttgagttgtttccagtccaaaccagactggcccaggcttccgtttaaaaataatccacttaccacagcattcaaagcaatttggcaagcctaggaagaagtgtgacaggaggacgggtgggttggttgcgggaggcaaggcaaggaatccatttttgtgtaccctctccacgtggtgcaggcgctgtgccggccacttaacacgctgagcccagggcctattgagaagagtccagtgctgtgaatgagcatccctcaggctcccaagctggctggtttgaaatctgtgtctcccttgactatcatgagcaaagataccaagtaagtgccatctctgacagggcaaagctgagaaaacattacaacaaaaacacgatcattccttaaacttcaaatcatagaaaaaaatgaagagaaattctggtgttcagctatcagtaaacaaacatcttgtaaatatttacgagtgggcttgatattataagttgttgtttaggaaggaggtcgataaaggggaccaaggttagccagcagtagaacagataggaaagtctcacgatcctaggtgccctttgacttagggtgcctacactaaaaggaacacaaagacaggccatatgcccatcttttccccatcctagactttgtgatctggtccacagccctcatttcacaactgaaaaatcagagggtcctgagaacttcagtggtttccctggaatagtgcagtccattggggagccaggacctgggtctggtcttctaatgtatttttctttctccttcccactgctgatttgggggcaaaccatctgattgaaggcatgatgatgatgaggagaggcacagaagccttgagctctcctctgtcctcaaggcgtgtggcacagcttgtgctaaaatggaacagtggacctaatactactgcttgtataatggatttttgcatggcataacttttgcattcactttgtgtgcagcatatatgttttttcaactctctccgaatgttgttccatagtatacttatatggtccctgagaccgaaataattgctcctctccaagactataaaatcctcaaggccaagacctaccccctctacattgctgactcacccccatcccaaaaatgtaaagcaatccgcaaatatttagttaatgcttgaagaactgactgcagttggcatcatgctggtgacttggggacacagaaaggccctgttatttaatttagagggtgaaagatgatattatttgttcacaattctcctttccctcctactcctgctggtgggaaaagtctataccacctcccagctatgctgactgtagggtttgccatgggactgtcactgaacacagaaacatgagcagaagtaatggtgtgccagccactggcagagcctttctgctgcccctcttgtggccctgcctccaccttgagaacctcgtgcccctgaacagtagtggggctgccactggagtctgggcactgggacaagaagatcagagaagcagaccccagcccatcctgaagcctggagtcaagcccagccacacacagcagggacccagtggagccacagctgacacacaggactatgaatgaggaataaatgttgaatactgtaagccacttaattttttcctgggttgttaccacagtaaaagctaatatatggaatctctcttaaaagcacatttgccatagagctgaagtgctgtgaaccaatttggtcacacaaaatatttagattctttttggcagatactgaagcagtttgaccttgctactgagttataatgaaagcaatcctcagaccagatttccctacacatatgtgaacatttattaaataaatatgtgttaatgcaggcataaaaatggaccttactacctgctgtcccagctcaggaaagtcccagctctctgtccctttagtgtctcacccaccatctttactgaaaggtttcctagaagcagacgctaaacatctcagaggcaggattgtaccctttttgtaggcattgggcaattaaaactctttgtagcaatgcctggacaacagacttataggaatcaagattcaggtgacatccctaaaggagtaagccacgggtcttgctggattcttaagccctgttcaggaaaccatggtgaatatctctagcatgtagacagcagagatacaagttgagaccagttacagaccttgtcatggagaagtttacagagttgagcaggggcttttggagccaaggttagggttcgtcatgggctttagttgtctgagaacaccctaaaaatcaagggatgtgtgtgcatgtgtatgcaatgttgtaggaaaaggtctacattgttcatcagatttctaaaggagcccatgacttaaaaagggcaaagaaatgctttcccatgggatctgtaagagatgactctataacaaatgcatttactcagactttgctatgaaggatcaaactattgactatataagaatagacttctagccaaatgaccaaaaaaggttcttacacataataactatggtagttaagaggttattttaaaaatgtcctaacagaactaatgactaataaaaatggtactagacatgttccaatgaaggaaactccatgctgcaccattataaaagtcaatcatagactcagcaaagcaaaggctcaaggttgctttgatatgcaacaatgcccacagggtaatagtagcaactcccaagtctcattttaatcacgatttgcctctccgtgccaagtatgaagtagaatgggaagaatttacagccatgatttaaccatctactacacattgctggttccgttacttagaatagacatcacacgtaagataataaacatacaggtagcagggacatttccccctcaaactgtccaagactgttcaacaaagagcatagctgatgtcaatgaaattcatggcccaagaagtcatgtgttattcatcacgcggttttcatagcccctgctacatccctacacatcccagtttaagaagcacaggcttcacttctctgaggtttagtttcctccatatactaaatgggaataatcatacttacatcaaagggttcttaggaaaattaattgtcatgtattggttcaatcctataacatagctatgctgcctagtacctagcaggtactcaacaaatattaaaacctacctccattcccacttgctatgcagctctgtgcttctcagagtggtctccagagctgcagcatcgcagggagcttcttagaaatgcaaattctcaggcccaccctagacttacagcttcagaaattcagggggtgaagtccaatgaagtatgttttaataagtcttctgcgtgattctgatacatcctaaatttaaaaccactgatgtagataaatcattcttaaccatggctgtacattaaaatcatgttagatgcttttaaaaactactgatacttaaactctctaaccaccccaagactacaacagaatctctatggggtgagggactgggagcattggtcattatcaacagttccccagggatttaaataattgaatttaaagggccaagggaagtccacttctctcctcttggcagtctgcactggatgcttgaaatccaatcaatattgagtctcttctgaactcagacctgccacaccagtaactagctgtggggccttggaaaagtttcctatacttctgttagccttgttttgtcacttataaaatgaggatcataatgatccatcttgcatcttcttattttccaatgggaacgctgaattccaaagtttttgttccttgcccatgtcacatatagcagtagtagcagaccagggcccagcctttgccatgtcctcttctgcagagagtcatgtgtatgggtgtgggacagagaaacatctggagccctggtgtgggcgttggtaaactttataatatttttggcataagtatcggaagggagggcttccagctaatgactggagaatgtgccactaagaaaggtgagtgaaggacttgcaggactcagtggaagctgtgtgggatgaggagaaggatctgcagcaggacaaggaatcaccgatgagcgtacacaaggataaatacaccattcattttccactggggctggtggaggggcaggcagctttggttaggatacgtggagactttgagatttcagagtaaaattgggaacagggcttggaaaagctagcagcagcatgaaactgaacggaaaacagggagggtgcggatatctttgtgtactctgctctgattgggagggagaaaggggagacccagggatgatttagccatttctcttgcttgggaagggtggcataagcccaacaattcacaagcccaacagtgtggaaatgcagaaaggaagtatttagctctagcaaaattcgactttgggtttattgaatctattatctttatttttcttctccttcccatgatccctccccatgatgtacacacacttaagaatcaccatgtctgctaggtgagaatgattactgtcatctgagaagaggcttcaaactaagcttcactgttcctccctctaactcctgttcatctgcatatcagggataaaatgaaggggaggaggcagctagctctgccctgcagccccctgatggtcacagtagtcactgctttggagtgaatgcctacgtactccccggattttatatgttgaaattctagcccccatggtgatgttattgggaggtggggcctttgggaggtgattagctcgcgaggatagagccctcatgaatgggtttagtgtccttatagaaagggaccgcagagagccctctctttttctgccatgcggggataatgaaagcagccatctgcaacctcgaagaggtccttaccagaacctgaccgtgctggccctgatcttggacttccagactccaaaactgtgagaaataagtttgcatttttataagctacccagtgtatggtactttattacagcagcccagaataagacagtcaccatgtgcagtgtgggtgcgaggctctgccccacattttctttcctgattctgaatttcttattctgaccttggccttcagactcacaaggctcaggtctctcattaatgtgctgagatgactcttcccaccttctgccattcactattgaccaggaatgacctctactgtggtgactttgaaggcaacaagacaaaatcaattaactggacaaaagtgaagaccttaactttttcctgtaattattataaaccagaaggaactctagaagtatgatttttatcccaagcattctaaaactttattggcaacttttaaatcagtatcacagaggctttaaagccatttacactagaaaactggcttttatgtcaaatatttatttaaaaaacctctgtagttgtaatcctcaaactatgactcactttatctaaagaaacatttgagatttcaaaattctggcacaaacaaataaatatcttgggtacctaccaccttgaagtgtactacaatggtttaccttctgcagggagggaggaaggagagggagctgagaaaaaatttgaagaaagcaaatatgagagtcctgtgagcccagaaggcatatcatgggccaaagcctgcaggtctggcctgcctggagcaaacatgcagagcccaccaagttcaagtagaagctgagctcagcatgtgggtggggaggcacagtgggaagagacagtgcaagtgtcagagcacaggcccaagccaggcacacagctataggcacatggggactagtatgcaaactggaagactggaaaaggatccaggaaggaagtattaggagaggtcaatcttctagcaacattgtaaatggcttctttagcttcagctgttaggacccagaggcatgggctggtcccctaaatctagccagattgtaatgcacacagattgcaaacagaagtagtgagctaggctaatgctagccctcaaatgtgttgtgattggcctgtacagagtttaaaaggaatgaactgataagatcagtgtatcatatcagtgtcaatgtcctagtggtgatatactatagttatatgtgatgttatcattaggggaaggagggaagggtgcctggcatctttctgtattatttctcacaactgcatgcaaatctacaatgatctcaaaaccaggtaaaaaaaaaaaatttaatgagctaaactttataaatcagaagatgtcacattttttaaaaaacctcattttccagcttctcttgagaagttggaagatccggcaacaccaggcccaccctgtgttcccacaataacatgttctcccgtaacaatcagaagaagcagagaagcatctgatgccttcagacaggcattacaatcttcattttgcccccttctccatccagcctgcttcactatttatgttatttgtctggtcccaatggacattagatttttctgtttttctatatagagggacggagttaaagacttggccgtccaagaggtcatctgagttcacacaatttgtctggagttgaacactacatcatgaataagaacacaaggacatctcactatcctggtgcccttggggccttgcacataataggtatcattatagtattctcctacagtagaagaaccacttaggatgggttccaagaaaaatcaatgacatactaaatgtcacgccacagcaatttctgtcataactcaggagccacataaaatacagtgagttcttaaagtcataaatactctgaaattatttatgaaacaggtattaggtaaggtccaatataccaaaattggaaatacctagacacaaggtttaactggaactctccatatatgtgtgctctatgattccaagacaaggtgccattccaaatggagtctgtcttttcgttttctgaggttaaaacattttccacattagaaacctgtcccctttggtttccacatggtaaattactctagtggaatcatttaccctaaaggcaatgcagtgttcccattatcactaagcagcaaagggcaaaatagccaatgggacggagacagggaggataaattcaggtcattcttgttgcaccaaaaaaaagcaactcacattactcaaaaaaaagcattatattgactcacagatttagatacatctctgtagttatgaaatgatactttttacaacctttagtctgctcaatatatggtccaacctccttacaccacctctcactatgcacattcttacacatcatactcaggagttggcatttttcctggttaggccattctaatagtggtgctttctctgaattttactatgaaaattagattttcctcccaaggagtctatgaagggtggaatattatagcacacaaactaataatacggagaaagcatggtatttttacgtattccttaacacatgagttaacttatcaggagagttaaattacatttaaaattcaggggcagatgtaggtcctggctaatggtcccttcagtggcctgagataaggattcactgacagggttctctcaatcccgccctagtgttgaactttgacctgcaatatgctcactctatgcttagctgttttacaaattggtaaatacacaggccaagcggctgctgtccattatgtctcagattgattcagtttggttactcaggttagctcaaccccattgcccccgctgatgctgcctcagttcacactggccgaaatggacttattcatgttgccatttgtaccatgtcatggccaaagaaattatatcctggaaattccttgcaaaatgcctgcagtctgagatttggctgttgccagtggccactaatctgaccacagtcatgcatctggaaaattaaattattaatgtgagatacttactctactgtattgaaagtaatggctgtgacatccaagccaaatcatttcatatgaaacacggaactggtttgctctgtgtggggcatcagctggactctgctataaggcatctggtgacgccatgagtcctctccaagttttctgctgcaagcctgtgatagccagctggcagagcagctgcaggcccaggtcactttgggagccagctgaccatactcccttagataatacatgtataggtcaaaggaggctctggctctcactttgaacaagtgtgtttggtcaccaggggttccactgaccactgggctgcagaacgtgcaaataatttgcagcttccttaattaagctaaactccaatccccaacatagagcttgacctcaaagtgctatttttatttcttattcaaatgcactgttgcaaccacacatcccctatctgtatcaaagtctctctttgtgaggcttttgaaaacaactattttctctttccattttttgaaatgatacatttattttgaatagctgtagagttacagatatatggacagagatcaaatgcggttttgattcccagagatgagtttatctgagcaaaagtaaaacacattgtgagtggtagatcataaacaacttgtttggattttggtgaaataagtgtgttagaccagtagtcacatggaataaaatatttctgatgttcatttagtgatgtttctctttgttactgagatatgtcaagtttctgtttggctctgataaacgtcaggtctctcctacctcttcatagtttggcagcttattatacattaaacaaatatctagaaaacacctcctctatgccaggcgctctgtggagctctgggtgtaatcagcactaagatagatgaagacctttccttcagagaataaaactagtggaaattccactctagtcatcctttcctagcaaaaacatgtgtcccgttttccagattccaagagatgggaaatttcccacatgggcttaatagagataccctttggatttgttttttagaaatcatttatcaatgtatagggatgaaaatgacatttttctggaacaactttttcacattcagaaaactaccttcatgatttctgagaacctgacagccataaaagagaaaaaatgctgtttctctgtgctctttgtaaaaaggatcacagcaaatggaaacttcaggcttcttggaaaggctctagttctgaaagattagggtttacactctactgttaaactagactttcagagatgagggctaatgctcaacttggcattggaaataatctgctttggcattatgcaaaaaaaaaaaaaagttaggttcacattgtactgaaatagccaccacctgtggaatttttagaggctgtttttgtttttatcatgtcaaagcatttctactcagctcagactcaccattccgagcttaggatgagaggcagctcatgcccctggaccaaatgagtttatcctggagaaaactctagttccaaagcaacatgcaacttcctcgaggtttggaaaaagaggcttccaagtgtagcatctttttattttataaaactcctttccctgccaaacatttggtcttgcacgcatctgagggtggggcaatgcttagaatgagagtgagaaacacaagatttagtaaaagcgttgccagatactctgcttttgaaatgttgcttaaaataaaaaaacacttttctccttactctttgatatgaataatgaaaatatctttcttttttgccctggaaagtatgttaaaaaaaaaaaaaaaaggcagtgttttgtttgtttctttcttttaaggaccacaggcaactcttccatttgactcatttggctatttttgattattggcccccgacacgtggaacattgttcagatcagtcctagagggcccagaatggccagctctctcagtatctcatttttggcaattcaaagcgcaatttcccattaaccccgattgcctccttcacacccctggaagacatgcacttctctcctactaggtgagcccacagcactcctaaagactgcgcagcctggaatcgaccccaggcccactttcccaggtttattttgcgagcacagtgggtcagtctggcaagtgaccgtgaactgccagagcagtggcaggtgtccttcccagcagagagctgtcgaggtgcacaatgtgggaaatatgctaatccaaggggttgggatgggagccccaggctttgttacctctcagttgagaggcctcagtgagcttttgacaagatggagctattgtcctcctgggcctccaacaggatgattcagaggagaaccacagtgtagatcaaaggatggaacaacaggacctgggagcaaaggctaaatagccctggtattattttgcctggagaagagaaggctggaggtggggtgggtcaagtaggccataatggtgaaaaagctattatgtcgtgaatgtgaccagctgtccgacattttgagtgagaagaaaaggcgtaggagaaaatgaatgtaaactgcaatgtgagaaatttggttgacataaggaaaacatttcaaacagggagcgttgttagacgctaaagttagtgacagagggaatacgtttcttagatgaactttaaagctgtgatttttcagtcaagaggtttgaaggcaaacttgctcggatgtagggagtcaataggaaaaaatgttgagacccacttcacttaaatatgtgcaacatatgatttaagcctttgcaaactgctctttacaacggatattttctcagaggctagcatcagaagctgctacacaggacttctttgaccttgctttaatgatttacttagctgagacaggaattgtctttgtggctaagtgattgacaagtaccttgggtgatgggcattctgattccagttctgcagctaaacaactctgagacttccaacaagcacagaacctcaatttccttaactgtcaaacagagacaatagctctgttctacctcataggatggcttggaggaacaaattataaaaggaataaaaagcacactgtacccaagtatgtagtaattagactgttcagacctcagggctactcccaaatacaaaagtgcttggctctcttagcattgttttaaaaagttactccccaaccagactaggagtgagaaaagagaaggatcaggggacaaacggaggattcaagaacagagttcaagatggtatgggggctgttattttattcttgcctctcccaggtctacagcccaacatcaagcaaaactgggtggtatataccagtgcaaggcaaacacccagttctttgattaaactgtgacctctgcagtttgggtcatttcaattggaaacgtttctccatgaaatcttcaaataacagaactagaaaactccattgccgttagtgtttctaataggtcagtcttaaagaacttttgaaataaacaaataaataaacctcagtgtttcaacacagtgataaagtgatggaattttttacccttagtgtgggttcagaccgagggcatattgagtcacaatgaaagaaaaaaagccttctacagagaaaattcttttaaaaatgaaggcaaactcaaaagaccttttcagataaaggctgagaggttgtgtcccaagcagatttgcactacaagacatgtaaaggaggctgtttagagcacgcctgcttcttaaggttgtagtcagttggaactctgttcttctgtccctaatgcttctgtgctgctgcaatcagagacggaaccctcaactgtggcagtcatgccactctagaatgttcaaggtaaaaaggaccatgtgagcacattttaccaaattcctttattttccaaataagaaatagatggtccaagaaatagaaacaaagagtaatggaattagtagggagacaatattggaatttgtccccaaatcttgtggttgcccagtgatatgatttatcccactggaaaggccacagactgatctctaatggggtaaatatggttcacaggcatatttcatttggcccacaaagtggattttttaaaataattttaaatttgttatcttgaaaaactagaagacatggttaggtgagccatgtacctacatggaacataattataagtacatgagcctacagctggagttccaatgtttccttccctttttagatgaaaagtactcttttgtttgccacattcattaccactccctaacgtctccctgatgatgaagccataggtgatttagaacgtatctccatactcacacagatgctctcttaaccatccatttcactcatttgtatgattttcctgggctatttacacatttaattttgcaaacccttccctaccacatgctgcttctattttcctactcagcaaaatcattcacaattattcctgcaaagaacaaagaaacaaaaaaacataatgaccacatgcatatatgacatacctctgatcctgtagtgataatgtgtatagccctggagacatacacgcattcacaaagcagttcaagagactggtttattttactcacttttgcataagactctaaacattgctgaagacccacttttgtattccagtattctgaaggaaagtgatgaccatgttgacatttctgtccatttctgctgagtaaaagggggcctcccctcatactctctactgtgttttctaatatcttttagggaagatggggtaagagaatctattagttttaagacactattaaaaagatagacacatttgtccacccaaaaatgtgtacatgaattttatagtagcattatttataatagccaaaatgtagaaacctagatttccatcaatgataaaagaagtattctatacttgtacaatggggtattatttggcaattaaaaaatgaagcactgatgtatactacagcatggagaaatcctgaaaatattatggtaagtgaaagaaacgagttgcaagccactacatattgtacaatccatttatacgaaatgtccagaataggcaaattccaaacagccagattattgccagctaggctagggctgggacattgggaggacatgagaaataactgatactggttatgaggtttcttttttcagtgatgaaaacaacctaaactggattgtggtgatgggtgcacaactctgagaatagtacactttaatgggtggaaagtatgtatgtaaattatatctcaataaaaatgttacttcaaaaagataaaataggataaggcttttgaaatcaggaaaagggaaataatatttttgggtgagctgctacgggccaggtagagtctgatgtgtttttttatatattttattcaagcctcacagcaaaccgccaggaggttttattctgtccatttcacagatgaagaaataaaggctcacagagattaggctgccttacctcgtcacttgcgaagctgagttctgaaccagatttgactctcaaacagcctgcctcgccccactgctgctcagcagtcacgcagcgttttctccttctctaaagacaaggaactaatagagacttgcctccactggttcttattgcctcatgtgactatttaatgatgagcaggataccaactcttctttcctaaagagctaccctgagccatgccagctgactaaacagtctttctaaagtcaaatggggcctttttttctcaaggtgacatgagtgcttttctaaatgcagagctagactcgcctaaaacaattctctgtctgctgtctgttggcattttctcatttacccaatatcctccttgaactcacctctgcttgctccctcattccacattacagctaaaaacattgtctaatgcagttttccctccctaccccacccctgcctatataaagcagcatccaggtagcagtgaacatgtttacgcctcctaattcttttgttacacatgtctctaatcattaacatcgaatagtgcttacaaattaattcatatgtacaaattcctcacctgagcattcaaaatgcatgaatcagcatccagccccaatcactttaagaggttacattaaagcacagatcattagggagcatggataaggtgaggagaagggagagagattcaaatagaattcatgttccttgccttaaatgaggatcagtctgagctatatacaagtgggcagccagcagagagcgtctgggatacaagccatctccaagccacaggcacagcctgcgtttactcacatcacaatccattatcttcccagccaggatccaaatcttacctctactgaagcaagagccaaccagtgacctcagctgggtcatcaggaccactgtagccacttccagcctcagctctctgatctgacagcctcagtcagcccttactttcctctttctgaacagggccagtgtgcttcctcctgtctgtcaatatttaactacgctgtcaagtcacattacatcacctgcactaaatcccacccagtgatagctagagggtgtgcctgctctattcaattcaactcagctaacctttatctagtgccttccactcattcatttctttccacatgtactcagcacctactgcatttggcattggggatagagaactgaaagatccactccccagattctagtggaggaaacagacaaaataatgtggtatgtgctattgtgctagagcacagagtgcaggggacactcccattccaggctggctggggaggtatggagcaaacaaagccagagaattcccaaagatggcaacacttagagtgacatctctaatggaccaggctatatcaggaagacaaaaggatgatgcatacatggcctctgtcctcaaggagcttactcccagcacaggttgctctatgttcctacagatgaacaggattgcttacataaatgccacggcaaagtgcagaatattaaatcaaagagggcagccctttcttgttgttgttgtttttttgttttttggtaagttgtgtcctgaacaaagatgtctcaacagtgaaagctggctgtatcctatagatcccttggtgctacaaatcgagggggattcttccaagagccgagagagcagataaacccagtgaataaaggaagtgtctgtgacccattttcaggaccaagaaaagaagaattcaggtcacagagtaacatttttctctggtcaaaggaattaatctggtacaaacaggcttggccaaaggtaaacagggatctctcacatgccctcctaatctctctatgacttttctaaggcaacatttcctgacacttaatgaagtgttgatggctcttttaaataatagagatagatatgcagaaccacttggcatcactaaaactgcagcctttaacttcgtctgtgatcagaagcctcaaaagctattcactttgggattttttttaaggttgaatttaccaccaaagcatggctctcaaatgtacccatgcaatcccttttctaccaaaacttactgcagtttcatgcaccagagaacaaagacccccatttatgtgtgaacattcaaaggaccccaccaccgggaagcctaagaggctgccacggaaagtcccggtatatttgaattgcaaaacacagcctggggatctcaatacatctaatttgggacatgttccaagctcaggagcctctctgcatggaagcagctttattagtcactttctcagacaattttctagttccacatgcacacttccccaagtgtttccaagacgaacatttacagtctgttgcaatattttactacaaggtatttagggttttgacaaatactaactgacattgccaccattccagtgaaaactgatgacccatagctaatgcctgcttcttggttgtggctcaagaccgttttgagccagtcagtgattgtaagcagaatgacactccagacctctccttcacatcctggaagcacagtttgatttcagcccattaatacattcgcattgaatgttgaatcgtcatgaaactgaagtgaagtgaagctgcacctcagtcaagcctgttctttttttttaaaccaagacttattcagaaccctttttgcttactaacatataacacacttggcattaggaatattatatgttattaattggggaattgttactactaattgccaaatgcccagggacttctggatccaattagaatggatgtttgacatttatcttgcaatcccactagaaggacaaggtgctatgtgacctttagttggtttttaaaggcagttttagtaaattttagcccacatgaagtaaatttttcaaataatattatgcatgtcgtgactggtgagataactatcagctcatggaaaataactagcaaatacaactaacatttccagaagtaaaccataagaaacttcaactttcaaaagagaatatttaaaatgaattctatttatctcttgtgtactcagctttacaaaatacaagaaagggaaggtttttgtttgtttgcattttgttttcaataagaagtcttaaagagaagttctaaagcaagactaatttctccaaatccaattgaataatattcatccaagttagaaagcaactggtattgtgcactcatcatggcagaaaagtatagatagagaacttgaagccacagttaatttaatgtgaccctgggcaagtcaatcccataattagggtctaaacctgctctactgaaactaaagtgatggattgtttaaggtacacaccaaaactcataggtgtcagggagtactgtgccttttaaacccatagttatagggttaagaccctataacttgtccagggtcacaaaagagtccttctcaggctgctgttaatgctctcaattttctcaggcctcagaggtttcccaatcagtgtgactgtcagtgccaacaccagaaaagtccctggccgaccaagatggccacccaacttgctactactcagataatgtcggaacaccatcttggaagtgatttcatattatatgataaataattacgcatcttgtctgagccagcaagttctgattctttaaaattcagttgactttttgaaatagctatcatttgtagccaggcttaatagatgagttttcaaggtgagtaaaaattgtgatgtgaaaaataaaatgttttcattaagtatagagatttgactttttgtgtggggttcagaaactaaacccaaaacaaaaatgtaaaaacctagaaggattttacttgctactttgccttgctactcatggtgtggtctgtagggctagcaatgtagcctcattaggaacgtgttagaagtagacgaacctggttgccctaaatctcctgaatcagaatctgcatttctacaaaatccctagtggttctgaggcacgtgacagtttgaggagtcctgttttagaatttgtttaagcctaggggaagggcaaaccagcctccataaaaacacttgatacagtcataaataaaaaacagtcttgcaattcaaagcattttgacaaaaaaaatgaaaggcattgttgtaattgatgttttctgggccttgtgaattttaacttcagagctgagaaggccataaaatatagttaaactctaaatgaggccaatgattaaatggttttcctacaagggagccttgttggatgccagggcccacttcaaagagtggagcagtcagtctgcgggaattcccctctatgcacagttagtcaccaacctctgttccaaacatctccctggttaggggatcaaacccagggtgttgcctaggttttaatggtttacatctgaaacattatcgcacaggtgaagaatggggatagagggaatttctaacatacagattgagaggactattttgactgtgagatttgagaagtctaataaacacctatgtggagaagaaactggtatttgaacataggagtctgaggcagagccagtcagaaaacagtatgtacgtgaaacatccttggaaagtaatcaggggggtagtcagcttatggattatatcagaaaatgagggaataaaagattacaattatagggagagcatttcaggcctagataacactggaaacagatgccctgtggcaaaagggaaaaagagggcagagcaaaagaaagataaaaagaagtgacaagcaaaaattactagatgataaagtgaaatcaaaatgaatgacaataacatatagagaactgcaatagtatgaaggttaaaaagttttccttcctaaaacagaagatgcatattattgtgggaaatacaaaaagagtctgaaaccaaattctaaatatttcaaatggggagtcagaagaggactgagcacagagtttgtatttgcatgtaaatggatatttggtatgctaaacagaaaatgcacagtcttcttttatgcttatgggataaaaattcacagaaaataattatgcatgtggccacaaagaaaacactgaaaattccctgaagtgaacgaggaaaaggcaaaaaacacaaaaactctcaagtgcctttaaattaaaaaacagtcttctaaccaaaccaaggatagaaaatgcaggccaggcacggtggctcatgcctgtaatcccagcactttgggaggccaaggcgggaggatcacgaggtcaggagttcaagaccagcctggccaacatggtgaaaccccatctccactaaaaatacaaaaattagctggacgtggtggtgcgtgcctgtaatcccagctacttgggaggctgaggcaggagaatagcttgaacccaggaggcggaggttgtggtgaggcgaagtcacaccattacactccagcctgggcaacggagccaaacttcatctcaaaaaaaaaagttcaagttatttagacataaatacaacaatggagaacacctcatatcaaaactgtgatgcagtaaaatccagaggaaaatatatagccttaaatgcttttatttaaaaaaaaaagatagaaaataaatgcattacacattcagccttcttaaagtcttccaaaaaaaaaaaaaaaaagacatagaggggctatttccaaatttattttaagaagccagcatcatctaataccaaaatcagatacagacactataagaaaactgcaggctaatatctctgatgaacatggatgtaataatcctcaacaaagtattagccaaataattcaacaacacatcaaaaagattataccttgtgaccaagcaggatttatcccagggatgcaaaaatggttctaacgatcataccttattcaagtatggaaattcaaataaagtatgatctttagttaataagagtgtatcattaattgtgaccagtgtaccatactaatgtaagatgttaataataggagaaactagatgagaggtatatgggaactctgtactatctttccattttttttctgtaaatctcaagctgttctaaaaccacacaaaagtctattttaaatttttaaaataagtagataatttctgatggtgatatacagaacataaagtagtgtaatgcagtacaatgttctgggattgggagggtagccaggaaaggcggtcagcaaattttccctgcagcatttgagctgagagtttttcataatgcagtagggagagccatgcaaaaatctcagggaagatattctagcacaggcacaacatcaaaacacaaaagcaacaaagaatcaattaaactgaaagctggttatttgaaaagacaaataaaacaggtaactctctgtcattctgattaaggagcaaacataaaagcatacaacataaagactaagataacagacataaatgagtaggaagacaatttgaaaaatgataagactatgtgagtgacactgcatttgaaaatgggtattttttaagcaaaacattaatgactgaaattaatacaagaagtatgagacagaagtacacaaaagaaggtaaggtaataaaactgtcactaaaatgttatagttttaaaataggcaaatatagcatgacagtctgattttatttaaattttaagaaatagataattcccatataatttaatttgtcccagaaaagagcaaaatataaacattttcataattaactttactgagccagcagatccttagcacagataaagaaactctgataaaactagcacagaaaaagaaattctaatttcagttgtaaaattaaatagaaacattttaaatagaatgttagcaaattgtattcagccttgtaagaaaatcacaatgcaatgtgagaaaatcacatatgatatgaccgagcacagtttattttagtgatataaaaatatgttagcattaaaaaatctatcaattaaatttcttatattaatacatcaagatcactggaaataagatacatataaaaggttatcatgcttatttatactatatagtaacagaaaagaaaattaaaagcaaaatcctgaaattctgatgcatctaggaataaattttacccagatagttcaaagaagacctatatgaggaaaatgtttaaaacttgcatatgaattaacagtagaaataaatgtatatttggatacaggtattatcataaaagtgatgattgttcccaaagtaatacataagtgatataattctaataagaattacaacaggattatttttgaaagaacgggcactaggcaaaagtcactctacagttcatgtggaagaataactattcaagaatattcacaaacctttaaggaagctttgtcctacaagatattaaaacacactttgaaatactatcaccaaaacagtagctaattgctactagtgcagggaaaataaatcactggcacagaataagaagtctagaaccatgtccagaaacagtgccagaaacttaattatgataatattaataaaattttgataaaactaatatttcagatgagtaagaaaatcatgttaatcagtaagttacattattcggtaaattatatgagggtatttgctttgtaggtggaagaacatttcattagaaccctattttacacaatgtgcaaaacccattcttgagggatttaagttagaagtgcaaaacaaaaccctgaaaagcaagagcattgtgaaacaatatattaaattacttttataaactcggagtaaaagagataagatattcaactcagaagccataaagggaaaaatagacataatttacataactcatcacgtgtttacacaaagatactatgaaccaagctaaaacacccaaaatatttccaatttgcactagaaacagactccggtagaaaaatgggcaaagaatacaaacacacaatttataaaagactgcaactggacaatacgtatttgaaaatataggctactatagtcagtcaactacaaattgaacaatattttacctattagattgaccaaaattataaatactaatagtatctaaatgttattaaaagtgttgggaactaggcagttgaatacactgttggagaaagaatgaagttcctataatttttttagaaattaatttggcaatattaatttaaaatgtacatatgattggaccagcagtcacttttaggaatctctcctgtgaaaataaatgcaagaccacataggatttatgccctctgcgggacggttataacagcacaacactggaaagattctgaataaccaccagtgggtggacagttgcagaaattatgccatgtggaatattatacaggagttacaaagggtaaggccattctaaatacagtgcctcagaagaaggttcatgataagatgttatgttaaaaaagcaagtaaaaacaacagtattagatgattttgctttgctttgttttaatttggagctacttttttttaatttccatttttattttggattcatgcagtacatgtgcaggtttgtcacaagggtatattgtgtggtgctgaggtttgagattctaatgatcctatcaccccaatagtgaatatagtaaccaataaaaagttttacagtccttccccctcttcatccctccatttttagtccttgcctccctccctccttcaaggtctactgttcccagctgtatgtctgtgtgccccccagatttagcttcaacttataaatgaaaatatgcactatttgttttctttttctgtgttagttcacttaggataatggactccagttgcatccatgttgctacaagggacataattttattttttatggctgcatagtattccacggtgtttatgtaccacattttatttacccaatccaccgttgatgggcacctaggttgattccatgtcttagctactgtgaatagtgctatgatgaacacatggcaatacagtgcatgtatctttttggtagaacgatttcttttcctttaggtatatacccaataatgggattgctgggtcaaatggcaattgtatttttagttctttcagaactctccaaactgctttccacaggggctgaactaatttgcattcccactaacagtgtataagtgttccctttttctccacaacctcaccaatatctgttattttttaactttttaataatagctattttgactgatgtgagatggtatctcattgtggttttgatttccatctctctgactagtgatgttgagtattgtttcatatgtttgtcggctgcttctatgtcttgttttgagaaataactgttcatgtcctttgctcttcttgattttttaatttttgtgggtacatagtaggtatatacaattatctttgcccactttttaataaatttgttttttcttgttgactcatttaagtttcttgtagattctgaatattagtcctttcttggatgcatagtttgcaaatattttctcccaatgtgtagtttgtctgtttactctgttgagagtttcttttgctgtacagaagctctttagtttaattaagtctcatttgtctcctttggttttgttgcttttgtttttggagtcttcatcataaattctttgcctaagccaatgacgtgaagagtatttcctaggttttcttctggcatttttataatttgcggtcatacgtttcagtctttaatccatcttgagttaatttttacatatgatgagaggtaggggtccagtttcattcttctgcatatacttagccagtttttccagcaccatttattgaatagggagtcctttccccattgcttattattgttgactgttgaagatgagttagtcatgagtgtagagctttatttcagtgttctctattctgttccattggtctatatgtctatttttgtaccagcaccaactgtgtatgtgcatggttgttgatacatgaataaaaaatctcccaaatgggtataatctgagagttatcactgggtccttaaggtggattaaatagtgggggtgggggtggagagggagaaggaaggaggagtgagggaagcctattcttcctttctacaggtctgaaattgttaaattgatatcatcaggaagccaaaattttgaccttataaatcatatactaggagaaagggggaaaaagaaagagaaagaaaaagaaagacagagagagagacagagagttttctagctacacaatgttttcatttttcatggaaataaagcttcatttcatttctagggtcatttttccaaagttcaaggaaatataacatgaattcaggtttccagttccagaccatgtgctgatgagacagataggaaactagcactgcatttaaaaatacttcagaatattgaataataattcccctgaaagcaaatacccacagaatgctgctttcctgccaggttggtcagtcatactctccatgttttatatatttaaactggccatttcaagttgtcttcagatgtgtaacctacttcctgtacagaattaattactgtatgttgatacaacattttaatcaccacccactctggacttttagaggtagaagaggagagaggtgtagacaaccgtttccaaggtatacagcttggaggccctgaaggctttttctttgatgtgaactttctgtttcactgactcattcttggagaaaacattccgaagttgtcgaagagggcagctgggatctctgcagctgtaagcatgaatatgtagctttacgatgcttgcacagatactgaggcacaaagaaccaggataatctgcttgaggagtggcctttttgatggcagaacaaggtttttgtttatttgtaggaggcatattttatttgtagcaatcatacctatacttcagaagcaaatccttcttcataataccatcatcaaagatgggcaaagcaatgatgctgataaagaagtaaggaaaaacacaacttcttttatcactaaaataagaaacaaacaataagttttacttggattgaggaaaggaatcaaatccatttacatgagtataaaggttcaagaactgaagggtggttactgatttataactttgtaaaattgcccatggaagagagggtcccatttagaagaaataaatttgtttctctctgaaatagacacattcaccaaacacatggatccgataaataccaaatcatggaattgatcattatatcattccttaacctttgcttcaacagccacaaatcaggtcaataatcacctagcctagtgttgtcctttgtcacagcaagagcacattaaactttgaagaggaaacatcatagagtttacaatagaactgcaggactcatactaccaaattatctgtatcatgcaaccaacttagcatcattatagtttcatgagataaaataaaaattgctcattcattattaataatctgtttccagcacacagaattaaaaaacaaatacctgagaaaagcagaaatgctgataccctaaacatttatttaagtcaaaaagactcagttgagtttaaaatattgcatttcccgtctcctggtagcacggatcactgaagtgctttgagaaccccttccttcctccatgccacccaaatgctcccagtgcctgttgttgctattaagccagagataaactcaacatcagggttatctatcctgagcactgatggactcggctccaaatacaagcctgtcaagtagcttgtttacagcaagtcttttaaataatgaaactgttccctctaaatacctggccgtcagggtagcatgctcatttcactactctaatactcctgcaagactatgagctccatgggctccacaggaaatgataatgattttgctcatcaatatagtcttagaacccgacacagtgcctggcatatagaagacaatcataactattcatggtgaatggattatatgttaagaatttctccactttatgcatctgcacaatatcctatgaaatggggatattattgttcttttatttctacatttctggggattcaagttgcttcttttgtagtattttaaacactgctgtgatgaatatctttatttttgtgatctctccatatgttagattcccaaaaggagaattaatgggtcaaagaatcagaacatttttatagctcttgacatataatgcaaaatgacttctggaaaggatggaaaacagcatagcaccagcaaaacacagaaaacagttttgaccactttcccaggcataccagctattagctttttaaaagagatgataactaaagggaacaatgaaatattacctaaatatctgttataaatttgtatgactttaatgtggtaaattggacattttctctgtttatttaactagttagattttctgttttgcatatcaaccaaggaatgatttgatgtggcttctgctgtgtgaatgggaaacctttcatagatacttggagaaactttgacactacaacttctctgccaatttgataccttttactttgaatattcctcaagagaatgacaggaactttgaaaactggagtttaggtgatacttccactgttccagggatctctttattctatgtatgaattccaagagaccaggagcctcttagatagattacttacatgtgtgttgataaatatcttcagaggttttcacatgggaagaattagtgagttattttgcagagttgggccagttttacaggccaataaataatgagctaaataaatcacagtcagggaccagcctacacagagaaattgtatacctacaaaagttttagcagtaatgaaattgaaagctgtcaccaaatcctgttatctgtctggatagaaaagtgctcaacaaaaacactgatagcgtaggagatagagaattgaattaaggccaaagaaacctttcagtgaatggcagattgaagacaataactgagtaatagaataaaactttctcaggaacccaagtcttaataaattgctctgtaagtactttgggactacagatctatctaacttctttaagttcccagggctcaaggacgtttggttttgggaggaggcacctttaggatgtacaggaaacctgggcaactcataatagggcccaaggtggaatccagttcgtgtagtccagttaagtttggtattattgtgtaaatacttatacatgatttccagaacaaagcattctctcattgttccagacactcattgcttaaatacttggaatcaaaaaaaaattctaagaatgcttataaaaatattctagaataagtatttaaaaattctcaaggataatccaagatatgtttagtgagcccagtgtttacctcttccttcctttctattttgccaggtgatgcttgatagcaacataaaggttacttatctttaaaaacgctccttttcaagaaggattagtatagagagagctaaatgttaactacaggtaaacaaataactgcattctataaataatttcaaggaaagttttcttttcatgtctccctggagatcgtacttgagtcagggagaaaaagtaaagcagtaaagtcaagaacataggctgaagccagagggcctggtcaaatcccagttctatctttactcgttatataatttgggatgaaccattaaactctatattcctcagtttcctcatctgcagaatggggtttatagtgacaatatctatctcatagtgttgttgtaaaaatgaagtgagttaaatatgtgaaaacactttacaatagtgccaggcacatggcaaagtgtattttccattctgatattatgaacatcttaagagtagtttataaaactgtactgcccagtacccaacatcattccagcacatagtaggtgattagtgaacaattgctgaatgaatggttgactataaaggattttccaccaatattttttttaaaggaccacatttctttgtatcttcaaagcatgacttaattcaatacaggactgacaggtaactttcagaaacaattccagggttcagagtatgcacacctgtacgtatcagcagaatgaataatgagagagcaatgaacaatattagataaaagctaggagaactatagaagacaagtaagagtcttaacccaaatccaaaagactttgaattaatgcaagtattatttccttggcaaagccctggcctgcccttctaatcttcactgataaggccatgactattacaccatctgggataggtcaagattaagtgaagattctgatctcatcactaactactcttatattcaagtgggggttggagagtgggtgggaatgtttcagggagagatcttctaatgacagattcactcatgtaatgctcaggaggtgatttaggcctacttaatctccaggacatctgaaacaacacaatttctggaacaacttcttatcctggaaaatcccagacgagtttaattatttttttaatccctgtgtttagtagtcatatcactcaccactgaaatgcagttcttgttgctggagtaaaagagagcaatgtttttaataggtaccaaagataataggatgactaggcacacagctcacgtcactgaaaacggagacagactggctctaccaggttggaacgaagccagtctctccagggctcactgtactctaggtatggcatcatcagctcccctaccggacagtgatgaggtgagagagtaggcaagagaaagagggagagagtgagtgattaaatgaacaaatacagcaaagttagagaaggtgctggcctacaaaggttttagttaaaaaaagcagggaattttgcattaatgaaatccactgaataatcggtttaatttgagatatccacatgtggctagtggctggcatattggacagggaaggctgggtgagttcacttgatatctctgttctttttctatctccttcatggtgttctcttctctcacctgccacttccatgtcggggttcctttttggttccctgcttttgtgactctgctcactttccatggctgaccttgagtcacctcacattctacgcgatcaaaactgaatttttcgtcttcctttataaaatagttactcttcatgaatttgttagttcagtttgaggcattatcattcacccagaccctcaagcagggaactatccttgacagctcatgcccctccatcccatacatgcaattaattttcaattcttgctatatttaccatccccccactccccaaatctatccatgtagcccaactacaagtatcttctccaaactgtcatcctctcttgcctgcattccacctaacattcttctagtgcaaggattctcagttctggctgcctgttagaatcaggtaacggggagtttaaaatatggccagaacctggatccacctccagagatgcggttttattcgggatggaatagagaccaggcatcaccattttttaaagctctccagatgactttttcagagtcagactgggactcacacatctagctcatcttcctggctctagtttttttgcacctatggccacaccataaagaagcaccacagggctctttacagaacattcacttgtccactctgcctaaaccctttcaatgacggaccacaatctagaaaatgaaatccaaattctttgacattccctggcctttctagtcatgtactgacattctcggcctcacagctagttccccacctgcaggtgccttttcctacctgtgcttgtgacctcttctttgctcagatccccactcttcacctggggaacctctactcatcctgagagactcggcttcggcgtcgcccttctaggaaatctgttctcacttgcttatgagaacagattctctgtacattgaacatcctgtgcataattatatgtatgatacatcacgtgtatgttaacatgggtgcctacacctggatgccccgttgcctatgagcccgttttctcagagcatgtatggtttatacctgctgtctcctttaattattaatggtgctcccttgagtctcaagggtatctgtgctaccatagatgataaattgcagattaccctccttgtaagattgttgaggtcagtaacattgtcgtatttttcattgggatctcagtgcctaacacttcttctaaaacttggtgttaatttatgtgctcaaaaaaattaatgaaggtgctgggcacggtgactcactcccgtaatcccagcactttgggacgtcgaggcgggcggatcacgagatcagaagatcaagagcatcctggctaacatggtgaaaccccgtctctactagaaatacaaaaaattagccaggcgtggtggcaggcgcctgtaatcccaactactcaggaggctgaggcaggagaatcgcttgaacccgagaggcagaggttgcagtgagccgagatcgtgccattgcactccagcctgggtgacagtgcgagactctgtctcaaaaaaaaaaaaagaaggaaagaatgaagtatttacctgggaaactatccttttacctccagaagcacatggtaactgttagaaaggctggcgtaaaaaactgaacaaagaaacaaatggacacatagccacttgtaaaaaaacgtgattttagagagtaaactaaagccttctttctcagctgaatattactttttgtacttttgtgtttttcccgaggccctactgatgttggggaagttccacatagtcatcaggtaggtatagatgattcctaaagcagccccagccagcgtcagttctcagaagggcagctctgctttttatggccaaggatttagaatctgatgtcagacttcttgcatgtgaattttgctcctccactgggaggacatttgacttcagttaagttatttaaactctccaagcctgctttataaataaggatgttaaaagtgcctaccacatacagttcttttgagaattaaataaggaaatctatgcagagagtttagcatggtgcctgtcatagagaaagctctgaatagagtagcccttattattttatctattttacttgttgaacttacaaatatttcatttgaagaagggatttgcctgcatttaaaaatactttgaaaaatcactgttccagaatattgggattgtagagattccaacccagttcccccttgggatttttgtaacttgagttgctaatggagccagtgttatttctttcctctgcaattcagcaacctaagtccataccttgcctgttcactagtacccattagtggaaaagaaaataccaacccaggactcatatttcagtgtgagccacaggtgttgttgggtgccagcttctggcagcatggcatacaaacaaatgaatgctcttgccaatgttgggaatattactgcagtatgcctattacaaatatttacttttttagctggaatatcaggggacactagggtttctgtttgaacagtgctttgaggcagaactcattgaaacaacatggaaagctttgcataaataaattcttttatgattatacttgtaacacatcgtatcatcagactgcaaaataaaacttgagaggataaataatcccagttatttgcacataatgctagttactaatacagagctgtagataacttcgcataaagtataataagagatatttcatttttggtaaaaggctcctatcaactagcattgaaaaagcaatataatttgtgagttacaggctgggggttatagacaatgcctttggagtcaaagacacataggtttgagaaaataatgcacttaagagtgtctggcacctaaaacaaatgcaacaaattgtaactcagagtaagaatattaataataactagtattaatatattattctctagggatatttgatatagttctaccaaacagaaatgattagattatattttgttctatcctatgttattttttactgctgcttttgtctgtaattttaaatcaaccccaaaatattcacataaacttaaaacctgacttcaataatttcaattttctctgagaagttggtggatcaacacagaagtgtggaaatgaaattgaggtgtctgcattttcatgaccagcaggcatgataacttgtcctaaaactgtttgatcttgttacaatttctgctgaatactttgagtcatgcaagaatatagaatgccttttattcaaaagcttccaaaagagagatagcatccacagaaattcagagtgagctgctgaaaggcaatattaatcctgatctcgggatattacgctaaatatttgacaggaatccaaattttcctgtagccttccactaagaagataatctttcataattttaactgtgaaaggggaggatttgatcctttgaaatggaaagggtgagcctaattgaatttccttctttggtttcttattaaagatgggaccagattgaatcatattcaattaatgattgtacttggatatattgctcttttcagaagctgaaataagattaacaaagcttgaaaaagatgtcgggggcaacagtgccaattcaacacttaaagggctaggcatacaaaagagcaaagccctatttcaatgccgtttatttacatgatccttgagcaggctgggccattgttcttgaccaattcaaggactgagtagaaggttgtgtgaccttgaacatcagctatggaggcaaagtaaacatacaaatgtacatatgaatatacatacatggaaataataattaagacataccattctgacctgccctctcttctgactacacaccaaatacaccatgatccttgtcaatgatgagtcagtatacccctataatgtctcatctaggcctacccaaccacttttctgtctgccttcattgctcaggttaaagaatgtcttcttctctaaggttttatgcaagtctagtaaccatggaaccatgttttatggactaataattgtgatacaaaatataacaagtaaattagcacaattactctgaagattttaatactgggactgtccaggagcacaatgcctacataattagtctccataaaattctcccttttgtaagcgttcctcgggtatgttgtttctatgttaaacattaggatttaccacaatagacctcacattatttgctaactgtctcatgtttctgtttgtatgatatactgcttcactggtgactgtgtaaattgactagccctttatttcttcagtgtctgcatagcacaaaacacatagtaggagcttgattggtacttctccaaatgcagttggtgtgtgtgtttgggaggtgatacaagtttggaagataaatctgaaattagtatcctagctctgacccttgacatctgtgggagcctgagtacgtttccacatttgtagtataggcataaaaatacaaatagtacatgcactgtgatgatattgtaggacatttgtgcagggactggtatgcagtaggagctccatccacagtcattctgttgttgaatgaaaacactggcttaagaatgattttagaaggccaggcccagtggctcacacctgtaatcccagcactttgggaggccgaggagggtggatcacagggtcaggagatcgagaccatcctggctaacacggtgaaactccatctttactaaaaatacaaaaaattagccaggcgtgatggcgggcacctgaactcccagctactctggaggctgaggcaggggaatggtgtgaacccaggaggcggagcttgcagtgagcagagatggcgccactgcactccagcctgggcgacagagtgagactctgtctcaaaaaaaaaaaaaaaaaaaaaaaaaaggaaagattttagaatatgagaggcaatggagtatggtgctcattggcttggggatcctccatcagactgcctacatttaaaccccaattctaagccttccagttgcaagggttaaatgactgaatacatataaatcccctttgagcgcctgacacagacaaagatttagcttcagtattattaaggatgaaactacttgagacacacaaatgaacttggtcaattttcaaggtcttttaaaactcttaatctatattcctgtgaagaaataatacatgttcttgcctttaaagctccacatattagaaaacacaggattattctgagacagctctcacaccctacagacacacacactcacacacacacacacacacacacacacagagcagcagcagcattgtctaggtctaattttttccttcctctgtcaccctcatatgtgtgctaattgtagtaactgtgagtccaatcaatatatgttctgtcataaggagagaagaagctggactaggaagatggagttgacgctatacctgacattcagtttgaaacactgaatattagaatgttagtcttttccagagggtctgaataaatgacttgtctaaaatagattcctgaggaaaagatctagactcagaatcatgcattgaaccagaattatcaaagaaaagcctaattctaataaaattaaggctcttccagcagatggactaggtcagcaaaaggtgctctatttaactaactggaagtctttgcagcgttaggatacaaaacatttaccaagaaagtctaggtacaaattgcccatgtaatcacacatctgtgaatttgcagagttttcaaaatcatttagagattccaaggaaggggtagtgtgaactcagcaacaaaatgaaaaataaactaagataataaacttactttgtgatctactcagtatttaaattctttgaaatagacctcctctagcaaccaccattccacattgctttcattcttctggcctggttgcctcctcttccctttcctttaaatgaggtcttcataggatatctcagtttctttaggcatttcctaagcgaactctcagggaattaataccatatctaagacttttatttaaatatagactcttctctgtatcagtttcgctctttcagtctctgtcataaaaactctaccaggtatcattcttttttttcattcccaaatacaatataattgcatttcaagttacagaaactgaaaaggctgctttctgaatggaacaaaatgtcacaacaaaaaagacccactggagaaacacggacagagtgcaatgtcataggaaaatccagaatgtggagaacagcaagttgccagagggttccctgcagctacccccggaacttaaaggatgttctgaaagggcatcacacgtgagctctgttcagtggttataagagtcaggtactggaatcaagacaggaaggaagaaagagaggcagggaggaaatatagagtggtagtaattgggctgaattaatgactctagacagagctatgcacataggaggcagtggttctgacaaagacgaccctcctctggagggacttgccccactcctccaccatcaaaaccttccccatctgtgagtcattgctgagacccagccttccctgtagctgttgaagctgcctaacagctcccctctgacatctgatgaacttattgtccgcaccaggggttctcaactagggaagaattttgctgcagtcatcacatccatcataaaaccatccaagcccccaaccccactgcttcccttctagggtgtaggtctcctaatggactgcctcctaattgatggttcccaggctattgccccagggctgagggccagctccctggtgctgtcaccacctttagccattagttccccagcacctagcagagtgtgggctgccaatggtgtttgttgaactatcgaaagggaggacttgtgacctcctgagatgaagaaaaaccatgtttaaaggggctaatatccagccatgacagcaccagtgccagacagcctcatgtcaggctgtgtcaggcagctgctcagatggcaaggcctgctgccctgaaggcttacctgcctgggagaaagaggcagccacagagtgctcctccagaacacccctactcttcaactgcatgtgaatttctgagtactgatttctagtaagataaacagcatttaaggttgcctcttggtgctagtttttaagatgatatgaattgcatagtccacaaaacatatttgccaagatgtagcatttctttttatacttattctgcctgatggcaaaatacaaaaacgaaacctaaaactagtccaggattgagagattcgcttttctcaagcccatttcctcaggggttcaggtttatgggactatggcattgggcactgaaatgttgtctctcgctgtctccttgccctgcctggctggggtcagtgtgaacttcacaagtcctaccagcaatctagggaagagctagtcctgcctggttccactttctgttggttttagatgcctttgctccggatagttctcttcttatcaggacattagtgaaacaaaacaactgtgctcctccagtaatggccactggctggtctgaaggaccccaaaacctcccacttggatgatctggtcatggcaatgcactgaggttcagctgcattttctacctcagccctggtaggaaacttcctgtttcactgagatgctcctccatgggaagggccctcctttcttgcacactccctctccttcggctaacttttggaccctgcttctggaaatttcctgagacctttgagctgcccgcagccgtctccagcatggatcaccactcttctccctgagcccaagcttgaagcatgcagacttccatcaactgcagctccagctcacccctgagtctcctccttccacttcaaacctgctctttcttcttcctaccctagagctgttttctctactggaagaggggaggaaaggatgagtagagggacctcttgagtctgtttgcgttctcctggtgatcttttcttttaccttcacaagtgacttttgaacctagaagtcaagattatggcaggcttctttactggtatgttttagataatttcatatactcctgcccagggcaactggctgctcctaattgcataaaacagtgttaatcaatgtataataaaaacaagtgtatgcttttgtgacaatccaattcatgttaagtgcacaaatattgttttttaaaaagtccttttatttttttttcagtttgctgtattgtctaaaatgttctcattctcttgactgacctaggtgaagcttttaaatgaagctggaaggtgtctggggctccagtggtatgtcccattcttcaggtgagaaaagagaaagcccaaaagaaggaaggactgatgtcctcaagttttggtaccatggtctagggaaagactcacagcgtcttagggctatctcagcgctgtttaagcacaatggaacagctaacatagggggcccagaaactttgccaaatggcaaatagcttttaaagacaaaaacaaagatagatagatagatagatagatagatagatagatagatagatagatagatagatatagatatagatgtagatatttaaaaagatgtatacatcttctggtattgctttaaaattgctcttaatctttgagagggaagttgagacttggcttgtccctctctctgtttgcagtcaaacaagaggttagtgaaccctgccctccttatcccagcacggtgttaaaaggatcaagtgagataacaaatgtgagacacccatctaaaatcaggaaactcttagaggtctctgtgtgagtgttatctgcagggatttgccagagttctgtgttcttcttccttgcactctgatctttgcttttctactttatgaactcagcagaacaggagtcagccctctccatgaacttgatggccagctcctctgaactccaggcctgaccctctgactagcgctggccttgctgctcctttgaatccatcgcaacatttcctccacagctgacttcctggatcttcactcattgtgattctcctgtggactgtcgcctccatgtgaagaattattttaactaattacttgcattttaagatctgaagaggccagaatagataccatgtgataataaaaaataagcttttaggtaattttgttaatttcacctgaggacactaaacattttcttgtgattgagtgatttacttgggaaaggaaataatttattaaaaggtcattctctttatactaaaaaggggcaagttgcaaaaatatcaggcaatttaactttctcatgttttactgtcatgaaacagttctcaaatctaggtacatctgaattaatacaagaaatgagcttttttttttgtaggttgaatcttatagatttattcacaaataatgattcaataccaattttaaaaagaaaccctgatgctaggtattgtggagtttataaagatgttaaaaataaaatccaaagcaactactttttgggcaaaattggtttttaaaaaattagtttcaaaagacttcccatatatatttgacttaattctcataaaaatcttgtgacacagttattattgctatcactgttttatatttaagaaatccaaggctcacttttgtagaccttggatcaaaaatcccagaacccctgacttcaaactctaaatccttccctttacagagcatgtagacgtttggtttgcaggaaataagtatctctaagaggctccaatgcaaattgttatttggtccttctagggaggagctacttttcattggagtgattggagagggtataattaaattgcgattccacctggtcccagagaaagggagagactttttggcagcacagggagagtaaggaagggggagttcaggttgagggaggggataggtgaacagaggcacagaggggaagggaagctaagaatttttagggaatagcaattggagcagcttgcgataatgtgacacccctgaagaaagcaacaacagcaacaaaaaattagcaataattcaagagatgggttgtataagaccttattgctggaccaagggatttagacatcctccagtgctgagtggaacccactgtgtgtgtgtttgtggcagcgtggtggtggtttcaaatgaagatagaacgattaagcttgtgttccagggcacttggccatgtcttaatgcaagacagacttgcaaagagaggaggtgagaaccaaacaactgcaggagaaaactaggaagctgtcagagtggtccaaggaagaattaatatagcaaccataggaaaggggaagaaaggcaaagatatgagaaacgcaataattagaaaactgaaaagccttgacaatttctagaaggttgaaggtgagaaaagaatggaagtcctacatttcaagcttcagcaagtagaagatttgttcatgttataaatagatatgatattaaagaagaaaagctttctggagcccagaagtgtctaaagataaaggaaaataaaaacaaaaatagctaacacatacttgcatgcttactgcataccaggtgttgctaagcccttttcgtgtaataactcatttaattcttaccccaacttttggagctaggtaatatggcacctactttaaagatggaaacactgaagcaaggaaaatttaaacaagttgtccaaggtcacacagctggtaagtgagggagggagagggagaccaggccgcctggtcccagaagtcgtgtgtatgagcaccatgctctgctgccgctctatcatgagcctcgtcctgagcatgctgcttgattttgccctggaatgaccagatgaagatgcataatgagaaagccaaactcaagatgaaagcttagaagagtaaccaaagctaagcttgcatgtctggagatgacagctgaataatggaggagatgagacaaccatgggagagaggggagaggcaggaagaagaggtgagaagtgaggggaaagggagaaaggatgagaaagaagacagagcacagcttgaagtgcccatatttagtgggtgggaaagaggaggaatcagagaagggaaccaaaagcatgcagtaaacccaggaagacctctgggcaagtttcaagtgcaaccccagtagtctgaaatgaggaagatcgctcaggcaaggagctaaccaagaaagaaccattggtaaagctgaactagtgactctatgcgtggtggaaaacatgccaggaaatgtgcgtaaaaggtatggcttcatgggaggaacacaccacgactttgaactccatctctacccgccatcaattcactgcccttcccgcaaccaagcagtcagtagcaggaaaaacaaattgccatagaccctagaggggctcaatattgatgggaaacattcatgtgcatatcttactgagctacatgcagaattcagaggtaaatgtcaaggtccttgcactcgtgcttttagtaaaatagtcttacgtaaataataaacctgaattgaatcggctcaataactttatttttaaggcctctttctccgtctttttccttccttccttccctttctttttatttccttttttcttctctctctctccttcctttccccttcctttccctgcctttccccttctcttcccttcctttccccttcctttcccttcctttcccttcctttcccccttccctccccttcctttccccctcccttctcttcctttccccttccgttcccttcctttccccttctgttcccttcctttccccttccccttcccccttctcttctcttctcttttcttttctttttgtagagatggggtctccttatgttgcccaggtctcaaactcttgggctcaagtgatcctccaaccttggcctcccaaaatgctgggattacaggtgtaagccactgtgcccagcctctttctttttctaaaagaagggaatttgagacagtgaatcatcttgcatctctacctgtggccttcatcagggttctctaaagattagccagtctatgtccagctggctgagacagggtgccacatgtggtacttccaataattctgtccacatgcatgggccatttcacctctacagctctaagctcactgctgagagtacccatcagactaaagcaaacatgcctattaaacatgtcataaataggctagcaagaagcgccacacacagcagcagaacaaagcagaagtgggctgatcatgtcctaagtccatccacttaaaatttatacttctactttattcctctgaaaatattttgattatgttaccatctgaaatgaaagcaagtataaatcttctgttggatttattctcccctttgtcaaccttctggccaataataggtttgatattgttctgggaaaaaaaaaaaaagagggaggcgggttggtggccacaatttaaaagcttccggaaactcttttccacaaatcaaacctttgaatcattctgtagcatgaggaagctcatgtatttcattgacatgagaggaagagcgagcccgtatttaactaatctatcctgtatagtcacattaagtaataccattgtttaccctgagcagtcaagaggaaagacttactaaatctaaaacaaaagtagcgcatgtatgttcttggtttggttttcttcaagatttccccaaatgctgcaaattgaacttggccttaggagtgcatggttgagcagtatttttttcttaaagcatttttctgctttaaagaaagtctactgacaaaagaggaatcagagtttcttctttattttttttaaaacagggtctcactgttgcccaggccaagtgcagtggcatgatcacagcttactacagccttgaccccccaggctcaggagatcctcctacctcagcttcctgagtagctgggactacaggtgcatgccatcacacttggctaatttttgtatttattctatggacgaggtctcaccatgttgcccaggctggtctcaaactcctgggctccagcgagccacccaccttatatgcttcttaatctctgtagccatctttctcctttctataaaataacatagatagacaagatgctgtgtttacacagacatatgcaccatgtacacatgaataatgagagaggatgttcttattaaccttttttccacatagatttaattatccttgcacttccaagctttttgtatattcccccataatggcacttatcatattgtataaaataatttctcccctacccaactgggagtacaaaatcaagggtagttttagattcactttacattcctgttgcctattgtagagtagttgctcaataagtctttattggctcaaggaatgaataaatgaaagaatgtttccctaaactgctattcattctcatgttatgtatattagaaactgaatttttgcccctagttcttagtcctttttccttcacttttagcaaaacgatttagagctcttgtaccttgggcaaaagcaactgaatggaatatattttatagtcagaatatttcaaggaattttttaacagagtaatagaaaataatcaaaacaggtgaatggcatattatagacaacagggaacacacgttctccctaaaatgggaatactaaaatcagatatctctgaaattcgaaatagttggacttttgggtccttttccaccttgagaattctttgaacaaggaaatatagaggtttaccctaaggcgtgacggttccttttaatgatatgactcttcaactttcaaattctctatcttcaaaatctacaggccaatctgaaatggattctatgtcaaggttgcgatcatagattgtatcatcttgactttaccaccttttctctcttatgtgctgtatcgatttgaactataaaggaaggttaaaatatataattaacattattatgcctcatccaaatctcacagtttccagctttttttttttcaacagagattttaaaacttggatgcataagaactcggttgcatagcacaatttttgtgggttgaagtgccttgacaactacctgccaaatgtctgtgcatctctatgtttgagcatctcaactcccacgggactcaccatctcccaggcagtccatgatcagttgcacaaggccttgttgcaaggcagcaaagatgtacctaccagaaacatttattgatttgcccatatttgtctacttgaggcaatacaggccaagttgaattcctcttctcaacacacacgcacacacacgcgcgtgcgtgcgtgcacacacacaacaatttaaaggtttaaaagaaagcttatttgctcagtctgtgctgcccatctgttctccaggctaatcttccctgttctgttatccatccctcaggtaatgtcaacttgagtcattttattctcccagcaattcttctctgggtatattccaatatgtccatcaagtgcattttcatatgtggtaacctttcctgaacacagttgttttcagcatatgttgaccagtccaatgcagaggaagaggatgacctccatcattccattaatgcggcctatggtaacattacgtttttaaaagccattcatattgagattactattgactattcggatgcatactgttaataagcttatagccctctgatgagttgactgtacagttgattttgaaataatgacagaatttacatttatttcttttaaatcatttaaaaatatatatccaacaactttcattgggtgaaacattttcaatttaaccacacactattctcaaatgggatatacatggttctattctctttattcatactatcaaccaaaaacttgaatagctccaaggccacaaaagaggcacgtactatgccacaaaaaccttctggttgacatcaatcttcctttggggacaataattcaaccaagatctaattcaccacatggtattagtatccagactacagttctccaccttttccaccagggtaaaatgagaaaccttataaaaggttttcatatgctaaagccctaaaagaatattttaccaaaaatcaaggcagagaaaaatatattatttcattcattgctcaagctgtatttgggttagagcccccaaacccccaaaatgtatgccaacctggaagctgtgaatgtgactttatttggaaatagggtctttgtagctgtaatcaagttaggatgaagtcatcctggattagagttggttctaatccaataattgttttgtacatagacacagactcaaagagaagatggcccagtaacatgaaatattgcaatttttagagcctaatcagatacttaagagggacccagaagccattctttactctgatcttacagtcatggatctgaacttctaaatgcaaagcaagttctctgggaaccctctctcaacctcacctttctctgcatttcaccactgcaaataattgatggccaaagtttcagtcaggtgggtcaggaccagttcatgttcacatatcagaaagcatatgccccagtggcacatgagtatccttttcagtaatcaacttcatcagcgaaagtcaagtcattttctgctgaaaagtgagttgtgaaatcttgtctgtcttctaacagatcttttccctggaatgccacacacggccatgcaacaatcactcttatacacagaacttttttatcttttccaccaaggtaacatatcaacttcactaagaacagatgactttcatgtgatttttgagctaaacctccccttcccattgcagggcagagagcatgaccatattagtgtctatcaacaaagtgacttgcattctgggtcctaactgatgccagcaaccccacaatctcagaaagcctggcatgaaagtgaattatgactttgtctctttctgggctaagccatctatatggcttgcaaatgtatacttgatgaatgctactatggaggatgtctcttcaacccgaaggagtgatgggaacttcaaacatttccctgcttaaaaaataattgtgtgttgtcttccctcaagcacaattacacacacacatactgagtaatgggggctatatgtgcactgcacaagaaaatttagaggaggagaaacttcatagggaagaaaggattccatttagcagtcttaaggacaggtgatctagcaaatgagtcccctgaaacagcttaccagctcactccactataataatatttcaattatctgagacctgttagaaaacaatcaactggccaaaaataataatgcttggccccaaataccatgtcaaatgcagcctcctctccttgagagaaatgtttcccatgtctgcaattgcagaacacactgaagggcatccctgctccaaagacaagggagaatttgaaggaccaaagcattaaatgcagccaactaggagaggctccttgcttgggaaagcaagcagcagttgtgcaggcagtgcatatgaatgggattatgggatcaggggaagccctgattaaatggaatatgtgcccaagaaggaaatccactgatggaggataatccacatgctataaatttagacctatggctgataatatgtaatggagaaattgtccccaaatctcactataaaatttcatttgtaactatgcttctaagtggcatagatgtaggaaggaggcagtaggggagaggcaggtgatacattccttgcctgtacacaatctcctcaaacaacacctgtttaaccatttctaaaatgtaagatgttgacatgacagaaaggctctcagaagcagcagtgtgaaatcaatccttaaatccattcagaacaagattgacgcatcaggagttagactgtgaaacacacagaaaaggcaatcaaagcaggacttgtttttacatgccctcccgtgatgtcccagacccaagccttgccttgggaagccatgtgtggcctctttcccctgtacagtcatgccctggtgttagaagttactacttttcaccacacccaaatttagtataattcatttatttatattattagatagtgagcaacttgagggatcctctttccttctttttctctctcctgctattaccattgctacctaaataaattcactgttgaataagtgaatgtatatacaaagtagtaggactctcagttctccaaataaggcaaccagtaatcaatttaaaaatcttcaattttacagaaaacaatagaacttgaagtgttttattgtctttatctcatcatcctaagggaagagtcattagttaaaattaaacaatgtctgataattttgcccagtcatcaggtcacctcaatcaggaagtatgtaactagaaaatcctgaaagcaaaggttatcaaaataaattcgtcatttgtccatttcaagatacttatagaaccactgaataaagaaccctagaatcctccatctccttaatgcaaccaatagttttagacagaactgcaataattccaattgactaaaatctcacccacttaaaataatctgataaaaatattgtgcacagcattgaccaaataacttcaattctaataacaattcctaacacattagtaatagaggtggacaaacccttgtgaacaaagatgttcactgcatttctatttataatggcaaaaaaaaggaaagagaaagaaacacagttggaatttgacaaaataagggttattcattcagtggaacatgatgtagccagtaaaatatatttatgcaaattgtgtaattccattggaaaacactaataaggtagtattcataaaacaggaaaatgaaaggttatatatccaacgtgctctctaatgaatggaaggaagaaacaaaagaaggaaggaaggacaaaatatcaagtaagttttatttctttcaacttttctggatatgtttataatgaacaagtactattatagtaatcagaaacattaatgatagatttgcaaaaaattaagttgaaaacaagaaagaattacaggagaaagagtccagttttgagcccccccaccaccgctgaatcactatcatgtttgtcacttgcatggtacaattcatcatgtatatctaatttactttaataattatctgaaaaacagtaatggttttctgttaggttgcttttatgtcagtttgcaaatcagtaaaagggacagtatatgttcatttttagtacggctaaaaacaaacaaactggttgcctataataagaaatgaagaaattaagcttataagctttaaaatgttcttctaagtagcttttaaacatagaacttggcttttagagggcagcatatgtacaatggataatataatttaaatataaatggctattcagaatgtgattaccatctataaagcactggtgacttactttgaagtaagtatttggtatagaattatacttcaacatactgaggatattgataaatattgtgtttgttatctgaattaggtcatcagggacaagattcagaaaatggagaaacacattagaaagctttaacagtgctctaagtgcctttgagatgggcatctcattaatattcatatcaaatcatgtaatatttattaaacattcatttgtgtcaacatttggtattgacatcatagatcaaacaacagacttgtaaactcaaggtcttctctgcccaagaaagaagtattctcagcatttcctatttcagcttctgtagtctttggagtgcttttgacatggctgagattttaaaaataatcatacctatcatacaaatgaagcacagttaaatataaacattactttcttagatggttcaacatttcaaggctatctggataaacaggttgtacgggcctacatactttcagggattttgtttttctttcgaactcaaaaaaattaggtcaaactatcttacctacaattatgaagctatctgcagaacccaagatattctttagggtcattaagcaacaataaatgaatataattggaatgttacctatcacaggtacaaaacatctggggagccagttatatactttcatccaaagggtctgatttgagaaaatacattggcatgatatactcaactttaatatttaaaaatgtttaaataatattaaaaaatatttcgtgttgacttgtatctgagtctttgttaaaatgctagatgaaacacgattttctaccttttgtagccacaacatgtccatccagcctgatttgtttaaagcaataccaacaagaacaggatattatttacagagatagtcaaagatgaaaggctccacaatttttcttggcatgattataatatctcaaagccttgacatctattttttgtaaagcctaaaatgatacatctcgatgaagtttatgcccatttcatccctttcaaagtttaaggtcagctatttggtatgcctttatgaataataaaattatggctttcctcccttctaggccttattgtagccaagtggctttagtcattttcatgggacagattttccaatgtctttattattactctaccttcgccatctcatatttttaccactgggccctagatatatatatcatccattgttcagcatgctctacccagtggaataatcatatttagaatggtctataagatgatcattctccattgggtccaatttacaatctgtttctcccttttttctttcgtatgtttttctgctcattcaaattatgatcagaagctaaggcattttcatatccaaatgctctccccatcacttctaataccatcaccatatattaaaaatagaagacaatatgaaaggaaagcaataaaagaccctcgctgaaaaagtccttgcactttgaaaaacaaacttatttttttatacaagaaaacagaacttaaaccccctttttatgtttgaaatcctgacaatcaaatagctgtgacattaagacttcacaagcattaagtcttatatcagccgtggttagatgtaaataaatccaccataaaagtcagtctaggcaaaaacgcactgtaacttaattttctaaaccacaggagctgggaagcagctgaacttcactaaatcagacagtaccaaaatggataaacatccgggctctgtatcttttgtgatggtgtgccatatcttgttagattctctgcacatttgttgttttatgagcaatgatattatcactttatgatctcaaggaataacccacaacaagcataaattaaggatgggacctgtagcagacattgggagttccttgctaaattttcattgttgcttttattcttcactaacaaaacccccatattgcagcggtagcaatctacccaactgcaagagaacatgtcccaggcccccatgcagaaaggagtagcaattatgatgtaagtaggaggcactgattgccatcgtgtgggctttcaggaaaattctctaaaggtgcctgatttggcaggtgcccttttgcccttccctctccgccttcttgctagctgcactctgcatcagtcatattgtgacctgaagtgaccttgagagcagaagccatgtgataagaatggcgggacagaagagaaaaggagtgcaggctcctgatgacatcaaggagtcatccatatcacctgtaattcgccttcctctgcagttcatgttccatgggagaaagataaatccttttttgtatgtcatgatattttagatgtcttacttgcaggtgtacacaactcctagttgatgaaataaccttattatgtagtgaatttgaaggaggctgctgaccccaaatcagtaatacattagtctgaaattatttttccattagtaacaattagttggataaagcaaacacaatttctttttaattggcctttcttgtttaacagaagtacttatttcccagatacttggccaaaggaaagtaaactttaccagtctaagtagtgtcaaacccacacatttaaccacctttctctcagcaactacatagctgcttatgaacattatcaggactgtcggacacgtcataggtgtaacaagatctttgtatttccatttctgcactgtccaaccaatgtcttccgttaacacagctatgagcttcatctctaatgtgcagcattcgtagcaaaggggccccaggtaagagtaggtccttaagtcaggacaaggatgcattgtatttcatacaaaaaggggacttgagaggtacatgatgaagacagagattccatctgacaaactgattcccatgtggccggcctggagacaggggaaattggattaaatagtttctgatggctttatccaggctaagatttcaatgatctttataaacctccattaatcatgtaatcatctttccattttggaactgaatttagagcattttaagataatggcttccagtgtctgtagagccaaagctaaaatatgacctcaaagagtcaccccttcccttggtgagatatcaaatcctaccactgagaactctttctcatttgatgtgaagagaaagatgcccacagaaacacacctacaccatttctaagacagaatggcaatgcagccttaatctgcatatttcaaaataggatgcttttaaaagattttacagctggtttaaggatgagtgtaaaatatttaagatgggaagagaaattataaggtaattatttttagacagtctgaaggaacaaaatcttatggaaatggtttcattcagaacaatcagtaatacagatcaaaattaacactcatgggttgccaagtaaggagaggtgcaaggcaactcaaatagcattcgtttgtgtaatttgaaaaaaggaaatctattcttaaagggccagtttttctccctctcccattttttagaattagtgagtaaatctcaattcttttttctagttttttcatgctacacataataattggttatgcaactaaaatggtacaccttacaatttctaacaattctgttaaggacaaaagttaaacacgattttctcctcttgtctctgtttaaattagtgtgtaagtgtgtacgccctttcccaccactttatgtgattcagccttgatgataggtctctgttacattgcagccagtaaatctgttatgagcttggctgccatgtgcaaccatgcctggaggctatgttaaaaattctgagatccatgaacatcagcaaagtttttgttcagtttaagctgaacaaacagagttaaagacaaactttattgagtttggagtgggtccatccattgtcactggactaggtactgacaggctaccagctagagtaacgtttactggattagcgaaaatctactagctgttggaggagagaataaggtgctaatattaatcatgaagagcatgggaaaatgaaactctttcaacaatgaaagcaatgctcctttctaccatgaaagttttcatccctcttcctcatctcaatttcaaaacgccatatcctaagcatcaagtgcaatttaaaaacatgagcaacattatgtgttgggcatctagatggttcatgtgtgcagagccggtgaaaacttgaagggccttgcaacatcctggctgctgtccaaccaaaacgatgaaatatggagtgagacattatttcctatccccacaatgcacacctaccttgcaagtccacaatgtgacactgagtcttttggattctgagtgtcacctttgataaatctaccacaagggaaaagtaagcccccaagaaaggaaaggaaattttgttattgttgttatatacacctccagaaaagttatggatacattttcctggatgttaacaggactgcaagaggaggatctgggtggcaggagggggatgaagaggaggctgataaggactctcggggtttaggaacacaggcacaagccacagtctgtttaaattgttaagttatcaatgttgtcaaattgagatgtcaaaattatgagctggtctagggggaatttcatctgcatgtagacagatctcattagaaaatccttaaaatggttttctacaactgaagcaaatcttgcctaagaaagagttgaatcactacctgccttgtgaaatctaaatatgcatctagtccatctttggctagtgatggaccttcctcggctttacctgaactctctgcagttctgtgttcttttctctctgatgctaagttcatggcaagtagaactaacacaaagccttggtcaatagttgtagcatttggcatctggctaaggaaggattttcttagcattttccttcacaaagccagattccatgtatgttttgtacaattctctcaaattgatagagacggggtctcactttgttgctcaggctggtctggaacgcctggcctcaggtgatcctcctgccttccaaaatgccaagattacaggtgtgaaccaccacatttcgcccaaattgagaggtgagcttcagcaaagcccaagacttcatgggctaacaatttctctttggcttatatgagtgtaaggttcttatagggttcctctggggcctatcagaggaggctcatttagtccaggccttcctttcacccatagtcccaaaggtagacgttcggtgttatctccaagtgaaatcatacctatgtataaagaaatatactataatagttgaaagaataccacatgaaggatttaactttagttattaaatgaaaatgcctaaaatgtgtctggacacattttaatatactgggatcctcaaaaactgcaatggcctggattctgttgacctgataaaggcctattgaggtatactaatcattacagacagctttctatgtgaatcatgaagatgtatttaactcatgatcacacaatgcatgggtaattacaaacacgtaatgagtctgtaacttcctgttcaggcgtgggaagcacacactttcattaggaagcacttttacatgaactattactcaaatgtgtgtaggtccatgtggaatgaaatgttcctactttaaatatcaagttcagtgttatgtctgtttgatatttaaaacattgataagtacattttcaaagacttacgtgcaaaaagaggaaagataaaactcgcatcagttcatttttcctttactagtaattagcagatagaaaaaaggtgctatttgtgactaatgcttagttttatgattttaaattacactctgtctccattggatgcataaataagagccctctaactacattttcctcttgctacccttccaacactaacaaggaaattagctcacacatattcaccaccctatatggttatatactttaacattcagcaaaaaattctaaattgctcacttactgagctgaatcacatagagggctgaaattcatccattaatgaattattgtattgcctgaggtctgcttagagctacctgattttagaattaatggcagaataaatcttaagaagaaggccaatatattttaattttatgcatattacctatttgagcaatatattctaacatgagtttggctgtaaatatcttattactactaagtatcaaaaggagttcagaaatattcactaatatacttcatattgcaactttaaataaaattaaaatttaatctacacttctgagaatagaataattgtcgctcatttactagaataacgcttaggagcagatgcatataatgctcataaaaccatgaaagaatagccattgaacatttaactagaattgtcaggtacaaactataaactgtaacttaaaataattttattttcttcctctaactgcagaaatagcacctaaatcaattagagagagctaagaaatttaatcttgaggaaaaaataagatttttattaaggagagaaaaatcctatattttatttttgtatttagactatttcctttacaaaacagctaaatacaacattatgataaaaatttcataggtaagccaaaatagagaatttataacatttaagctaaatcaaagcattatttatagttttcagagaaaaacaggctatcttttgatataatacaaagaaaaatctattaaaatgatttttctaaatttggtttggaagagaatgggcttaagtaacttttctgttggttgctaggaaatctaaatgatgttcttcctgaacaagcaacacaaagcgctacgttttactgcagccaaagggagatgggatggggcaggtgaatagagaggggcgggaaatgacagcaggtctcaggcaatcttcatgctgtgcccattgggaggaaggacctccaaatagaaacattatttatctttgagaggtgaagtcatggataactttttccattcattttctgttgtattttatgagttatataagttaaatgaagatttttttctagaagttctatttgattctttttcaaatctccttgatcaaaacttcttaatagtttactgggttttgcttccattttcaagtttctttattatttttctaacagctacgcattagggtaaagctagagcttcaataatgagaagcagagattgaatgacctaaggtttatatctctctcacctggtctcagtgtgaatgggctagatcaatgggacagatctcctttctgcgcccactcagagttccaagtcccaaccaagcaattgctccaccatcccctaggacatggtcaacatgtgtgtggttaaagctaggttgatgccctcctgggctccagccgagtgtgaagagacaagagggtgcattgacacatcacttctacttccattctatgtgtgagatcctgatgacacagcctcacctgattgcaaagagaactgagaaatgtggccaagctaggcagtcatccatcctacatactactactaccgtggagtaggttaaaatggactttatgagtagctacccatcacaacatgaaacgtgaagatttcataggatatgcctaatatttccaatatcaaagtctctgcaggtctgactctgctatttcttctgcttttcacttactgtgtcatgtttccctttatgtttgaggatttttgaccatgagttcatgtttatgttctatgggaatatatggttatgttctatgggaaaataattttgcaggaatgttttgaagtctgggttaaagttgcattatttcacatagggaatgtatttgcttttgcctaacaaccctaaataattttaaaaatgtatttgcttaagttctgcttgggccttataggcaagtttccttgttggtatcttccaggcagtacagtcaattccagctctcatcattctgagattgcatcccttttgggtctcaccttcattgggctctgatctttacctgccggtcacatcacatgataaagttgtcagagtggagccataatggatgggcagatgtcttggtgcccactttctttctaaattcctgttgttactaaatcttggcttctacagattccttgtttttgtgccggcttcgcaaggcatttgaaattatgggtttttaaaactgtgtatgtttgttttatatttttaaccagcattttagttttcttattggaaagaatggaatctctggtccaagatagcatcagaaatggaagttccaaatatacttttataagacaatcatgaccatgattttagagagatcatcacaagtagatgagaactagcaacgcaagcctagagttttactactgagtcttgtgtgttatatcatacacagaacttggatttcttgatctgtaaaatggggagaataataaccatattacccatgtcagtaagttatgatgatgacagaataaggaactttgcaaattcttaaacagtattgccagttggaattgagactgagaacctcacaagccacaagcataagagcatgaatatgtcaataggcaacagacatgttaaaatgcaatgatttacaaagtcgttttctgatatcttccaccggccctactcctgctgagccagccctctcattattggtttcacctgtgaaacagttctctgccactgctgacttcaccgaatatcttctttgtacttccatctgcgttttatgtgaactctggagcgattagtcgctaatatcaacattggtgcacagtctaggaacatttattgctcccctgcttggcttaatgtttctgacttggtaccataatattattaatagtcacagggtacaataaaagaaaattaagtgtttattttgtttaggctttagccactttacctacagcctttttccattacatttgcacataaatgagcatacgccacattttttagatacaaatcaggttttaactttgctaatcatatagtttcctttctggtagtcttccaggctggtttcagtgtgactccagatgcatgcatattgtagcaaatgaagaaatggccatgtggtagatgtttgcccttttgtgattcacaaatagtgtttttgaagaaaaactatatttgtaaatccactctgaacattccttttcaattccaggagcacatctttaagttttaggctgaagtccattgttcaattccagattattttctagcaaatagttgggaacaactgccatggaatatgtaatcattgaaggcatgagaactacttgaaataaaagttactagaaccaagttttagcattaaagggcccccatttctcagcatgagaagcccaaagccctgagatacttaagtgggcatccaaggccaatgcagtgagtttattccatgtttcctactttctctaccacctcctaggcaatgttcttccaaatgaagtgtttgctttgccttgaaaagacaaattaatattttacatggcaacaactctttattccttggtgggatatttccaacttgatttatatgatggtgtctaaatgcttaaaagcttttgtaaggcagggtttcaatcgattaaagaatttagttttccttgaggttcttgcatcagatattatctcagaaggcctacttcctaagatttataatccaatctcttcctcatgttaaccatacattttggtgagcatcccattggaccaagcttggggatttcagttcagcatcatcatgtggagtgactgcaaacagcacgggggagcctgcatgccccaactttccatcaacgggctctggctgtacaagacttcagtttgcttgctcactagcaatatatatgagtcctctgggcttctgggaatatctcacaggttcaaaaaacagatgattttgaacagaaagacagaaacacagtattctaagataatctgtacacatgagtccttctttattaaatcaagaacttttaccttttcacttaaaggaagtaccttatggcttctctttgacatatatgaattgccagctccttgaggatagaaatggcacctatcatagtacctaggtacaaaaatgttcagcaaacatttgctaaatgaataaataaaataaatgggctgggagtggtggctcacacctgtaatcccagccctttgggggccaaggcaggtggatcatgaggtcaggagattgagaccatcccggctaacacggtgaaacccagtctctactaaaaatacaaaaaaattagccgggtgtggtggccggtgcctgtagtcccagctactcaggaggctgagacaggagaatggtgtgaacctgggaggcagagctttcagtgagccgagatcccaccactgcactccagcctgggtgagagagtgagactccatcttaaataaataaacaaatgaataaataaatgtggaaataagttaatgaggagtagcctgagatgtgggaagaaggcagtgaggagtagaaaacttggatgccaccttgtcattgccttcagctttgtctggactgagacttcaacttaagaagagaacttgcaagtcagacactcctcatcacttgccaacgtggcatggggctctcggtgaagcttgatgtttccatctgtaacttggggccaattatagactaattgagaagatcacatgatttaagatatgtaaatacacagaatagtatctggcactgcttttgctttttttttttattattatactttaagttttagggtacatgtgcacattgtgcaggttagttacatatgtatacatgtgccatgctggtgtgctgtacccactaactcgtcatctagcattaggtgtatctcccagtgctatccctcccccctccccccaccccacaacagtccccagagtgtgatattccccttcctgtgtccatgtgatctcattgttcaattcccacctatgagtgagaatatgcggtgtttggttttctgttcttgagatagtttactgagaatgatgatttcccattttatccatgtccctacaaaggacatgaactcatcattttttatggctgcatagtattccatggtgtatatgtgccacattttcttaatccagtctatcattgttggacatttgggttggttccaagtctttgctatcgtgaataatgccgcaataaacacacgtgtgcatgtgtctttatagcagcatgatttatagtcctttgggtatatacccagtaatgggatggctgggtcaaatggtatttccagttctagatccctgaggaattgccatactgacttccacaatggttgaactagtttacagtcccaccaacagtgtaaaagtgttcctatttttccacatcctctccagcacctgttgtttcctgactttttaatgattgccattctaactggtgtgagatggtacctcattgtggttttgatttgcatttctctgatggccagtgatgatgagcattttttcatgtgtcttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagttctttagtttaatgagatcccatttgtcaattttgtcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagatttctacatatggctagccagttttcccagcaccatttattaaatagggaatcctttccccattgcttgtttttctcaggtttgtcaaagatcagatagttgtagatatgcggcattatttctgagggctctgttctgttccattgatctatatccctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaaggcattggtagcttgatggggatggcattgaatctaaaaattaccttgggcagtatggccattttcacgatattgattcttcctacccatgagcatggaatgttcttccgtttgtttgtatcctcttttatttccttgagcagtggtttgtaattctcctggaagaagtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatgctgagactttgctgaagttgcttatcagcttaaggagattttgggctgagataatgggttttctagatatacaatcatgtcatctgcaaacagggacaatttgacttcctcttttcctaattgaataccctttatttccttctcctgcctgattgccctggccagaacttccaacattatgttgaataggagtggtgagagagggcatccctgtcttgtgccagttttcaaagggaatgcttccagtttttgcccattcagtatgatactggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcatatattgaaccagacttgcatcccagggatgaagcccacttgatcatggtggataagctttttgatgtgcagctggattcattttgccagtattttattgaggatttttgcatcaatgttcatcagggatattggtctaaaattctctttttttgttgtgtctctgcctggctttggtatcagaatgatgctggcctcataaaatgagttagggaggattccctctttttctattgattggaatagtttcagaaggaatggtaccagttcctccttgtacctctggtagaattcagctatggatccatctggtcctggactctttttggttggtaagctattgattattgccacaatttcagctcctgttattggtctattcagagattcaacttcttcctggtttagtcttgggagagtgtatgtgtccaggaatgtatccatttcttctagattttctagtttatttgcgtagaggtgtttgtagtattctctgatggtggtttgtatttctgtgggattggtggtgatatcccctttatcattttttattgtgtctatttgattcttctctcttttcttctttattagtcttgctagcggtctatcaattttgttgatcctttcaaaaaaccagctcctggattcattaattttttgaagggttttttgtgtctctatttccttcagttctgctctgattttagttatttcttgtcttctgatagcttttgaatgtgtttgctcttgcttttctagttcttttaattgtgatgttagggtgtcaattttggatctttcctgctttctcttgtgggcatttagtgctgtaaatttccctctacatactgctttgaatgcatcccagagattctggtatattgtgtctttgttctagttggtttcaaagaacatttttatttctgccttcatttcgttatgtacccagtagtcattcaggagcaggttgttcagtttctatgtagttgagcggttttgagtgagattcttaatcctgagttctagtttgattgcactgtggtctgagagacagtttgttataatttctgttcttttacatttgctgaggagagctttacttccaagtatgtggtcaattttggaataggtgtggtgtggtgctgaaaaaaatgtatattctgttgatttggggtggagagttctgtagatgtctattaggtccgcttggtgcggagctgagttcaattcctgggtatccttgttgactttctgtctcgttgatctgtctaatgctgacagtggggtgttaaagtctccattattaatgtgtgggaatctaagtctctttgtaggtcactcaggagttgctttatgaatcttggtgctcctgtattgggtgcatatatatttaggatagtcagctgttcttgttgaattgatccctttaccattatgtaatggccatctttgtctcttttgatctttgttggtttaaagtctgttttatcagagagtaggtttgcaacccctgcctttttttgttttccatttgcttggtagatcttcctccatccttagattttgagcctatgtgtgtctctgaacgtaagatgggtttcctgaatacagcacactgatgggtcttgactcttgatccaatttgccagtctgtgtcttttaattggagcatttagtccatttacatttaaagttaatattgttatgtgtgaatttgatcctgtcattatgatgttagctggtgattttgctcattagttgatgcagtttcttcctagtctcgatggtctttacgttttggcatgattttgcagtggctggtaccggcttttcctttccatatttagcgcttccttcaggagctcttttagggcaggcctggtggtgacaaaatctctcagcatttgcttgtctgtaaagtattttatttctcctttgcttatgaagcttagtttggctggatatgaaattctgggttgaaaattcttttctttaagaatgttgaatattggcccccactctcttctggcttgtagggtttctgccgagagatccgctgttagtcttatgggcttccctttgagggtaacccgacctttctctctggctgcccttaacattttttccttcatttcaactttggtgaatctgaaaattatgtgtcttggagttgctcttctcgaggagtatctttgtggcactctctgtatttcctgaatctgaatgttggcctaccttgctagattggggaagttctcctggataatatcctgcagcgtgttttccaacttgcttccattctccccatcactttcaggtacacccatcagatgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctacattcttcatgtagttctcgagccttggttttcagctccatcagctcctttaagcacttctctgtattggttattctagtcatacattcttctaaatttttttcaaagttttcaacttctttgcctttggtttgaatgtcctcctgtagctcagagtaatttgatcgtctgaagccttcttctctcagctcaacaaagtcattctccatccagctttgttccattgctggtgaggaactgcgttcctttggaggaggagaggtgctctgctttttagagtttccagtttttctgttctgctttttccccatctttgtggttttatctacttttggtctttgatgatggtgatgtacagatgggttttcgatgtggatgtcctttctgtttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgccggttcccagatctccagctgcgtgctgggagaaccactgctctcttcaaagctgtcagacagggacatttaagtctgcagaggttgctgctgtctttttgtttgtctgtgccctgcccccagaggtggagcctacagaggcaggcaggcctccttgagctgtggtgggctccacccagttcgagcttcctggctgctttgtttacctaatcaaggctgggcaatggcgggtgcccctcccccagcctcgctgccgccttgcagtttgatctcagactgctgtgctagtaatcagcgagactccatgggcgtaggaccctccaagccaggtgcaggatataatctcgtggtgcgccgttttttaagcctgtcggaaaagtacagtattcaggtgggagtgacccgattttccaggtgctgtccgtcacccctttctttgactaggaaagggaactccctgaccccttgcgcttcccaagtgaggcaatgcctcaccctgctttggcttgcgcatggtgcgcgcacccactgacctgcgcccactgtctggcactccctagtgagatgaacccagtacgtcagatggaaatgcagaaatcacccgtcttctgcatcgctcacgctgggagctgtagactggagctgttcctattcggccatcttggctcctccccccctgcttttgcttttatgtactgatcatcatcatcatcatcaatcatcagtcattccacaagaaactcgggattacactttttgatcctaaaaacagttcagctcaattgtcagctctttaatttttttttcaaaggttagagtcctctcaggtggcatgcaccatccttgggtgcacacccctcttttgtgggtgtgcttacctgtcatcttggcctcagcacgaacagccactttactcctgctaagtgagcggctcatatgcacttttttagactgtattggattttataaaaccttaaaattggtaatttaagtgccactagcaacttgtctttaacaggtggagagagatctggagcccatcctaggaaaaagcaaatgacatttctctcttgcgacccagtcattgcaaatttggtctgtctttgcaaggaacctagtgctagagccattgctaggttttcatatcagggggaataaaaacctgggaggggaggggggaagcaagcaggcagagggtctcaagctgtgggttggttggggtatatatacttagaaagacactgccttgggtgatctcctgataattgctttccaggaccactgatgctttggatacacagttaacatggcttcctcccaggctttatcatcataggctaaactcctcttgcatgaatctcttacctaaggtaatgttgatcagccactactcctctccccttgtcctgaccaaatgccctctactgtctctcacctcatcagggctaccactgcaatgcccaggagatgatgcaagccatccctacctcacttgaaaaattatcttactcaagtctcaaactttcacgaccatatgttatgctttagtttgacatggtcattgatcataaacttttatttatttttctttttatctcaacttagtgtcctggatgtagaaatttaattgagtaaacttctagaagcaattgttatagactaacataaaagaaaaacctgagggtaaatataaaatcatccacaatcccaccatcttaactctaatacctttaccattttaatgcagcaaatcaccccttttatatgtaattttatgtagctgtaaccagattctccttgagcctttgcctgccctaaaattctgcttgtttccatgatattataaacattattttccatatgtgagaaaaacatgttttctcacagttgtaatacaaggtttataactatcattttaatgtctgcatactgtaactttcctttagatttcttataaattatcttgtatctagtagcataagatatcaagagcatcttatgcttctagacattactgtggctttagatgcttttcatttaattatatgatgaagatcttggtgcaatggagttttggcactttgattattttgtaaggttttattattgcttctcctctcctttttaggctcccctccaccacctatcctttaaaggttggggttctcttgggtttcatgcacaagcctccttccacacgtctcttcggcccttagtaagctcatctactatcaagcaaggccttacctccccaaacattctgcagggtccgagacccatatgtactaaccctgcaaaaatgtaccatgtaatcacattaactcctcaaatattttcccaaacactaaacaataacttctcctagaagctgctctaccttctgagcagatattctcagataatggcacccctatccaccagatctgcttggttagcaacacctctaggaatcttctctctctcttctccgtatccaataggcatcaagtcctctgcagtgctgccttagaaatctctttacatgttggattgcttctcttattggcttccacatggccactgccttgatccaggcctttatcatcttgataaagatgataattgttacctggtttccatgctaaaaatttcttaccactgcaaccagtttgatcttaaacaaagctccctgattaaaaatttagttagggccgggcgcgatggctcacacctgtaatccaagcactttgggaggccaaggcgggtggatcatgaggtcaggagatcgagaccatcctggccaagatggtgaaaccccatctctactaaaaatacaaaaattagccaggcctagtggcctgtgcctgtagtcccagctactcaggaggctgaggtaggagaatcgcttgaacccgggagtcagaggttgcagtgagccgagatcgagccactgcactccagcctgggcgacagagcgagactccgtctcaaaaaaaaaaaaattaattaatttagctttttattggctacagaagtagttgtcaaagtttagcatgcctcagaataacctagaggacttgtgaaatcagagcttgctgggtattatcccccagagtttctgattcagtaggtttcatggggttgtgaggagatggacagcagagaatctgcaattctaatgagtttccaggggatactgatactgctattctgggagccatactttgaaaaccactgttctataagataatagttaagtttctaatcatatacattttgaaatcagggctcagtttatccttccagccttactttgtaaacgttgtctagtgaaaattacttttcagctattctaaaattaccaactatatgtggtttctatctgctttcaaaattacccctcgttgtatatgctgtaacttctgactgaatagcctcatatttaagtttttctttgtcaattggcaaacagtgccaattggcaagccagttactacagagctacaaattcaaacatgtatctagagcagttcaagagcaaaaatgcataaagcaggaggaaggaagaataaagagagttccatttaaagtactgtatgatccagcaaacccacaaatgggtacatatccaaaggaaatgaaattagtatgaaagaaagtgaatcagaggtatctgtgctcccatgtttattgcagcactactcccaacagacaagatagggaatcaacctaagtgtctgtcaacagatgaatggataaagaaaatgtgatatctatctatctatctatctatctatctatctatctatctatacacacacacacacacacacacgtacatacatatacacacacacaatggaatactattcagccataaaaagaaggaaatactgtcatttctacaacatagatggacctggagaacattatactaagtgaaataagccaggcatagaaagacaaataccacatgatttcacttatatgtgaaatcttaaagagttgacctcacagaagcagagagtagaatgatggttatgaggggctggtgaagctgcaaggcaaggattgaggagatattagtcgaaggacatagaatttcacttagactgcaggaataagttcaagagatctattgtgcaacatggtgaatagagttaatagtaatgtatttcatatttgaaaattgataagggaatagattttaagtgttctcatattaaaatatgggaggcaatgcatatgttaattagtttgatctagccattctacaatgttacatatataaaaacatggttatgtacaccattaaaatgtacaatttttgtagatacaaaaaataaacaaataatgaataataaataaaagggcagcctctatctctctcctactaattatcctctgagaatattgctaagtctttggaatttttcaatagaagccagaattctagggttttttttttgttgttgttgttgtttttgagacacagtcttgctctgttgcccaggctagagtgcagtggcacaatctcggctcactgcaacctctgcctcctggggtcaagtgattctcctacttcagcctcctgagtagctggaattacaggtgcgtgccaccaagcccagctaatttttgtatttttggtagagctgtggtttcaccatgcggaccaggctggtctcaaactcctgacctcgtgatccgcccgcctcagcctcccaaagtgctgggattacaggtgtgagccaccatgcccagcctagaattccagatttctaagcaaagtctccacattcttagatagtggtaatggatttcaacaaatgtaaaaccatatgctggctgaattaaacatatctgcaggctgaattcagcccaaggcccataagtttgcaactatagtgctactccttattcaagaccaagtccaataactgttcctccacacagcattcccgatgtctgccaggactcccaatgtgcacacacacatgcacaagcttagtcacactgtcctttctgttcttaaggtactgtgttaaaatttatataaaagcatgtgcttcaattaaaccatctacataaatgacatccccaacccacaactaaaggctcaagagcagaaacttagattaacttctttttttcttattttctaatgtagtatgcctatcaaatatctgttgaaggatggaagaaagatcgaataaacaaataaaggtaaactctattagaaaatagcaggcgatatcttattccatacatcttaacttccctttgtatggatttcctcagtgacatgttagatttttcacaatgaaacagtcaaattttagccatgctttccacagatgtacagaaaaatgttagtccaagctaatataaacactggaaggatttagatcaagcagcattattttaacctgtctttcaagagaaaaatgatggaatgattcatgacagtgactaaaggcatcaatattctcttatcataactccaggtaagctttcacatacatgcaattaatcacagcattataaatgggaaaaggtatgtgtcaacccaagaatcagctgtctcctacctatttaatccaaagaaacccaacaaaaacaaaaagcagaacagcaagaacaaaaaatcagttctgtactgtgccagacaaagaagaagtcaaaccagaagattcttccttatcctccatccatgtctcttttttattcctgaagttgtccagcctcacagttctgcatgtgatttgaaagcagttaaatagaaagttaaaagttttcgaattaattttaacagaggttttgttgagccctgaagggtctttcctaagaagaaaatgttattgtcaatggtgcccttcaatttatactttctgtcttaataaaactggttgcagagtgtgcaatgcaaagtcaggttgcctttcatcttttactaagcattaaagcattgaggaaaggaaaaaacactttaagataattgcaattttcttcaattatataatataacttcataacctgtaagggttttcattaaccaaggttcatcaattctaatcgggctgccctcgcattggagaggcccataccagtgtaattaaagctgccgattctgctgacagcattcttcagtttccagggcccttatcattgatggataagtcatcgagcagcatgtgatggccctacatattgccttcctgccttcacttttcaggagagaagctaatctccatgcttttaatttactcttcatacattcttcccctagagccaatgatattaatcagtgttttaaaagaaagaaattaggcaaaattatgttttaaaatgtttaaatagagccatctgtcttcggttctccttccccctttctcgtggaataggcttcatgctcttatagcacattgatttttatatcatggattaatattttctttaggaaaatacatctgatttcccggatcctctaacataaagtacctaaatcaataaggtagttacagatgatgctgttataattacctcttttctttcagaacagcttctcatcatgagttagatgtgagattggaatgcatgccatggtcccttatttgaaatgacccaggctaccacaacagaaccaagcctgcagaggtctggctctgaacaaccttttctcacacatccgcttttgttggtcagtctcaatactttctccaaaagcactattttaatcatgatactcccttatggagaaacttaaggttggattaaactatcctagtcagcaattaaacactttctccaaagtcattgtgctacgagactctaattttacttccttagaagagcaaaaaggagtgaggaacattgaccttgagcccaggcgttctggcctagtggtctgccttcatcagagctggttgctcctgctgtaggttcaaggtcaatgaactctgactattgctttcagcttgccattggagagctgtatcctccctttgataaaatcttcttggctgacttattttcagcttgaacattctgctctatctgctccaggaagacagatctgcttttggtgccctgcccatgacttacatatcttccacttagttacaagacagcctccttttcctcaggggatctgttccaagaccttcagtggatgcctgaaacctcaagtagaacccaaccctatatacactatgttttttcctacacatacacacccatgatagagtttaatttataaattagataccacaagagattaacagtaactactaataaaatagaacaattataaccatatactgcaataaaagttatgtgaatgtggtctctctcactctcaaaatatcttactgtactgtactcatcatttttttcttcttgtgatgatgtgataacttaggctactaagtgactcatgggtgtgtggcatattcagtgtggacctgctggatgaagggatgatgcacatcctgggcaggatggtgcaggtcagcatgagattttttcaggctactcagaaaggtgtgcaatttaaaacctatgaattatttatttctggattttccctttactattttcagaccatggttgatagtaattgacactgcagaaagcaaaactgaggataagaggggactgctgtgctgagatttatatgacattcatccagcagtattttttataaacactcttattattccattgcacctggatccacatcaagcctttaaaaaacagaggaaaactaaggactccctcatgaagaactaaatcttcaaaatctggtttcaaactcactttctcttttagatattgttctctatcacagtgaatctcacctggttccaatcatgccagcaagtccactgccctttactgacagcagcagtgacttttgcaatattactgatatttctaatacctattcctgacacatttctttgcacttttcctagcaaccccatttgataatgaacttcttaagggcaatgatctttgttttctttgaaacttcttccaacaggtgcaagaggaaccctggatttggagtcagtaactccaacatttactagcactgggatcttgaaccttcctagaaatctctggaagactcagtttattatcattacatggggacaatcatgtctcctgccctgacacctcgataggcagggctgtgggtaaagatcgaatcaattatagtccaccagggcactttgtaaacagccaaggctcatgcagatgctataacacttatgctgaataaattttgctaacagaaaaactagccaagatttatgacgaaacatacaggatagtgatttcactacccttaccctagtcaactgcgatgcatttcaaatgtttcatctcttttctatcaccttgaaaaagccagagtcttaaacccaaatatgtaaggatcagggagtcactagaaatgtgtaaagaatacctcgcacaagataagacactaaagcatgctggggacagtgacaaaatgaaaagtccatgtcttgtctaaagcagaaagctggcactagatccgcccaattgtcaccctgaagaaaggtgagccaactatttcaagggaaactgcaatccatatttttataagtgaaatacctagatgtttaaattgttggcctttaatttggttattaaaataaatgtgtagtgttcaaatatatcattaatggatatgccccatgtgtcacaagggtttgcaactttggctcaagatttttaacatctgagtttgtatgaacaatcagcaagtgttcttcagctccagtaaaaactaactctggaccaagtttttgggggctgttaaaaagaagtataaggcatcatgcctgcatcgaaggagaggaattaataattattatgtgcctaacatttattcagttactttacatacttaatcagtttactttaacataatccttatgaatttataaggtgattactgttacaatcactttgctaacgaagtaaccaaggttgcttgcccaggagcatgtgacataactggtaagtagtggagcaataatgttaactcagttctggttattgtcaaaactgatgtttctccaccatggaagggaacatttcaaagtagccagaaaagagaacttgaaatatttctaatgcacagaaatgataaatgctccaggtgatggatgccctaatataccctgacttgcatatacattctatgcatgtaacaaaatatcacatgtacttcataaatatgtacaaacagtatgtatcaacaaaaatagaacaaaactatcacagatccatttagtggagaccaaatttagtgaaaatcagttgtctttctgctttattgcagtacaagggaataaataaaagatgatgaacccagaacagaatcaaaagaatcaaagacccacagaataatcgaaatttatgctggatggtggtgacactttgataagacattagaaaaagatataaactggtgaggaatatgtcactctgagaaacttagtggaggatatgggcattgggttagggttatttaggatttgttttctttttcctttttttttttttttttgagacagagtcccactctgtcacccaggctggaatacagtggcatgatctctgctcactgctacctccacctcctgggtttaagcaattctcctgcctcagcctcctgagtagctgggattacaggcatgtaccaccatgcccggctaatttttgtatttttagtagagatggggtttcgccgtgttggccatactggtgttgaactcctgacctctagtggtccacccacctcggcctcccaaagtgctgggattacacgtgtgagccaccacacctggcctagggaattagaatttggataaatagaggatggtagggggaacagcataaatgagagactgagtggatatgagtaccttaccaggtagtaatatagttctgctttctcctcccctttcccttctaacaaacacactccagcttctgtgaaggagtatctgttggttttgcttggctccatgttctcccagcttttggtaacagcacccttcctgtttttcctttggggaactgtcctgccatcattctgtcctggggtttctctgatcctgtgcatagagcctcctgtacgaggtcacactcacatattcagaatctggaagtgagaaagtgtttactctacagaagcaacacaggcctaatggtgtctcttcaatcccttgggtagacaattctactcttcagaaggtaccagacagattgaccctcagttgcccacagccatggctgattcaacaatgcacctttgcatgggcttctcctccttctctaattcactcttgctcatctcctactcctactccgtggattcacttcccaaatgaactgcgtgttccaagcttttgaattatgccctgcctgggaaaaactctggttaaggcagttgttcgtgacaagattcccaaactgtcctgccatccagcattcccaaagccggattgctcaagtcaaagcaagatagctttgactctgctattgacctatcctctactattctaaaaatttcaccacttcacttttatcagctggtgtccatttctgtttcttgccaccaaaaaacccgaactgatttatgactctatttcaaatagacctatatcataccattggataatagaagaaaagttctgtacacatactaataaaaaaatctcactaaatgtcagtgtggctattgctttggatggcaagaaattctgaaacatctgacagtattattaaacggctcttgaaaaacaaacattatggatgggctgcacagtcatctggcagtgattcacggtgtttctgccaatgcccacacctggcatgatgaagtgttggaacccagcatttccttcataaccacctgggccttgaaggctaagattatatatgatttttaaatttgtgcaaatctataggatgtgtgataagatttttacatgtatttaatgtggagagatcaagtcagggcatttagggtgtccatctcccaagcacaacacattttttaagacttttaagttcagtatacaggtttgttgcacacataaacttgtgtcatgggggtttgttgtacagactattttgtcacccaggtattaagcctagtacccattagttattttttcctgatcctctccctcctcccatcctccaccctccgataggccccagtgtgtgttgttcccctctttgcgtccatgtgttctcatcatttagctcccacttataagtgagaacatgcggtatctggttttctgttcctgtgttagtttgctaaggataatggtctccagctccatccatgtgcctgcaaaggacatgatctcattcttttttatgcctccatagtatttcatggtgtgtatgtaccacattttctttatccagtctatcaatgatggtcatttaggttgattccgtgtctttgcttataatacatattttaaagtatagtaacactactctgctatcaaacattgaattataccttcaatcttactatatatttgtacactttaacccacttctcttcacccaccctctcctctaactcatgctagccagtctctgatctatctttccactctttacctccttatgttcacgttttttaatcttccacaaacatgctatatttctttatgtatgtgcatggcttatttcactcaagataataactttcagttctcatccatgttgctgcaaatgacatgattttattatttctaatgggtgaatagtattacattgtgtatatatataaaattttcctttttttttctttttctttttctttttttttgagtcatgcactgacactcaggctggagtgcaatggtgtgatctcggctcactgcaacctccacctcttgggatcaagcaattctcctgcctcagcttcccgagtaactgggactacaggcatgtgccacctcacccagctaattttttatattttagtagagatgtggtttcaccatgttgcccaaagtggtctcaaactccttagctcaggcaagctgcctgccttggcctcccagtgtcctaggattacaggtatgagccattcatctggccccaaattttctttattcattaattcactgatggatacttaagtggattccatatttttgctattttgactaattctgcaatgaacatgtgagtgcaattatttctctaatatattgatttctttccctttgggtagatatacagttgtgagattgctggatcaaatcataattctagttctagatttttgagaaatctccatactgtttttcatggtggctttactagtttgtgttcccaccaacagtgtaatagagttcccttttctctgaatccttaccaacatctgttatttttttttctttttaataacttctctattactctaacccaccaactcattgaaatcgttgtctttttttgtctctcatgtaaggaccactcctgtgatacagttttctcttttccaggtgagaaactatagaaccgatgcaaaaattaaacttatatctcatttttccatgacattgtttgcccactaaatcatacagctttccattgccactttaattaaatgggttagattcatactgagttcaagtatttttaacattcctttatctatctatctatctagctattgtccttcttcttatctatcatctgtttttctatcatttatcattctatctactaagtagctccaaatacacaagtatatccctgaaaagtggccatttttctaaaatctgcatcccaaattgcaaatggaaaaatctacattattatggtgcatctggtccttgttaattcttaatctgttgtatcttttactgtcatgatttcaccagatgtgcaagtctatctcacaagttaatattttacataaactactctaaagaattgttgaaacaaagttgagactccttggctcccaacactctctccatacaggagcagtctaagtctagctgaccaaaagccaagaagatcataaaaatccactgacttagaaacttgcaaatgagtccaagattctccccaccctccttgggtgtgtgtgttttaccctctgttgggtttacaaaagaaaagatgctcaggataatccagaattttattaaagattaatacgtttttgagaactttgctaatactctgcaaaaaaaaaggggggggggctttttctctcttaaaatagaattcagaacaacgggctttcttttaaacaatgggttcaaaaatagaacttgccatttggaaaccttcttgagattttctagaacagtggcttcccaaagtagctgatcattagaatcgctcaggggacttttaataaaaatgaagattgcatggtctccccccatatctattgaagcagaatttctggcaagttggaccaaatttcctgggtgatcctgatattcagccaggtttgaaaaccatggctagaatgtggagttggaacattaaatactatctaagcagttaacattttagtgcctgtggttataattttattctattaatttcctttggatttatgttttggaagtgaagcctggatggggaatcatttggctattattttgtccaaatccctcattttgaaaaagctctttgaaaagcttaaaaaggcccttgcatgatggatttgcccaccagtgtctagatcctttattgctgtagtgactgttgctcttctatcagaactgcacctctaagagcatgaagacaggcctgaggggaagatggaaagttatttctatcttggctgaatcctcaggattgagtcagaaaactggagaggaccagcagaaaccatctggtccagtccttgtcttcatgtggttatgatttgcttctaggaatttcaaagcagagagagtccactgctggtgtttcaagatcccgatagtgagtaagttcttccctagagccacctggtgttgctcacaagccggcatgtcctgattcccaatgcaggggaaacgatgccatttcccatccctttctaatttattccctagaactaagaagctacacatagaacaacatgacaagatggattaatcctaatacaagttaaacatccctaatcccaaaatccaaaatccaaaattaaaaagtttttgagcaccaacatgatgccacaagtggaaaattccacacctgacacctttgcttttctaatagttcaatgtacacaaatgttgcttcatgcacaaaattatttaaaatactatataaaattaccttcaggctgtgtgtataaggtgtatgtgaaatataaatgaagttgggtcccatcccaagatatctcatgatgtatatacaaatattctaaaatcaaaaaaaaattgaaatctgaaagacttctgttttccagcattttggataaaggatactcgaccagtatgaccatggtataatgacaaccctagactaagtcaagaaatctagatggtagtcccagcactgacactaacagaatatgcaaaatcaggctaatcattaatatttttgtggcttagtttcctcatctgcaaacgaaagaagtcaaaccctttctggcttgatgtagtatatgcctatcattccatcattcatttacttggccatcaaggcccttcaatgtgccttaatgaggtcagtgctcagtaaaagtagggaatgagacaaatatgtcccgtgaccacaaagatattatatttataaagaaaatggacaaataagaaacaaacattggtatgtaattacgtttatatcttttctgcaaaagaaaaggaaaatgttgagacagtcaccatttaggctagagtctttcctccccccgacagcacgcctggccctctaattccctaaaatgtggaacaacagatggcccatgcattccaagaattctctaaatggactgatttacccattagcatgaaactgatcaatcttattagattttggcagcttctagatgaccatatttatgaggaagtgtccaagtttgctggcagaactatatatcttccaagaaaactaatagggtctccaaactttagagtctaaagagatatggccctagtgtcagtattatcacttggctaggaactagtgacaaggtcaaaatcagaaactgaagtcatcgatcggcacatcagcttcacatagaaaaagtgtttcatggccacaaaatgaactattaactcagcccttcacccaagtgtgtgttggttacaaaggaacccaatattatatggataactcacttaaatatatcactagtgatggaaaacatcttctgtagcattttatttgctgcatactgggggtggggaggagggtgtcagtccagtattaatcaactctactaacaagctgtttctttacactgaggcaacacttgtaactttccagtatgtctttgggtcagttgcatagatgatacatgcaacaacactatgaggcagatgggatgatgtattgtatcacatgcccatctgaaaggataaactatggcctaagaggattgagtgaatccctctccagtcatgtagttaattggaaaatgtgtgcacgcactgcctcccacccatctccccaagtccctgtctataccaaaggactgcttatgtaaacacggatagtgacaaagtccacaaagaatatattacatggaggagaaaacacggaatagatcacacagaagagaacagagcacagttggtctctgctcactctgtataatccattgcattctttctcagaaagccaagttgccagtgactatactaaatgctgaagtaggtagacatcacatgcctttttccgcttatttgtttttaaagaagaaaggtcttaggttagacacttcagttctttgttcaattgcatttgagatatttcactgttgttgttgtttatcagcaacagtggctgcatcgtcattttcactattcctttgggatgaaatctcaaacccccatgcagtgaggctagttgtgtgacagtgatgacaagcacttgttccatcacctgaagtaccttcttggcaatccctcctatacctacctgtgatttaaagtaggaaagcccttaaacatacagtctgaaacagaattggaaattacagatggtttagcattcaacacatgtgaatcacagaaatcagttcagtcagctgaatttacctcattagattatcagaaattttgactctgtgacagcttgagtggtgaacgtctacaaatattttttttctctcagcaattttgcagaaggccaagattttgatgtaactaaatagtgtcaggcattatgaggagctgtttgtttttgttctcataaaaacaattagtaagctattccctagaatcattgatggacaccagttcattcaacgggtcattgtatttcctgtaattcagtcttcccacactttttcataagagctgtcattggctgggaccttctttgagggaaacaagccctgaaagaaacaatgactccagcttgtatgaatcgcaccctggaaaactcagcccagcacactgcaggagtaaaaggcagtgcccagccctgtgtctttgaaagactggctcaaaaatagcccggacattttcctgtttggagaactcagtaacagctgttcatagcccacatttctttcataccctccccagccacaaagaaaatacaaattcacactagctgtaggaatggacgttattcaacattcgtgtgccttcaaaaatagcacaggaagagttatagacacaatggagggaaaaatgaggaaaactcaggaggagtagagagactagggaggagatgcttttaaacaatgagaaacttaaaataagcaggaaggcaaaaaagaaagggcaggatttgaaaagtctacctctgagaaatgatagggtggtgtgaaaagggcactgtagtgggagctgtaaaagtcaagaatgttgttggctctgctgctaattagttgtgttttctagagcataccccttaccgtctccaggccactaccatagaatggtcagggggtggaggcaatagagattaagcggtctctaaaaattcatcctgattctaaaaatgtcacattgtatgaaagtatagaatgtggttattaggcaggggggagttgggagaaacactggatataccctccatgtatttatgtatcagtcccctggagaagggcattcagtggtctgaagatgaggaaaaaagaaacacacccagcttcatggccacttccttcccctatcctagaatagctgcctgagaggatggtgagaaagtggtcttacccaccccaggctacagcagtagcacccagaaagacgtaaagtccagttctcaaagacccacgaccaccaaatttcccctgtctttcatggagtcccctgtaggttcttgccaaggatcacaaattcaagatggcagagtgcatgggctccaacagaagccatttagcatgtaggtaaaaagtcaggtactgagccagacagaactgcattttcactttaacagaactgcattttcactttattgagggtttgatctgtgacctttggtatataccttaatctctccctgaacttaatttttaaaatatttctcaaatggagacagaaatgcagttatgaattttaaatgtagttgtcaaagtgcatagcacagattaagtgcttaatatacatattatctattattattgttaatgttatattcatggaatgctttacttagcttggagaagtgttttttgtttgattttctcaggtcccttgacctcctgaatcaccatatcatctttgatgaaaagcaaacaaaacaaccaaatcagaagacctctagcaagggctggtcaaagggcttccaacaagtgctggtggctgttgatcagacattgactagagctctatcaagcatggaaaaatcagccttaaatccctaatgtagaccaattagtgagtaaatctcaacattttaaactgggattccaattttatagttagagctccctagggcaacaaacgcacatttttccatccagtctaggcatatggagtgtttcccttacccctcccttcagaaaaaggggcaggctgagtacagtggcactttgggaggcaaggcaggaggactgctcgagcccaggagtttgagaccagcctgggcaacatagggagaccccatctctaccaaattaaatttgggaggctaaggtgggcggatcatgaggtcaagagatcaagacggccaacacggtgaaaccccttctctactaaaaatacaaaaattagccgggcatggtggcacgcacctatagtctcagctacttggaaggctgaggcaggagaatcacttgaatccgggatgtggaggttacagtgagctgagattgtgccactgcactccagtgggtgacaaagcaagactccatctcaaaaaataaaaaataaatttaaaataattgctgggcatagtggtgcatgcctgtggtcccagctacttggggagctaaggcaggaggatcatttgagactaggagtttgaggctgcagtgtgccatgatcgtgccactgcactccagcctgagccacagagggagactcaatctcagaaaaagtcggcaggtagttaagggggacatagtacatctccattttggcaatctcataggaagataagatgttttatttggttcttctgcatttgaactgtgctgagaaattagttaacaaaaagaaactataggcatacatacttatctgaaatgaggaacctaacacacaatgtcagccttttctgcagacacaggggttagataatctgaaagggccccatgggacaaatcatcctgagtgagaggagactctgagggactatttgatattcaggcagacagagattcaaaaatgtgtttcataggggatctttcttagcagaagtcggagaatacacagtcatccattcagaaggattcatgtgagtttctgtatggaagcaaggctttgatagaatggtattttaggggcaatttttacttctaacacacattgatgtagtcttcttacagcaaaatagaatcataggatttttaagtggcactaaacttatacaatcttccattgaaccccttcattttatttgtccaggtaactacttgactgtattttaaagtaaaccctgaatgacctaaatcttcgtgcaataaaatcacaatacaatacatgagagttctgtttgtttgtgtgtttgtatttgtttttgtggagcactcagtcaatctggctaaatgcccaaggccctggacattggaccattccatttgaaatggacacggtgacagaaatgtacctaaggaccttccaaggacaacagaacacacaggaacacaaaggttccaactaagtggtagaaactgtgataaccaactctgtaaatctatggatcagatttcacaccaggaactagctgggctctaaaggggagatttccagggcaccaggcaaaggtggttgtggagagggctgaggggaaataggctcaggatgctgacagaacaggggccacaggatctccaagacagaatcccagttctacaaatggtcagggaacaacccttggcatcttttcattttcaacataatttcctgaatatccaaatgaggagtactcatgacagagccctccctctgcccagcatcaacggctataaccctggaattgggtacagcccaagtgttgagcaaccctcactctcatttcctgagtggagtctggtccccagccaggccaagtgtggtccatggagagtagttacggcgatgctagtttttctagatcctttagggaacacccacctattcccaggtgattccaaagctgatccagaaaagcaacacatacaaatcctaccaaccctgtttttagatttcttacttctactgacggagcagttaagacctgccctgtggtaacaatgttatgtggagaaaagtacaagagtatcaccaaggttatgattaaatcccagagcatctctaaacaaatgaagcttaaggaaagacaagaacagaatagggcaaaggcaaaagatcccacctaaaattcaaaacactatctctatttctgcacggtcagcataatggtgaaaaggtcccaagctgagggatgaggatgtgatcagaagcaaagtcaagtgaggacactgggataggaggcacctcatgggcaatcactgagcacacacccatattttcatagtgctggacagaacgaggcagacccaggctgctaggtccaggaaaacagaactgacacaattgactacaagtttttccaaggaagtgttcatttttagccaagttttctttgtggactccagctctggctgtttgctttgtatttgccaagtttataatgtaagttttatgatttctgttaagaggagtaagtttccctcaaggagagatctaaagtaggtaagcctgcttacttttccaaaagaaccagaggaaacttcagggaaatgctaagctgtggaaacaggagaagaaaagaatttggatgtaagagacagagaagatgagaaattctcaaagtgatctcacattcatctatgagttcatactcctatcattcaatagtcatcaattcattcattcatgtgttcaataaatatttcttgggcttttatggtttgccatgttaggcatcagagaatgggcaatacagctgctcttgagcttgccaccttgtgtaagagatggataatacacacgtaaataaataggaatgtaatgtccgggaatgaccattgttctgaatccaactatcacaggaagtggggttcttgatggcccagcatgagctacttctaataaggtggtcagggaaggctgtctgggagggtggtggagcagagaggttaagacctgcctcatggtaacaatgttgtgtgcagagaggtccaacagcgtcaccaaggttatgattaaatccaagatcacctctaagcaaacgtaggctagggaaagacaggaacagcagagggcaatgggaaaagaccctatctaaaattcaaaacaccatctctattcttctgatattctatatgttaacagatagaatattactcctttcccagaatacatcagaatagatctgttcttctccatccctatgaagtgagggagggagttttgacaagacgtgaaggaatagccagcttttctgctaaggagatgggagcatagttgaagggccataagatgaccaaagtgactaaagccacatgggcagagctgagatggaggcaagagacagtagtcacttcccgcagagaccgttaggtcaggagttcagcatattgtttgccacatataggtctgtaatttgtttatttctgttgacagaagcttgtgaaaatatgtatttctttgcaataaatctgtgtataaatgtccttcacgcatttttactactcatatggtaaacagggctttttccatttcttctctatgttaccttctccaggagctcctgcccctgcaagctcttctgtaaggccttcccagccactccaggccagcatgcttgctcccatctctgatgcatctcccatcctgcccccaatccctgctctacctgtatcctatgccatatctagttagtgtgtgtgtgtgtgtgtgtgtgtgttaaggtctatcttgtcaccaaagaagctcccggtgaaaatacgggctttggagtcaagaaagatttgccccacccactaattcagccccaccattcaccacataagtgaaattagtttctcagcctcaattgtaaaatggggatgacaacattggtaccttacagtatagttgtaaagaagatgtagtatatgaagacagtgtttgggaacaggagtgaggccagcaggtctgtgggttcttgcggaaagcgggactgtgcctgtgattttcagttctatttcatagcaccttataacacaacgcttcctgtgcgtggtctctgaagggagcacaacacactccaaaaatcgctggatctggaacgatcagaaatagattcccttctaggttctgtctctaactagttatatgaccaagaaccaaagtaatttaattattccaagcctcagtttcctcatctataaaataggcatgattatgccaatctcacagggatgttagatatataacctgtgagattgtatatggaaagaagaaagcattttctgttctaaaattctgatcctgtgatttttcaactcttgttgatctaatataaaatccaattacatgaatccacaatttatttaacaaggaattcatagactcagtgcttcagtacctttctctgacaactccttcctggactggaagaccagggagtggtgaaagccatcttgctgttgcccagaacagaagtcacaaggggagggccagtgtttaaggtacatgtgactcaacacatggctatcagaaaacaatgtatttctttccaagatgaaggtcattaacaacctctgcactggcaaacctgacaaattactctgtatttatttcagcctcagatcttctacctgaaacagttcaagtgacattaaaaatatctcactaagtggcagtgtaaaattgggtgtagctagggaaggtcactgtgccctaacagactcgctcagcgactttatgcaattctaaatgtactctggccttgacagaatttacattttgctgttacacttcagtgtgttttagagagagccagatgtataacagttgacaggcatgcatgtcaatacaacaggtccataaagcaggaagaagatgggcatagggaaaaggtagctgataaataacaattaccattagccagtgactaaatactaataccttcatactattctttttcaagactatcacgtaaccctcaccatgactttggcaagcatatgaaaactggtaatagtttgggtcctactaaaatattctgtaactcaatctgtaggtaccacgggagtaaagaattttgtttactgatgtgtctcaaacactgagaacagtgtctggcacatagtatgtacttaacaaatattgaaacaaaacccaaaaaggaatgaataaatgagaatcctgttttgagtttccctgcttaattccaggttcattttatatcacagttgcaaagcagtttgtgtttagtcatcgtcatctacacaattaaacatggttcactagttagtttataaagctaatgtttccatttgcttatagtacacagaagagtgatacattagaatgggcaatgccatctcaagaaagaagagtgagcaggctggttaaatgatgtgacaaagatcaggcagaaaaaatagtgacaaaaggagcacctggaaggcccaaggccagctgctccctggctctccatcacccaagggcacttatcactctgtgggaggaaattaggcaaagggagagaggtcaagactttcttgcttgtccaagaaatcattctgacatcaggaaagtttgggtttgtgagaaaaagttggtagccctttaacttgatctatgtggaactcatgctttggcctttttgttcagagacagtgccgttgcactgatgcagcatctggaattgggagtaagaggcccatatgggacccctttccatttctgttttaccatttgcctctgcaatttgagacagacccttcattgtaccttaagtgttcattctcatatagccaaaaaccatacaggcttaccaacaacactgctatcaaggcctaatttctgtcttatacaaaaccttgggcttagggctttacctttacctttgttcaccaagatatctcagtttttttctctcctaatgaccttctcctctgcatttccatgtcattgcctcagctccaccttttcttgagtcttccctaaacaaacagaagtacttcccagccagtttcaatgtctcaagtcctgcatcccttcaatccattttccatacttctgtctgtacaccaaaaataaatttctaagcctcctaaccaagtgaatgagccccctcttagccaagagcattccaaagtaaacctgaaactcgacttcaggccatgatgagaaggtgcggtcagacatgcctcattataccctcctctctatggaaatcgggtacaactaaccagccttaacattaaagcagggatgttaagactgataaaatagactttttatagcaataagacacccagttccagcctagctctggtatagccatacatgtcagagagcaggcaccaaaagaaattattttaccccaaaatatatttttgacatactttgaaatggccctgcaaagtagaggaaaatctacattttgtcgagaatccccttccctttccaggtcttttccctgatccaagagagaactgactaagagtctggcatcttttaaggtatgataagagctctgaagcctgctacctggaagcttcatctgcacaacaaaaccttggtctccacaaccccttatcttaacccagaaattcctttctattggttccaggtctttagataataactttttcaaccaactgccaatcagaaaatctttgaatccacctatgatctaaaagcctccagtttgagttgtcctgcctttctggactgaaccaacatacatcttacatgtattgattgatgtcttatatctccataaaatgtataaaaccaagctgtagcctgaccatttgggcccatgttctcaggatctcctgggactatgtcacagtccatttctcactcatttttggctcagaataaacctctgtaaatattttacagagtttgacctgttgcctcgagacttccaccctacacgcgattccaaaaggcaatcttgattgcataggaaaaccagttgcttagcacagaaacacactgacgcttagtgcagtaggcacagggactgtgtacagatctacacatgcagaataaactggaaaccagccattacctccctcaaaccattgttagactcatccaagatttgtgaagtccagcgacagagcagctccttcagttactgcaactactgtttcatgacagccagtttttgaaggactgtagtcactcaggcacacaaaaagctccgaactactgaataacaggatgatatagaaggattcagtccagagacatgtctgtggagggggaaggtggaagattaactagtcatacctaggaataaacctgctaactcatctgggtagtgtaaatagtagatctgggtagaattaccagctgaaaattacattttaaatatactaatagtaaaatatttccttgctggttactctcaggcaaaattttatgcctgcctcatatagtgtcaggatgtctcaaaatctaaattaaattaaacaacacacttgctttgacagatcatgtgtttattcagaagtttattcaagccaggagcatgcacaaaatctgacagtattcaaggttataaatttttttaaaccactgtttcagtcaaatgtatctaattaaatgcttttggagatgatgatgttagtaaaccaggtcaactttttgacattatttacagacatgcagacgttacttgcttaacaaatcagcccttgaatcttcttgagtccctgattgattacgaagggattacaaagaaaataaaatcttgcagaaaaagggaaaccctcctcacctaagaaactgttaaccctgtaggtgatacatgggcacctctgggacaaaatcctgagctacttgttcatttcttactgaaaattacctttctgaaagttccatttctcattatcctttatggtcagttccagtccaacatctttttcaaagtctgctgagtccttcagctcatgttcatctcccttcccttggccatttataggacgaattttttattcctcttgattttgcatgtaacttatatattatcaagacagaaaatgcatctcataaaacttaggactgtaccaaccacatagcaactactacaaaaatgcttttggagctttgtggcaacttcacattgactagaactgtgattcttaaggtgtgagctctagcccaccagcatgggtatcagcaacttgttagaaatgcgaattcatggcctcactcagatctgctgaatcagaaactctggggttagagccagtaatctgtgttttaatgagtctttcaggtgattctgatgtatttatatgctcaagctggagaactactgtactgggaaaattggcatctattcggaaaaacttgaccacctatgagagccactgaggctcttataatagattcagagttgttttattaaaaaaaacttcccaagtatatttgcaaagaagtgtttcttgcaaaaagtaggcaccataagattagacatctgaggaaaacaataacaacaaaacaggaaaatgtttctctaacaaagcaacacagatgatatttccagttatcaggagaattacttagcacttactgtcagcacaaccacagcctcctgaattaattcatattctgggctgaatgaacgtgcaaagcttattcccatggaaactgagcactatacagattgatagggttatagagcatataactgagctaaagcaattgccaattttaaaagattagcattgacaatttaatgcaacacatttatttcccaaatatcaggagtgtctcatctacattcaaggataaaggactgtcaaaatttgatttaagaaaaaataaaaagccctactacaacacagcttatcatcttttgagcttgggccaaaatgaggcagaagctctgttttcttaatactcccttaattacaaggagactgtttttaacattggtattaaatgggttgctatggcttcctgcctgagagttcagcatgccaagtttcagtcaggagcaagctatgaatgggctgaataagatcctcacaaataggtttcacagcccaaattcctaccacagagcatcccattaggaagattcctgggaggtaacagggagctgacaatggtgctgcctcccttcactttccaagacattccttctatggcttctcactaatcgccttgtcctataggatccttgtcctgtgtaacagaaagctgcttcaaacagaagcggatctgctgcctgctgcttccaagcacagaaaccatgtggcagtttgtttagtcctccaataggtttgtttgttccttgggcaatttcagcgttctcaaattttatatatgactgtgaccagaagggaagaaggcaaacaagaagttcaaagcagagttaaccatgcttagatacaggcccctgtctttggtaaacaatgcagaaaaaactactggggattttatctctgtgttctcaaagatagaaagaaccccaggtaacacaacccgcaatggtgaaaatgagcaaatgcagtccccagagccatgcgtatgtctaatatctattcagatatccaacaagccttctggcttcaaaattctccactcctctgatcttgtagcttctcatagggaccaagcctttgaaatttcatgctaggttttagtgatttcggtttttgtgaggaaaaaaagatatccataaggaacatatgcccgacatttgtggctgtttttgtaaaagcttagcctttgagagctgtggctactgtgttgaagagcaagctctggtcgtttccagagcttcatcattcagaagttagggtcagagcaaactgctgcaaaaggctggggaggggacccagacatgttcctggattcctttcaggatatttacatttacatgcagttaggcaggatgtgtatgagggagaaatagagggagcagagtaaaagtgggaaagaaagaaaggatgaaaagggaggaggaagggaaagaatgagaaaaacggaaggaaggaaggaaggaaggaaggaaggaaggaaggaaggaaggaaggcaggcaggcaggcaggcaggcaggcaggcagccaagaagaaaagggcggcagggaggaagggagggagggagggaaggagaaaagaggaatggtagggagacagggagaagggaaaaatgggaaaaaagaaaagataaatatgtacaacttttatgcatccataaaaataaagaaagaaaaaaaaagaaaagagagacgcggagggagagagggagagaaagaagagtaaacacagcaaagacatactgtaaaagaaggaagtgattttcaccatgtctttcattcagctgtgctgacctgcaggtgtagagaaggtgaaggagtttgtactctttctccaagaagtgatcaactcacacctggcagtttgacacaattacctcacaagctttaatactcattatcttggcttccacagatacaattgttttatggctccaagaataatgcactcctttcggaaatccagcagtcatgcctgggttggcgacctcctgaatcaaggaactgctaactggcaatactgagttctaatacaggtggccaacccaagacaatttactttgcatggggagtaggtggctatgtaatactgtgaagttaccagtaacatttcaattctggactgcggctgccagatataaatggctttatcattttgtttgtgattttgcagatgtggttaaagtcacacaaaggctcataccaaaggaatatgagctgttttttggtttgagacccagtaccaaattggtaaaatgagccagctttcagtaagaagtttttattatgtggacatgagataaatatttaacttgcaaagcttacttgcacgttaaacgtctatcacagaaaagggaaatacccaagtctttctgtctcagtcatctgtgggttctaaaaatgcacaaactagatggaacatcataaacacattttcaaaaggccatgcaaaaaaaccaacaccaggtggacacatcttcttgccacctcatcagcgggcataccacataaaccagaccagactcaatgctgaagaaaagtgacataaaagtctaagtgttcttttttgttttttgttttttgtttttttgagatggagtctagctctgtcgcccaggttggagtgcagcagcacaatcttggctcactgcaacctcagcctcccgggttcaagtgattctcctgcatcagcctcccgagtaggtgggattacaggcacccatgaccacgcacagctaatttttgtatttttagtagagacggggtttcaccatgtaggccagactagtctcgaactcctgacctcatgatccgcccacctcggcctcccaaagtgctgggattacaggcgtgagccaccgcgcctggccccagtgttctcattttgcaaattctttgatttttcagaaatgaatggatcccaacttgtttctgacacaacaccatttttcaaatagtttctctgattattcacaaggatttagaagagcaagcactgtaaacacttccaagtctgggcttgattacctagaaatgtatctagaatgcattctatcatttaatctaaaatctgagtcatcttgaggggaaaacacagaatcttataaaaaggataaactgcttttaagaacgtggatgtctgattttggatttgcaaagcaatgccaattacaagtgatctatttgtttggaaaaacacactgaggataaattctattagtaattaattcaacaataatatgaatttgaaaagatgcatgctccgctctctaaaaaagaaatcagtcagaaagtctacctcaaatctgccaaatcaatgaggttttatccctctgaagttcacagaattgtaacttttgacaaactttaccttctaacttacaactcaagcgtgctcatcacaccagagacactgctccaataacacgtgtctttctgctgcagcattttggaaaactgaagacttctgagggacaaagcacatgggaggtctgctaaccagacatggcaataattaatctcaaataccaaaattacaactgtaatgaccacgtcctaaagaggcaacagtggcctcagcaaaacagcacccctaaattgattgtaaagttaacagagcagctttgggcaaagtggggagttcaaacattaaagtaggattacaaattaattttttaaatttatcttgacacacttgaaagaaatttaagcaaatatctcatttttagacagcagtataaacaatctatattgaattttcttcaggatcatctttatacgtaagtttattgggatagtgatgtacttgtgacagatttctttccctataaaatatctctcttcactaataactgatgcctgcaattccatcatagacatttccattattccttacttaaatacaacacagggaaggggtccctatgcttgattaatccttgtaacaccatctctacagctgtactgggaacactttgatggctggaaccttgtgttttccttcttcgttagtattccctgcaggacctcatcctgtgctaggcgcttgataccacagaatcattcagctccaaggaactggacagatcgctgggctccgtcctttgattacaaagacaagaaggtacagctgaaactcagaagaaaactgagacttctctggagtgactcagccaattagtgacaaacctgggaccagacgtgtggagcccatagacagaaaaatttacccgtcaagcatttactgagctctgctgtgcactgggcattgtactataagctgaggacatggaatgataactacaaatacattgtcctgcagaagcttgtgatctaaatgagttggctagactcatacaccaatgatcacagcaaatctacctaagtgccattataaaattgagtccttaattagccctgttgattcaatctagggaagcttagcaattgagacatagaaatgatttcttttggaagatttcacctaaaaaaaagtactggaacttagattccacagacaggtctttagctgagattccagcaatttcgagttaactttactaatcagaatattttatttgcatttatagatgtgaatgaagagctcatacattttagtcatatactcaaaattaaagtcgtgttcattcatttttcagtcaatgtgttagttaggtgtgtatacaaagaatgcagacagaaatcctgatttgattcgttcttctgttcggatctaactagttaatattaacaagagctaagctattaacttttctaaaggattaatttgtacattctcttggatgatggtgaatctcattcaagtgagaaaccttactctattcaatttttcatgaattctctcaaataattggtttcaagaaatagcactacacaacatcttatcattttctagtcctcctgggaattcctaaatcatgtgacaaggacactaatcacaaaattcaacagggaagtggtagtaacatgaaatactcaacatgtagtctttgctttataggagcctccaggctccgtagatccttgagtgtccgttcgcctcgcttgctgtgataatttcccgtgactgctactttggtgatccttatataagcccagaagaaagtcttgggtttccccagtatctcaagactccacctctgtccctgtctggctagtttgctcatatctgcatctggtttatatgtgcctctactcaaatcttctagatttatctagtttcagagatagggaagaaatgccatgcttggcttgtgatctgacatgacagtgaccctttgctacctcttctccatgcagacgttatgggccatgggttcttttttactctgtacctccacacgaatggtggctgatttccaaggggctgaaagagtggagagaacattggatcaaaggcagccctctagtgtgtgtggtggtggtgtttgatgacttttctccttcctttggccaaatacaatagatagatagatatggatatagaaatatagatatctcactgcttgtcctgagattcatcccagtcttaaaatctattcagtcttctaccctctttcctctgtatgccatatgtctacatcatatccttgatattcataaaaggtcaaagcagataaagactcaggacccagccctccctcatgccgtgagcctctgtgccttccaccccggtgactcccacaggggcacacaccacagctatgacagaagcactgcagacttttcaagaaaaacgcattttaaagaatagtaatagtttcaagattttaatagaagcacagtacttcggaaatgaggcgttcaatgaacgtgtgatgaatgaaagaatgaatgaatgaatgagtggcaagcttccaagtgtgcctggggagtgaggtggctccctgcagaggagggacttggatggaagttggcccctttcccttgctctatgttgcgatggtaggcatctgaaacgatcctaggtcacatccagttgggtgagcctacttctggcatctgagagtggacagaaacaatttcagctctcaggggtgagccagtttaggtgagccagttaggttaatcaagagtgtgtatggtttatccacagcacttactggaatagagctttacttggtagtaaacccagtcccaccagcaacaacccttggtttttatcttattatagtgactgttattcatttcttcctttactcagtcattcatggaacaccttggaatgctcctttctgctcaactgtactgggggtataactgtgaacgagtcaaagctcctgttcccatttaagttctcaaatgatcacagttcttactgttctggagtatgacttttaactttctcaaacaattgcttttggctcttgcctcatctgatccttatataagcccagaagaaaacagaggctcagaagaggttaaagattttgagggtagcacatggctaattagtagcagagctgggtctttttttatgacatggagagctatacatagtttctattagccagtttcattttcctttcaacagaagccctgcagcaacacacttatcaacatgggcagtgatctttggttggaccttctctgggcaaaggactttggacaccaaatatgctttctgtaacaaccactacacccaattttccaatttttcatggggatccggtaaccatataggaaaaaggaggaaccatcttcctgctcctattatactaagactcatcctacttaattcctcatttaaaacaagaacttttgttatttccaaacaatattcaattaccaaagagtttctctggattaattgcaggacgtcactctcctttaggatagagcacattgtccatcagccccaccaaatcagtcaagagtgaagaaggaagatattgccagggaggaaccaaggcctaggagccctagctgtcactctcctcctcctcctctgaatagaaactccctctgggcacaagaacgggctctccaagaccttcagggctcctgggaaaagtgcttaaatccacaataccctctgtgatctgttttccatttgcagagggaaaaaaaaagtctaatgttggaggtttagctccatgggaaactacaactgcaaattgaatttttgaaaattaaatccaatttaaaatgcattaaaaactatttaaagcaatcttctggtgagtccttggttatatgaggaatctttctgggaagaagaaaaggcaatccctggtgtatctgttgtataaatctgggtttacaccaatagaatcttcttaaaacaaggtttgggggcctgaactgcaaaggggtgaaggctgacttggacaaactgattccatttatgtccagccttccaggtgacatactatagctcagtttagcacttaaaaattaactttaattctagaatttctgtaccattcagcacatgcatttaaggtagcaatgtaccagagctgaggattaggcccaaattagaagcaggctgaaaatactataagagaaccctgatgtttctgcctgattcaagttacactgacttccaatcatgcattttatcttttggcatgcttatgtaggtggccaataaatgttacctttggtgataataaaacaaaagccaaactttcataagctagaatatccaaaagaccattgtctgcattcttggcagcagccagatagccagttttcccaagtcagcagcctctgaggaggctggcgaggggccagttcccagggttggtgcattcctggggcctggcaagaggccactgggaccctgtttcctctttccttctctctatgtagtggaaaaatgttcccattttgacccctctgagtcttttttccccctatcggagcaaaggcagtcagatgggaaatgttccccagttcccccccaaaactcatctcccactgctctaagctggcagagcttaaagcaattgaaggcataagacaaacaaaggagggttcctcaggccagtcatccagcctgattctatcaggagcatggtgcctggagcaaggagaaccagcgggaccttgtgcacagggagtcattgtacctgtgcttggaagactatgggcacttctggaagcttttggaataaaattacctgttataaatagacactggctgggtttcagggttgagagcaagaggccaagatttccagaaaaatagaatgctccatataagagggtctggtgtacagctcattaataggggactgctgagcaattgaactaagaagaaaggaatttgaggttggtcagacatgacctgtagtaaacacctgggtaaacatttctggcagataacatcatggatatgctattccacttttaaacatcatatatatatatatgtaaaccaaacattaataaaaatcttttctgaatgcttccttccatgtacagacaaagaaagctgccatctggaacggccacatcagctggtccacatgtttccagggtagagaagtctgcatgccaggcatggtactgcatgccctatttgtgttgtgagtcctttccctaaattcactcaacaaccctttgaataagagacgatcacctctactaatagatgagaacacggaggctcagagaaggcaggtgacatggccaaactcacacaggcagtaggaggcaggttgggattcaaatccagttcagcctcattctccagccaactcatgctctctccactgcattacagggcatctatttccactgtgccctttaaaattagtgctttgcacacagcaagttcttaatacagctttcttcctgaggctgccactgctacttctatatttgatagaaattttggagtttagcagataggagctgcaccgctctcgtcataacaatgtatttcctttgcatagggtgccacagcctccaaaacaattccttgttctttatttcacttaatgacaacatccctcatcatagtgtcccaccattgaagacacagatattcagagagtttaagaaatgtgctaaaggccacacatctaccaaacatttcaactccagctctagtctaaggacttacgcagttctaatgcagtgatcgatccactagaccaccctccctgcacctcagcatcacacaacttttatcaggactgttgaagagaacaccatgtcactggttacatggaacttgtgttctgaaggtgccacatcaaattgtctggtgaaaccaaattgacaagtccaagggaatagactggaaaacaacacacaaaaatctatttcaaataaaatattaaaaatgggctagtgttttctcagcccagaaatgtgagaagagatggtggcagagtatattattttatagagtcaatgtgctggatacactcgtttggcctctccaaatctacccttcacccttccctgccctggtctgggcccagagcactctatgggccccattccctctggcttccaattgggttcagccagtggaggcaccaacaggggacaagacagtgtgaggagaatgaagtgggagtgttcacgtcccgatccccttgctgcagggccagcacggttggccatatccctccacctaagtggcatttcccgccaaatggttcactccttatagccacatggttctatagccactttctaggcctagtggcaatgactccccactgtttctagctgcaggaggctccattattatcttgttgcactttctatatcctgccaccccttttaaagaggccctttattaaactctcctccagtacctggcatgagtgtgcaatgtgtctccttcccagactttgatgcagtaaacaataaaacaatattactgattttgtctttgtagacaaatgatgggaagttactcaaatcctctaagaggatgagaaaggctaactactttagaccaggctctctctttcagtcacttccttctcaccacacctcaccaaacagaaattaggtcagatatcctgcctcagggacctaccaaactgggcccaggagatctccacatagctacctaccacacccacagtctagcccggagtctactccgggaggaaggcaggacaccactggcctcatcccagtctgtctagttggtgccttcacagatttcactctcagcgttcaccaacccaagctggatcactgccagcctcatggccactccatctccaaaaacggcaggcctctgcaaacagctcctcctcacagaaagggcaacagcccttgagcctacttatctgccggctctgacagatggaccccagaattcaccaaaccaaatgattttatttccctctacacatctatgtgcatgagagcagtcaacgaattaattgcattaggaaacctaccaagctgaaaacaactgcttaaaaccaagaaccaaaaaggtgcggaaagacagaaggcaagcaaacctcaggggcatattcggaaatggacaattatgatccattaagcctggttaagaaactgaaatttatgaggaagaaacatctggaactgcctggcatgtaaagaaaccaggaggaaccactttttgggcttagagggagcaggccagacaaataggattccatgttaggagagaattgcaaaattagtgtataaaaggacagaatggaggcagtgcctctggtgttaactgaagcgtttgaatatgatggctcctggatttccttttgaaatattaattgaaattgggctggagatgagggctgcatgaaaactggcagaaagatcataaatactggttaaagtgagccagaggaatggaacatggcaatgcaacacgaagtaatgagaaatactgctccattcatggccatgaaccctatggatgtctaataaatattaattgataaaaatgaactatactgctgagtggtaaattagtgtaagaaacctaggctgctgaaatacagctaatatatatacagtttgtacagcatacaccgatcaatgaatgagaagaaaagatatgaaaatgatttagctatgtgatgcattttgccttgcaccaggaattaggggtaagagaatgttaatagaggagtcaggaggggtggtcagagggggcaagaggaaagttaggacaataattcaagattatagtagaccttgcttagggtcttggcaatttctcatgtataagccaggcaccctggagtcacaccccattcttttagacactgtggctttctcaataaatttctgcttcagggaactcaaggacaccatagattaaatttggaccaatttattggaggaagatatgacagccctcctccttggggaagccctcgctgatcaatgtagccagaagaacaacttcctctttgtaaccccatcagccttgttgtttgcaccactgtatacctcctggtattctgaatagtgtatatgtgacaagattttttttaaagctttgcaaagcagaaatcatagtttacatttcttagcactcatttcactgtgtttcagaccaagtaggtactccattcctgtgctgatcaatgagaaactcgaaaaagaagagcaggctcttatcagagagaacacccagatgcctgttaggtttgggaccagcttctaaggggatcgatgaaagctctacctcctgttatggacaaagcactagagagtctgccatgggaacgatcctaggctgccagagaatgatgcggaaaactcagttgccatggaaacttgtatgatctgatgattcccattgttgaaagatggtgagacaacaggagaatgacaaacagatcttggagccctaagaacacatggaacatgccaagcaaacatctctactcatttgtacttatttctgctatagaagcagtctcatttcatcatctgtcaataacatagcatttataaaaggctttcaaaatgtgtccagttcctgtttttatgtagtgatctcagcgacaacaaggatgcacagaactacctctgatgctggcagacaacacttatcacagcagctgaatacagctgaatgaaacaggtgtcacccgagctcctgctccatgactccagcaagggaagccatccatgggcagatgctatggtcagcactaatggcacgtgaagctacctaacaatttttgcatcacagattcctgtgagaatctaattatacctacagactcactccccagaaaaatgtacaaatgcatataacataaaatatatcaaagaattcaaagccctggaagtcttttcataaatctcccctatcaagcaccttgggactcaagagaatccaggacaccatattaataatctctgatgtaaaacaaacaaacaaaaaactttacacacacacactagaatcatccttgggcaaacctgaagagcagcatgccatttcctctctccaaccttcccaaacagcaccctgggcctgctgcatgtgggccccctttatcccatattcagcacccccatgactgtgtatttggttcataagcagctgctcactgctaagttcactcactcattcattcattttactgagctttttctatgtgtcagactttaggaatacaatgtgaatatgacatggcccatgccctcaggaaacctacagtcaggggtgatttttcttctcagggaacataatggccatgtctggagacagttttcattgtcacaatgagggaggggtgctcctggcatccaatgggtagaagccaggtatcccaataaacgtcctacaatacacaggacagcgcccatgacaaagaatgatcaggtccaaactgtcgatagtgtcgaggctgggaaaccctgttctagagcacactggcctgtgggaatgtgaaaaggccagaagtaggtattatgccagctcaggaaggggcgtgttcataagaactccggaacatgtggcttcgatgacagcctgccttcttttcagagatgaaaggaaggagagaaggaagcaaaggagccattcagagtgagtaacaaccacaatgaaggtggatcctccttcaggcagtgtcagaggaggcaggaccaattgcaagtgctgggcagacaaatggcatttcttccagaatctcctcaggggaaatgctgctgaccctctactcacctccatcagtcagtggcccagcagagggaatgtgcagccatttgataggaccatcactcaagtcataaaccccactgcatgctgggggacggctagatgctggaggtgccccatcgctcaccaggttctccctactcttctcccattctagtcaataactccaccttgtacatgaacacgccataatcagttctcatatgaataaaaacacaaaattgtatatatatgggtatgtgtgtacacacacacatgcacgtacacacacacactattataaatcgcaatctcttctaaagttggttccaaggtctggttcatcagaaaatcacaagatcagaaaatagacctagacctacattctacattccttataagtctccccttcccacctccattcctttgtcaattgttttgctgaaaccaagtctggcttccctctgatctagactgttctaaactgcaggctcctcagtgggcacagatacagcagacgtgctaatgcacatggtctagtcctgttgaggtagctgatgctctttcacattgtgaagcaccgtgaaggagctcccagtcactggcataaagcaattttctgcttcagagctgttagctgtgcagatgcattgtagtctggggatagccccagacctaaagtgaaatcccaactctacctcttaccagttccattgccttgaggaagttgatgaacttgttaagcttcagatttctcatttgtaaaataggggtaattagagttcctaccttaaagggttgttgttaaatattaaatggtagtttccatataaagtattgagcagcatgcctagcctatattaagcctccataaatttcagctactattactaagggaaggaagccatcctggttgagacttaatgcatgattcactaagtgaacatgctgagctgtctgctaaagtggctttgatgttcgattctgccatcctcattgctgacatgctctatgtccactgcttggacctagtctacttccgtcctccattcagactgtccccagcaccagtgttgctgcagatctccaatggccctccaagacttttcgtgttaggatctgatctcttcccactcttttggggctccctcaagacttgcagcaagtagcacctgtgggtggtgccctcctggcccagcctcccctgcctcctcctagctcatctgctcccagctccatccatgggacccggagatctgcactgttggagaacaggtgggcagggcacctctcctgcatttctgtacctgcagtgatgggctgagctcggctggtggacagattcactgggtagatacttgtctaagggtctgacacgtctctaactccacctccacccactctcaagagggcacagtcaatatttcagcgtgacattttggaaaggttgctaaaccaggccaaagctagtctattccccaccagttacttttctcctaaaaatggccttcactagatcctcagatgtcacgccatcttctgatacctggctcaggccatggtctctattctaagtacatgtaagagacacagaaataatagacaagttaggggaaatgaggcagttggaggaaaagaaaaactccctcttgttctttggccctccctgacttgatgctcatttgggaaatctcaaaaccatcttgatatcagagaacaaagatcaggcttcccagaggacaacttggcaggttcccagtggccaggggcacagggcaaacggtactttatgtactcttccatcagtagacatggtcaaagggactgagattagactagctggaaaccttctataggaagctggtgttttgggctctgtgcagtatccctatggtaagaggaggtctaacaagagaaccatgagagtcaagaaagatccagtcatatctgaagcagtacagaataaagacttttgttttcttagtattcataacccactagctgtaggctgtactgagcaacaccagcaatacctctattttgcatttagaaaaagtatccgcaaggctgaacatactctatgtcaatattttctaaatatttagaaaaatgccttctaaatatttttctactattcttcctactggggtatatgtacctttgataacagcctaaacctgttcctctgcctgcccgcatatcacatatactgagggtaaatacaaatcactacttagaaaatcagcacccaggaaacgtaaaacaggactttcaaaattcccattgctctaatgcatgcggatagccattacaatccagcctagtgcctgtctttgtaattaaagtgtttttgtaaataaaatagctacatttgatcatgtgtcttcagaggcagctctcttcctacaacaaaggtgagcagttgtaactactcacgtggcctgcagagcctgaaatatttactatctggaactttatagaaagagtttgctgattcctgcttcagaattacatctagtcactaaatagaggggaaataactgaagataaacagcagagatttaaattcaatatgaggaagaagtttccctgggagaaaaaattcagtaatgacatgaattggcaccaaaggatgcaggaccaatatccttgggttgcctcttttttctctactctcagtctgcagttaccaaattccctctgacgcttcaaactacagctcccccatggcccctccatgtagttgcacagctccaactaccgcttccccatggcccctcctcacatcttcccagagtgacctcagcatctactactgtcagtgccacacagttcatttccatgtgatgatatttttcctgcttattaggacagcttccctagataaactagaagcacttgaggaagcctatccccctgtatcagccagggagaccttccaggaaagagatggcacactcaaagcatctaactgaggagagtttggtaaagggactgtttactgaattgtggacagagctaagtcaaaccaacaaaagatgggctaacaacaaccaagaaccattactatgaagaatcgttaaggtatgggaaaagaaaaggtgccagaacatagatagagcagtggttctaactatagctggagttctggggagagggttgtccaacaaaagctgcaactttaggcaaaggtgcccagttcctgtggtccatgaccaagcagggtgagagtgggagaacaaacacctcgacctctgatctcctgctaggagacaagtaggacctctttctcccattggctaaacccaaccagatgccaaaaggcaagtccatgtggtgcatcctccagggatgattggccaggtagagaaggaaaaagagtggatctggagggaaaatggaaaccatccagcacatccccatagctggttttcaatagtgcttgttgactgattgtgttatgaatgttgtggaagtcttgattactataacgatttggatacaaacagtcaagaggctgaaggttgaattcagggatgtgtgcacgtcctttttttcctctacaagcttataaaactatactgctgtcggaactgaggatttagtgtggcagtgtggcaaacgttttttcttccttttgtgggggagaagaaaagagggtaccaggaagaaattcatactgttactctcatctgtgcttaaaagctaaatgtatttcccaaaaattaaaaagagaatgtttgttacttaaatgtgagctggtaagaaagataactcatgctccagcatgctcatcagctaaatactaccacagctacaagtgtcaaacagctacatgggcagcccgggaatgagtcttgcaaataaaagagcacagtgtgaaatgatgactttttctgatcaaaaagcaccctgggaagggctgaacagttttgggtcaagaagaggactcgatttctggggtgatttttatcgttatcagagagtagactgtacttgccgtgaacgtatatacggctactccgcacactcctactggtggaggcaaacttgtagtcacttgtctttctctctgggcctttaacccccacaatgaaacatatttttcatttcagtttcacttacgtatcactttctcctttaaaagggtgaataataaagtaaaaaaatcaccatcaatgaatatttcagtgtgttaccagggcacacacacatggacatgtatatgtgtgcacacacatacactcaaaccctcccccatgccacgtgactaaggaccacaaacttgttttccccaattggagcttttttcagtttttggactgtgagtttctttattctgtgattcctccagtctaaaaatgtaaaagccattgtaagggagctataatttctactcaacacttcaatgatttgattatataaaataaaaagtgtaatgaagttaatagcaccttattcttgcaatacattatgagaatattttcctgtaaaatctgaaagtggaaattacctctgggccccctaactctcaaaaatatgtgtcatgacgattattgcaatggaattttaagacttaagaacgtaatatgtttctctttcctctattcagtttcccacaaggacatcttctgttcctgggatagtatataatgaaagataaagaacttaagtgacaggttgttctacttttggtgtaatcctagcgtgtgagctcaggaagagcagataacctctctgggccttaagcagtctgcaaagtgaggagacgagataaccgattttcactttagcattctagattcaaaaaataaaataaaaagcatgcattgggaatgaaaactgtactgtaatgccaggtttgttgttcttgttgttttcttgtatttcacagcagcccttatctagaatcttccctacctgcttcttgcctagtaatttgtgtggcttcagcataaagctgaagaagagggcaacatcttgagttcagatccctcacaggccaggcatctttgatctcatccctggtctagctttctttctgatacttggaattcattcaaggtgctttcaatggttcccattcccaaagaatcaactcaaaaagaatactctagctgctattctcccagaagtagcatcttatttgaagaagagaacataatactataaccgggggcaaaattgtagtaacttggcctaagtgctataatgttgaaaagcatttaagcacccccctacacactgtgataggaaaggacatcctttttcagaattttcccaatctgggcatgcagatgtaacacagtctgcctctaggaaacaaggaaaagatttcactagtgtaaaagctctcctaagcatgacacagggagacttaacaggattaagtctctcaggtggtgccaaacaagttctcattttcacagcgttcttctatgccagcaagtcaagaaacatatttgcagccctcaacaagtttcagggtacagccatatgccagaaagaatgcaagctcaatttagggttttcagctagactggtaatgtgacaggattttacttatgcccattttcaagctatctttaggcaaaatttaaatatgagcattgacactgtttccctttttccgatctgcaagtacctacgatccccattgggggttactcacgtccccctgccctgtcttgtcctgccctatccctgccttcgcagctatctgggctctgccttcttctattttaccaattcccacaacaaaattctgctcatcggtttgacatttggcagtgatccaaggccatttattaatgagtgctactatgaattattgaaagacaatagcttattatgtttaactttatagggtatttgcataaaacttgagatctgaggcagaaatctatggctttggggaccaaccaataccgatgatatttctgggttaagagaatctttcttgagctgctcacatcataccctacggctgtctctgtccttagcctaggcctaagacagaccctattggcatgctgatatgtaaaaagtgtttttcttctgcaaaggagaggctgagaaattatctctttatcccaggtttccccagaagttgaaaagggaatacacatacatatacacacagagacacacacacagacacccagacacactcacacaccaatgtcaccacgttcaacctggagttagcaagacgtaggaggtgagatggggtcagatctacggagaggagaacctgaaatacaccaaagttggcctctaaaggtatgctggtcaatgcacagaccaaatagacacagacattgattctgactaaggagagaagaacttgacataaatgcttaacacaatcctcttctcaagtcccagaaactcacatctatgaataatttgtgaggcagagcctcagccgctaagaggtaaataactaatctgtccgtgacagagcaagacctacagctgcaaagtttgaaaggtataacggataaatcaaaccaacaaatagttcattgaacccccactctgctagactccaggacaggtgctgagcatatacaagtgaataaagcacatccctataaaatgtgcacaaggaaccaagctaaatctctatttcagaaagtttgctttctatttcaagtttgcttgatttgattccttgctctgttcacacgcattgcgtaacagaaaaggtgacccacacatgttggcccagagactgcagaagaatagccaaccatcagacttagtctaaagtgaattagtctgtttcactggactaagcagattttcacaccggatagcaaacccaaccaggttgttaagaataatattcatcagcattaaaactctcagaaagttagtttacagacaactgaactaatgcacatacctaagaaggtctccaagacttcctctgctcttcaatatttgaacctgtattgaattcttgttcaacttacccccaaggttaagataaatgggggatggaacaactatacgtaggcttagcatttggcatcagctatacagtagtgtttttgtataggctgaagtctacatcagttgtaattaatgtaattatatataatgttgacagattatgacatttgcctattaagacactatacaaacattccaataatttgctggcttttgagtttgtaaaaaataaatgaaacaaaatctcaagggatgttgctaatggtgtaactggaagagaggtttcaaaagcacagcgttcaggaaataacagtcaaagaataatgcattcaaagccaaaacatatagagtggtaaatgaatatttagtacttaccacaagactgctgtctagagacagcctttttccaaagtcccttttctcaagctgtctctttccctccatggatgaagttatttattttcttttgtgacttataagaatcccccgtctgtttccagggtcactgaaaagagtgaacatgtgttttactatccaagtacacagtgtttagacctttgtttttaactctctaaccagaaacaagcattgaagtcaaaaaatacccagtcccaaataataagtatagaactaggctctctctactcaaaagaccactccgtgttacaaatgtcagagttgtctttatggcggcccctgtgtttttataggttttgctaatggagttggggaatgggtttgcaggttgaatcagcagactgtagaaaaaagcaaacagtccgtttcatgccacacttgctccacacccgtcctctctctatcagccagaataattctgttactgtgcacatagatgctgtctgcaaattccatgagatcaaaccgacaaaaccacgctctataaccaagagttattgagctcaaggcccaatgaagggaaactgaaacatgaacattgtttaatttaaaaaatatgtaatttaaaaatatttgaggaacattgtaagatacattcctttggggatagattgattcaaaatgaatggtgggtgatgtcattactgtcaatgagtatttatagaacccactgtatttttaccatattagatatagttcatccctgaactccactgagattgctttttctagaatgattaagtattctggttaataaggattcatcatatatgttaagtgccagcttccaattttcacaaagatgtaaaaggcttgaaataaaagaaatgggttacagtaaaggattttttttttttttttttttttttttttgggatggaatctcgctctgtcacccaggctggagtacagtggcacgatctcagctcactgcaagctccgcctccctggttcacgccattctcctgcctcagcctcccgagtagctgggactacaggcgcctgccaccatgccaggctgattttttgtatttttagtagagacagggtttcaccgtgttagccaggatggtctcgatctcctgagctcatgatctgcctgcctcggcctcccaaagtactgggattacaggcatgagccaccgcgcctggcccagtccaggatttcttatccactagccaagtgaccttggacaagtcatttaacctctcagaaactcatttttctcaactacaaaacatgatgatagcaatcaaatgatgtatgggaatatgatttggatgccataaattacaactcatatgtaagttataattacccacagattacatttaaaaacagttaacctgaaatatgagtcaatataattcaatatatccttgatgattcagaaggtgctttgagatatagaaattgctcataatccttgtaaataaacatagacattgtactgctgatgcagaagagatgaaatacaatgctataccaattaactttttaatataattggaaagaaatatgttccacaactctcaattgctccaagcctgacatggatcaaacaggcaggatttcatggcccacaggatgtgggctgtctctcttggttttcctcatcaagagggttgagacagtggtgcctgagatggggaatgcccaaactatagtcaatcatgagaaactgatgggctcatattccagcttaggcttcctcctccatcttagtcattttatctcttactttcaagaacactaatttttaatacatcactggtccactcagaaactcttaagagttcaatcagaatttaggataaaatccaaagttttcaatatcattttctaaaattctaggcagtatttttcagaaaagaagttagttctgtatactgctataggcatgaccactagtcaactgaaatttgtttgggaggctgccttttctactttcagctgttcctgcctactttgtagcattctccctctcccccagtctcagtgactgtaaacactggtagttcagaacaccctctgcagtgatgaaccagctagagactactctgaccctcatatttccctctccaccaaaaacacaccctcctaagtcttgatcccaaagagcatgggagtttgatagctcataatagattgtgctttggcctttagcacatatgcattgagtgcctactgtacagaagacagtaggaataccctaggaatactgtatggaaaacaatccttacatgttagtgacacagtcatgtacaagaaaaacaaagtccccgcctttgtggaactcatattttagtgaggcatatagaaaacaagcaaacaaacagctctaaactgtggtaggtacagtatgaaggaaataacctccagcaggtggtgccaaagtgccaagcggccgggcacggtggctcacacctgtcatcccagcactttgggagactgaggcaggcggatcacgaagtcaaaagatcgagaccatcctggccaacatggtgaaaccccatctctactaaaaataaaaaaaaaaaattagctgggcatggtggtgagcacctgtagtcccagctactcaggaggctgaggcaggagaattgcttgaacctaggaggcggaggttgcggtgagccaagatcgcgccactgcactccagcctggctggctacagagcgagactccatctcaaaatataaaaataaaaataaaaagagagagaggacccatttcttaggaagaaaatagccaggaagagaatgcgtgaaaaaagtcctgagttacaggcaaaaactacagaggcttgtaagctaatgtatctctctcagctcttatgctaaacacaaaggttaatcttaggttttaaattccctaccttactccctactagcaggtaacattcaacaaattatttaacctatttaagcttccactgcttactctatatgacagcattgataataggaccttcttcatagtagggttttctgatgattaatgagacaagccattgaaatagttaggctggggacagatacaggtaggtaagacttaaatattagatatattgatcatcccttctggcaaatatgattaaactcattaaaagcaactctagctactgaactttatgctccttcacaggcagatgaggctgtcattttgggaaatggggatccttttgatagttctcaaatagtccaatctgcctatgtggaaagctgatttaacagctttccaaatggatttggtccatttcttttcatattaatggtaccaataatataggcagatataatattcaaatgatttagcaacaatatggcataagggttggccaatcataaacgtacagtccaatcagggctgacaatggcaacaagcggtacagttagagcagtgtatcctagccaattcccagcctaactacatgtactggccccactccaagaaggtgaaaatttgtgagttagaccataaaacaatcatggaaaggttcagagtaaatttatccaagtggatcaaaggaagactatctaaaagaaacaaaatggcaaccaggatgcagcaatatgaaaaggaacctgattaacaatgaaaatatcagaaaggctgaaacattccattgatcgcactattgggaaaagactacatacatacagcagagactgcagatccaggggggaaatgagtatatcatatcctaaagatgcctgggattacctgggccatttgtaccatccatctaactcaactaattcagagactagtgtcatcaagtaaccttccaattttatttaattcctatgcagtatcacttatagaagaagaatgtgctgaccagcaaatatcagtagacaatcttttgaaaaactacatttctagtgcaaactaaaaatgacagtttgacatcttactctttatatttattatttacctatttggttagcatattagtcagcttgagctgtcataacagaataacacagactgagcggattacacaacagacgtttattttctcatagttctggaggctacaagtccaagatcaagtgctagcagagttagtttctggtgaggcctctctccttgtcttgcagatggacatcttctcactgtgtcctcacatggcctttgctttgtgtgtgcacatccccatgtctcttcctctaaggacaccagttgtagcacgttagagccccacacttatgacctaatttaaccttaattacctccttaaatgccctatctccaaatacagtcacattgggagttaggggttcaacatatgaaatttgcaggagacatggttcagtccataacagttattttcagtcaggtttcaaatcacatctgagtgttctattaatcaaattcctaagtctaaaaaactaagggaaacctccgagtagtggggcttatggtggctacctccagactccacacctctctgcttgttatgtgactgttggatcttactgccccctttccacctcaccttgccctgctgtactcttctctgtattgtgcatgtacagatgcaaacatgatcaagacttcttggtcagtgtgttaatgttgaattctgctaatgggaggcagtgagaggagattagaaggcaatgggaaagaagaagccattctgcttccagctctagcagaacagcatcaacagcaggtgactgcaggctccagcaacttctgtgattcctccaatagatcagctaagaaagggcaccagcaatgccccagtctgtgggtaccgccaccttatccctctggctcctccagccctttcaacaccatcataaaaattccttgcattaaatccctctttgcttgaaacatctacagtaatttcctttttctaggcttgacaatgtttgatgtgcaccccatggagatgcctttggaaaggcagcaagccttccttgggaaatacctggatttgttattgtcagtcttctgaaataatagtctggaattattttctaataaatactaagcctctagaggacagagagagcattttatgttctgtgttcccctaggtagtataacacctaatgcatagcacatgaagaacatttgttgcttgcataaataaatgaatgaatgttcacagctgtctttgtgaacatataaagagcagggcaaaaatacaattttgtttagcaaagtaatactagacacatttacaagagtgaggttgctttttagccaagcatattcggatacacccaagcctcaaagaaaacattttgtcatgattttgaaatgtcatcaacctaaaatctatttacctgcacctacaaagagccataaccgagtagtgttaatgtcttttctatgtcttccaacatctctggttataaaagaatacatatattcctcagagcaatgggttggaggcctctccttccctccgtggggaagaaaacggtcatggagttgaaagaagacaggaaattaagcatccttttattgactgatagttattgatactaatcttcccttccccctcacatacacccatctctagctagtgaaactacttctactcagtatctgtagaaatctaagttggccttaataactcttttttttttttcaattttttctcacagttagtaatggccttttcatgctagacagatttttaacctttctaaagatgtcagtaaattctattttctgatatacttcgttaacaggctgtataattttcaagagagtaacaaaaccgcaccattgaataaaatctcaaaggcatatcccctcacatacacacagtcacacacacacacacacacacacacatactcactcactcagacacacacacctgatctagacaccactttctccatctcaatttctgcctttctgattctgccacttcccatccctgctttcatatattaatggtattgccagaagaaatgcagaaaaacagtaatgccaaaagggctctcttgcttaggcattagaagatttggttcctagctttctttgccatgtaaatttgagtagattcctaacttctctgagtttacattttttatgcttttctcaccaggtcattgtgaggtttcaatgagataatgccccagcaagcttttccacatctaaattcaagatgttttccggtcagcttcgttaagcaacaaacaatgcaaaatataattttttgcagcctcataaacatcccgagaacagagactgtgtcaaattcattgttatattccctgcagcatccaacgcaccagctcccacacggtaggcatgcaaagaataactgcagagtagagcacatcaaggacaaataacaaacacagtaagtttcctgtcgttgacaaggcagctccatgggttttcaccctggttgtaccttagaataacctggggaactgttaaaaaacatatcaatgcctaggtcccaccagatcacttgaatctctggggtataggctgcagggatcagagtaaaaacagccagggttggcaaccatcagttaagagcagtggctgtcaagctttgccgcatgttagatggagtcacctggggagtcattaaggcccatccctagatggaataaatcaagatctctgggggtgggaaccaaacattattattttaagattcttcaatatttccaaggtgcagtcaatggaacaccagtttaggaaggtgaagatgtcagtcttttcttgatctccgtcctcttctcaaaggctgagggacacatgattgttggtagcagcaactacctttccttagccaccatacccaacaatttttaatctgcaaaccctgaccccaaagaaaagaaatgttagatacaaacaatttggataaatacctttatccgtatctccactctcaggctcatcattcaaaattaagctgcttaagctgatccttcttttcattaagaaaacattgttgactaaaggtagaaatattaaatctagattccaagttaatgtacgtatatcataaaacctcagagtgaggtcttcacgtagagtttcagggaaagaacttcaaatggcaagcccaatgttgcagaaaaccatgactcagatgcccccaaacccacgacctcctttcttcccactgctctccatgtgcacctagctctcttttcaaagtgctaccaaatagaatgtttgaaactccagtcctctttgtattgaaatctttttattctgatttattaagtccatagaaaggaaagcactggctttctgtatgctttaaacacgtacctacagcagtctcattttggaagatatatcagctcaataactttctcctattgatacagctatttgtggtataaatgggtaagggtgtgtttgtgcatgcttatgtgtatgtgtgtatgtgttgagtctgcatctgtgcatgtgtgttcatgtgtgtatgagcatgtgtgtacatgcgcatgagtatatgagtgtatgtgtgcatgtgtgtgtgtattcacatgcactctgacaacaaaaccacccccacacagaaaagtgttgtgtccattttgaatatgagtataaaaacatgccaaatgatgtaattttcaaccataaaaattttttaaaatcctaccagccccctgaaactgatttagaagaagattaaatgctaacaaatttcccaaatgtggtattcatccttgccagataaattagtggctggaaatagtctcagagagacatgacaacaacccttttctttcaagtggaggaaaattctgcatgatgttgaaaactggttttaaaaaattgtttcctacattcatgctcactaaacgtctcactaataatattcagtagcttccggttgatggtttcaatgccagacaggcccctaagaatcactttcccatgggcccctcctcagataaatggctatggccaacacagagaactcagggagctgcacaaagtctgggtctggaaatcttgtctatttttcaacatgcagctcagtgaactggagcagtaaaaaaattgctatgaatctgaactaagtttcttaggaagagaggtcagagaagagaggtcagagaaaacttccaatattcagtaatttctctcactattaaaacaaattattgagatataattcgtatatcatataatccacccttttaagtatacaattcagcgtcaacccttctaataccaatatttattcatttgctgcagaaactggggattatgtctcactctcagtggggacacaaagaagtttcctcatcacttcttgaggcctcatcaagccagctgtcccatgtcaccatcatcttgggtagcagcatcctggacaggcctgagttcacattctccaactgccacttacaagttctgtgaccttgagcaacttatttcacatttctttgctctagtttcctcactgataaaattaagataataataaaaatccccttaacaacgtaactctggggattaaaatgattcctgttttaaaataccggagtagatactctgttggtataatcactcaaaagagttccattcattcaaaattaagtaatatatattctatacctattttgtcccaggccctgtgttaggccctgaagattgaaagaaaaacaaaagaagaagggaggaacagagaaagggaatgaggaaggaaggaaggaaggaaggaaggaaggaaggaaggaaggaaggaaggaaggaaggaagaaaggaaaggagggagggaaggagggagggagggaaggagggagggagggaaggagggagggagggaaggagggagggagggaaggagggagggagggaaggagggagggagggaatacatgtcctcaaatttcaaggagacctaaaatgtaagagagggagatttatatattgattagtaaaatgcaagataaaataaacatgtgaatgaacaaatgaacgagcacatgatttgagcaaggaggattcactttttattgagctaaccctggaggacttgcctttattgtcattcctggtgttgccagctgatttccagacacaaactattgctacatcttcaatgtatgaactaagaatgaagaaacagaattgcatgggcttagaccagggtaagcgttttagctctggctgctcttctcaaaccatctgttccttctctcccactcttcctttgtaaagatctccccctgcaccaccactctttctttctttcctctgactcttctccatttattgccttaaggaagatttataatacattacataaaacgtctacatgttgcctgtgaactcctaaagggaaggtcggtatagaaacaaaacagataaatacattttataaataaataaataaaatgtacacataaccccagtggattggaagaatatttagataagtggctagggaaaagaattttcacactgtgtcatctgctaacattaatgagtgaattaaattagaaaaattccactgccaaaagcaaaaacatccaaatatgtgggatgctgggggaattatagaccatgctactaaatgcattctgttcaagcttactttttttttttctttgagcaggctgtggagagctacacttaaaaagccatccaatttcaagacagtattttccatctggggccagttgggtagaatatgctctaaactctgcaaagcctgctgagagacaacacaacttgttaagaaaactgtttatgaaaagggatgttttttgaaaatccagcaaaaggtttaactatgatgtccccacacattgcagaattcattattctccattgaatgtctttgtgcacaagtgaaacaccaaaatgactcaggaaatgagtgcagtacaataaattggaagccagtacatttttgctaaggccctagctggtaattagaatatttccaattacctaggagcttttttttccactttaagaggttattcattcttcatgtatagtaatctccctccacccacccaccccccaaaataatcccgatgtgaaatgctaaaagccaaatcaagattaagagattaaactttaaaaccaattaacatactgaaaacaataggaagaatttttagtgaaccagaaaatatagaatgacattaaagatgtcctaagtaataatggctgccaaaatgaaatgtatgagaaaaatctctaagatgtttatctttttctactcaatgatttaattaaattgagactgatattcatttgttgagagggcagcgggctaaactccctcaaaaaggtaaaacaaggccaggttcggtggttcatacctgtaattccagcactttgggaggtcaaggtgggaggatcacttgagctcagaagttcaagaccagtttgggcaacatagtgagacccctgtctgtaggaaaaataaaaaactagccagatgtggtggcacgtgcttgtagtctcagctacttgaaaggctgaggcaggaggactgcttaagcctgagaggttgaggctacaatgagttgtaataatgccagtgcactccagcctgggtgacagtaagtccctgtctcaaaaaacaaaacaaacaaacaaacaaaagacagtaaactagtcaatgaccacccactaaaatggatagctagaaagtagagttaggttttacacacacatatatgtgtgtatacagacatatatatatatttatactatgcatacatatacacataaatacatacatgtgtatatacacacacatatagtcatttcttttcttctgcttagaatttccacctagttttgagcaataaaaatcaaaacttcaattactgggcctttttttttttcccatgtgtaggttgtttctttttattcaggctttgaaggctcaggaataaaaggagttctatggatatttggacagaccagtgcttctcaaatgcatgcatgggaatcactggcagatctcgttaaaatacagattctgatataataaggctacagaggagcctgagagtctgcatttctaacaagctgatgcttctggcctgtgggttgtacttcaatagcaaaggatctgaaacttaaaacagagaacttatctatgtacatgtaatagcggaattccaagcattttctcataaagctatgcacagccagccagttcttatgatgacttagttctttgcagaatccaagacaactatggcttaggttttgccccatgattctcgtgttacccttcactcaggacatttggaatcctagaatcttaggtttaaatgatgccttcccggccccctcttcacctacccatcagtacggttactgcttctaagacaggcctcactagggcttgcccatctcttcttgccgcttccagtgacaaatgggtcacattgtctttcggaagagcccctttcacatttggctgtctcgaatgcctagaaagtttcaatttgtctcttggattttcacctactagccatagctctgttccctagagcaaatataatttttctcttactcaaggaaaaaaatcccaagtttcttccacattttctcttgtgagaaagtttccacagcccataccctcctagttacagcctttgaaatgttgtagaacttggccaatctatgagataatttttttttattttgtaaaaaacataccatattaaatgcatttattttctttgtaaaagatataagctataacaaatgtatatagagtataatatgaaaattgtatacttttactctccctctttctactcttctccgcagagatgcttttaacagtttttctatttgtttacctatatacatatatattgatttttctctttctatataagtggcattgacatctattgttccgtgactgcatttgttcacctgatatattcaacacctgggcctagttcagtttttacagcttcatagtactataaaacagattatcaataaattgcttattaacttatgggtagaaatttagatagttgtttgtgttttctgattctagaccatcccaccatgagcaagtctatgtatctgttgtgcctgtgtgagtttctctataaagcatagatctcaaaagatggaattatagtgtaaaattttaaatttggttagaaattgactaattgccttccaaaaatatttaagaatatgtaagactacctgttttccatagagttatcatagctgaacagaaccaatcataaagcttttacaaatttgttggtaaaataagtgacttcattgtctgaatttataatccatgattattggtgaagctgggcatctttgttttatgtgtggttatctgaactatttttctctggattgcctacttaaattatttgctcattctcctattgcctcttcctttttgagctctgaatacattttgaatattaactccttattaagagacattgcaaatattttccccccagtctacctcttgtctcttcactttgttatggtatagaatgttataattaatttgcagtcaaatgcatcaatcctttatgcgttctaaattaaaagaccattttccatatgtcttcctaatatttttatggtaccatctgaagataattttgtcttgtaaacctacgtaaagcataggtttaactttatttttaaaagaatataaattcattgattctgtgattaaagtattcctcccacggatttgaaatgcccccaatcataacaaaagtcaacatatgcacaatccttttccttgaccctcaagtaaaaaaaaaaataagctaatctatgcacctgtccttgtgccaatatcacactgctttaattatgagcttttagtaaattttgatgtcatataggccagacttcccatgttgtctgtttggaatttttcttggccatttgtgttcatttttgtcttccatatcaacttgagaatcagctcatcaggtccaacaaaaagtaccatataggtttttattaaattggattgaatttaaatttacagattatttaggagagaatttacatcattatattcttgagtctttccattcagcgacatgaaatgggtagtagattgtttaatggcaacaaattcctcccttcctatgatgcccaactctcttttgaaatgtgtcttttatgctcttctagcttaaggatggtgctcatttctccaccccttgaatctggtagggcttatgaaccttttgaccaatagaatgtggcaaaagggaaactgagttctagcactaggctttaagaggtcttgaagcttccattccctctctatgaaccctcaggctatcatactgagaagaagcccagtctagcccacaagagggtgacagccactggaggagaggtgacagccacaccaactgccagatacctggtcaaggccactgtgaacccaccagctatagtcaaatactgagataaacagaggctgatgagtgattctaggtgagaacaacaaaagaaatacacaggtggtcatcccatggaatcaggaggaaaatcagtcattgttttaagtaaccaacttattggggtggtattttgggcagcaacagataattaatttgggtcactgtgttgttcacatccttcagtaaaggatgtgaagactgaaagaaaaaaaaggaagaagggaggaatggtgaaagggaatgaggaaggaaggaaggaaagaaggaaagaatgtaaacagcacaatgacccaaattaataaatattttattaataacttatttattaatagttattgcattaataaattacttcaatcattaatttattgaattaataagctaattcaatagcctttgggcataatttctttagatactaagtatgttttattactcttgagaattatttacatttttttctacttactttttctaattggttataggcagtgccagaaataagcctattgattaataaactttaaacttctgcttaggtaactttctgagcactctttctggttctaaatgtgcttatttttttctactggatttttttacatagaaaattgcaacgtttttggcttttcctgtccgatacttacaagtcttgtttcattttctggtcatacagcattgaccagggaagcaagtttttagcagaaacttttgctcctgacttcagtagaattagtagtaatgtttttatccataagaatgggattgatttctttgtagctaccaattaccagattgaggaatttttttatacattcttgaatctctatagtgctttaaaatgtttcatttttaaaaagttaaacatactgaaaagtacataaagcaacagagattcatgtacctactaccctgtatttaacacagattaatcttgtgccatatttgctttaatctttcctctcttttaagtaataaaagcactgtagatgtagttgtagccccattcccctattctatcctaccttctctccagcaatagccactcccctgtagtaggaaagcattcttgctgtgcataaattatatttctactgtgtatgcataaacctagaacgatatacagcactgttttatgtgtgttttagtttatgtacatatgatagtctactttctatattcagttgtaattgtttttcacttaatgttatagcagcaagatttatccatgctgataagagaattctagtttatttttaaatactttaggaatcctattgaatggacttaaaacggtttaccccaattccaaaagaatgggtattagttgtcttacattttttaccattttcacattgcaaacagtaatgttgtgaacattcttgttctggcatccttggatcagaggcagaagattctttctcatatggggaaatccttgggtcacaggttgtgcacatgtttgagtgagaaggcagtgccaaattgctccccaaaaatgactgtactgtagcaatttatacttatatcacccatgttaaaagttcttgtttttctcttttattgaaaataaatgctcggttatttgggtagttggatcagatgggctctggcagtgctagatgaaagccagtgcccccaccctgactggattactgtttcctttacacatttattcagggttcctcctataagaaggagctacatttgacaggaaaatatcaggccaggcattagtctttctgagttcttcctttatttcagtatatatgtaatttttattgcctgcctgccacccagaattctttaatttttccccctaatttcacccccttcactatgaaattttaataccacagatttaccgaatatctgtttatgtacagatatgtgtggcttctgaaaggccatggactattatgatattttagtatttttcattgtcccaagaaccaatgctcaccttcattgagaatgtttctaagatccaaaatacttgcaggttcataatttttcagaggctagagggaggtggagcacaattcaacttgattctcttacataatcagcagggcttgtggctcttttgatcaaagaatgtggtaatagtgacaatgagttctgaattatttcactaggggcacactcatttaaagaagtaccttatggggaaaataaagagctgagtaattgggctaagtcagagattgcaaacccaaatgactaatatgttgggaaggtaacgtaaatgcgtgaagccgcccctgggagctgtgcccatctgggcaggacccatgcaaaaagggcagctggcatccaattgcagctaaaaaccaccatgcagaaaggaaggttcactttaccaaactcttcagtttttcgagagtcagaaatccagatcatctatgtaaaatctctcaatgtttgaagattagttcggtttttaaaaagtagttcacaaaccaatatctctgagaagtgtgcaacctatagactacactttgattacatgagttcttataaaccttcctctttctctaaagtttgatagttatttttaaagtttgaattaatgtaaaaccccaagaagaagagaagattgaagtctcaaatatgaacacaaaaaaactaggtacaggaaaggggaaggcagcctaatttaatttcccatcacctgcctgtgcaaatggaagaaactctaactttctattcaaagatgatttactctccttttacatgaagtcaaaatgtggaagcaattatcataagttatagaaataagttctgaaagcacaaaggttttttcttcttacattaaaattaaaattaaaatattacttgggttactgaataatttttagatattcatatatgacattgcagcccagaaatttgaaagtctctccttcaaagacaattttatttatttctttaatttaatagattacctaaggtatgtaagtacatgcctctgtaatctttcagttgtctatatgtctttctttcttgttagttttattatttgtctcctacacacacacaaaaaataaaattcaggtcacatatggatattttgacctggattggatatttgaccaattatctgaattatgaccacatctatacgtcacattttgctgtgtagatggtttcagtggaggttagaaaaatgttgatccattttggaaattaaaatataaggtgtgtatttttggttccataactacctgtataccttctgacaaattaatttctctagtcctcaatttcttaacctcacatatagagaaaaatgaagtaagcaatctctaagatccctttggccttaaaatattttgatcaatatcacaattttaaaagaatttaatgcctttaaattcattgcatctaatttacagctttattgaggtataactcatataccataatattgatccatttaaagtgtacactttattggtttttagtgaattcagagttgtaccactagtaccataatctatttttagaacatttttaacactccaaaaagaaaccccatacgcatcagcagtgcttctccatcccctaccccttacccagcccccggcaaccattcatctacattctgtctccatggatttgtctactctggacacttcccacacatagaatcatgataagtaatctttgtgactaacttcttccacttcgcatcatgttttcaggaatcatccatgttgcagcacgtggcaatgcttcattcctttttgtaattgactaatattctattatatgggtataccatattttatttatacatttatgtatatatttaccagtattggacaactgggctgtttccacatttttgttaaaacactcctgtacaactttttatatggacatatgttttctttactcttgggtatatacttaggagagaaattgccggatcaaatggaaactctgtttatcagtttgaggaaatgccaaactgttttccaaagtggctgcatcattttacattctcaccagcagtgtgtgaggattccaacttctccacatcttttcaacagttgttgctgcccaccttctttttttaactatagccacttataagtgggtatgaagaggtatctcattgtggatttgattcccatttcccgaatgactaataatgttcagcatcttttcatgtgtttattggctacttgtatattgttttaaagggttatgtaaaactagattcaggagatacatatgcaagttttgtttcatgcatatattgcataatgatgagatttgagtgttaagtgtacccatcactcaaacagtgaacaatgtacctaataatttttcaaccctcaccttccacctcccatcctccctccctttggagttctcggtgtctattatttccctctatatgtccgtgcatacccattgtttaactcctgcttttaagtgagaacatacgatatttgattttctatttttgagttatttcacttagggtaatgtcctccatttccatccttattgctgcaaaagacagtatttcattctatttcatgactgcatagtattccatggtgttgtgtgtgtgtacatatgtgaatatatagaatattttctttattaaatgattcattgatggacacttaggttgattccatatctttgctactgtgaatagtgccaaaataaatatgatataatgacttattttcctttgagcagatacccagtagtgggatttctgggttgaatggtagttctagttttaattctttgacaaatctccatactgttttccatagaggttgtactaattttcattcccaccaacagtgtaaaatagtttccttttctccacatttttgtcagcatcttttgattttaaactttttagtaatagccattctgactggtgtgagacattatctcattgtggtttggatttacatttctctgataattagagatgttgagcattttttcaaatgtttgttggtcacttgtacgtcttcttttgaaaaatgtctgttcacctcctttggccactttctaatgcagttgttttcttcttgctgagttgtttgagttccttgtagactctggatattagtcctttgtcagatgcatagcttgcaaatattttctctcattctgtaggttgtctgtttattctattgtttatttcttttgctgtgcagaagctttttagtttaattaagtcctatttgtctatttttgttttgttgcattggcttttgaggtcttagtcataaattctttgcctaggcctatgtccagaagagtatttccaaggttttcttctaggatttttatagtttcaggtcttacacttaaatctttaatccatcttgagttaatttttatatatggtgagaggtaggggtccagtttcattcttctacatatggctttctagttttcccagcaccacttatatattagggtgtcatttccccattgtatatttttgacaactgtgtcaaaattcagttgattgtaggtatgtgcctttatttctgggttctgtattttcttccattaatctatgtgtctgtttttgtaccagtaccatgctgttttggccagtatagccttgtagtataatttgaagtcatgtaatgtgatacctccagctttgcatgtctttttaagagaaatatctgtattccaaatatcaattcagatttttgtccattttaattgggtgatttggtttttattattgagttctaagagttttttttatatattctggttagaagttccttgtcacatataatatttgcaaatattttctcctatttcatggggctttttttctttcctgctaatatcctttgaggcacatttttttttaaattttactgatgtccaagctatctgtttttttattgttgcttatggttttgatgtcagatctgaaactattgcttaatccaaggcagtgaagatttacttctattatggaagttttataattttagctcttacatttaggtctataattcattttaagggtttttttggtaggtttgagataggaatccgaatttcctcttttatacatgaatctccaattatcctaacattatttgttgagaagattattctttttctcacagaactgttttggctcccttgtcaaaagtctattgactataagtgagagaattcatttctgcactcttaattctctacctgtgatgtatatgtctagccttatgtcagcacagtactatcttgattactatagatttatagtaggtttgaaattggaggtgtgaatcttccaacttcattctttattttcaagatgatttggctgtttttgatatcttgcatttccatatggaaattcatatgaattttgagatcaacttataaatgtctgcaaaaaaatccaactgggagattgcattgagtttgtagatcaatctggggagtagtgccatcttaacaatgctcagtcttctggtccatgaaaatttgatgtctttccatttattcaagtcttaatttctttcaacaatgttttataagttttagtgtacaactcttgtacttcattttctaaatttattcctagatgttttattctttttgttctatcataagtgggagtactttcttaattacagtttggattgtttattgcattgtatctccttttagcttcaaattgaaaaactagttcgtatttccttcattcattctaacttttttgttctttgctttaaaagatgcatttttattttagctgtaatatattttctagttttatttttaaatctttttattaagtcatgaaaagactcatagggttgtatacagtatatctgaattaaacaaattgagatgcttagcctcctcaattaaatcacttagaataaattataagacttccatcatctttcaccagcactcattaaacacttcctaaatgtacaaaactaacaatatcttagctgcccacatttgctgacaatgcatgcaactccatcaacaagcaaactgcatttaactcctataacctcagaaaaacacagttattaagagaccaaaacataaataccctcatcatttcaagcttgttgcttaatatttgcatttcattccattaaaggaataatttccattgactgccaaaacgaacaaaccattgcaccataaagccacattttaattttactttaaggggactccatgcaaacccttttgaaggcactactctactattgccttttaaaattatgctaacattgttgaaggtataaaatataattatttgtctcagaagagaaataaaagaaattgtggttactttgtcttttccttagaaatataatatgaattcaaactaaagaagtcaaattaggtgagtggctcttaaaaactttgagaatcaggggaaattaaaatacatttaatttgcagagatttttttagcctaatttgaaggattcttgattattctaaagccaagccatggaagaaatggacctcaaagtaaaaatcttccataaaataatagttgagttagatatgcaacttttgtaggtaaattccctggcatatatgaacaaataaacatttctgtgaacaaaaaaaaaactgagctcagagaaggaaaaggacaccgaagtcttggacctactgacttctgtgtccagagggacacaaaaatgggaaagagtttgacatcaagtatacatcaggcaccaaaagctttccataaatgttgggagacaaaggccagccagcttacttcatgaaaacatagtctgggaaaagggtccctcaatcttgaagaaggattgtgaaaactaattactgcctggggtcacagcttacataggatgttgatctgcatagtagaaggaaagacagtctgaaagataggtcttgaaccaagtcacttgatagctcagcttcatctgagatgtacctagtttttttttggtttttttttgtggtttttttgggtttttttttttttttttttttttttttgagacggagtctcactctgtcgcccaggctggagtgcagtggcgcgatctcgactcactgcaagctccgcctcccgggttcacgccattctcctgcctcagcctcccaagtagctgggactacaggcgccagccaccacgcccggctaattttttgtatttttagtagagacggggtttcaccttgttagctaggatggtctcggtctcctgacctcatgatccacctgcctcggcctcccaaagtgctggaattacaggcgtgagcctccatgcctggccccccagttttatattatagaatagatgcctcaagtaactcataaaacctagttctagttggggtgtctggtaagcttcccagaggcatccataaatcctctaggtgaggagaagtgtgcacagagatgagaggaagctccaattcaagatgaaattgacagtttaaagcacacaaaactaagaagacaagcaaaataaaaaatacagataattcaacatcaaacaaacgaaaacaatgaaaagctaaaactgacagtaaaaagaaataaaaaccaaaacataaaatagaataccaatcataaaaaggatgagaaatatgatacaagaacaggcaaataagaaacaaaaacaaatgtataggaagaagatctactataaatctacagaaaaaaactacggtctaaaatgaaatgccaataagacaaaatctagaaaagacaatcaaagggataattaatgaattaaaaacttatgctgatgaatccacctagaataaagcacagagagaaaagttgaagagaaaaaatatccattcaaagtctccaaaatgtatccaaggaattctgaaaagagaaaatagaataacatagaacaaatatcctaagagataagggctgagaaattttcaaaacagaagaacatgtgaaaaatactatacaggctgggcgcggtggctcacgcctgtaatcccagcactttggaaggccgaggcaggcagatcatgaggtcaggagatcgagaccatcctggctaacacagtgaaaccccatctctactaaaaatacataaagttagctgggcgtggtagcacgtccctgacagtcccagctactcaggaggctgcggtaggggaattgcttgaacccgggaggcagagcttgcagtgagccgagatcacaccactgcactccagcctgggtgacagagtgaaactccatctaaaaagaaaaaagaaaaagaaaaatgctatgcatatcaacatgtatactattaaaaccataaaaacctcaagtgaaagacaaaatcctaacacatatgagagatgttttttaaatgacataaaatgaaatcctattagagagctagactgccaggatatttctagttagcaaaaattaatgaatgaacacaagacaatgatgtaatcaaagtgtttacagcaaataactgtgaacttagaatttcaaattgagctaaaacataatccaagaatgagggaaaaataaaaactttttagacttactaaaaacacacgtttttaccttccccagacactcactaaaataatgaaggatatactttagcaaaaaatgagagagaaggagtagaatataggagattgcagtaagcaaagacatggatcaaacatgtttataaatctaattatctattgccattaaaaatagcaattgaaggccaggcacagtggctcatacctataatgccagcactttgggaggctgaggcaggtggatcacctgaggttgtgagttcaagtccagcctagccaacatggtgaaaccccatcactgctaaaaacacaaaaattagccaggcgtggtggcatgcacctgtaattccagctactcgggaggctgaggcatgaaaatctcttaaacccaggaggtggaggtgcagcaagccgagattggctactgcactccagcctgggtgacagcacaagactctgtctcaaaaaaaaaaaaaaaaaagaaagaaaaaaaatcacagtgggtttcaatgggtaagggaaacacgataaggtcttagtgttatttttaaagggtataaagatactaaataaatcttattctttgttataaatatataagtattttatatatatagacattaaaattaatatgcatgtcacaaattataaggtaaccactaaacaaataacaaaattatcaaatcaaatccaagcagaggggtagaaataaaaaacataaaaaattaaatccttttgaaggtaacttcatgaatttttgtctcattgtctttcctactttgttaaaacttttaattgaaaaatataatatgataaatttaaaatcacaatattttaaatggaaaagagaaaagtaaaaggattcaactaaagttgggaactacataaatgagaacaaaacatgagagcaacattcacagagaaaatagcctaatttagtaataaaattaaatcaaagatggctacaataatttaaatacattttatgcaatatatggtaattacatcacgatccttcaaactcattatatgctcatacagcctttagaaaaatcattgccaagattatttaaagaaacattcctgactgtatacataatatgtggactggaggcaaagaaagcatcataagcatctttgctcctttaggacttggctgagttctcagcaatggtagacagttaataattttttgttgaataaatgtttgccaaaaaaaaaataagaaaaagagtaaaacaaaaaaattagtgttaacattgggctgtaactacatgatattgactaagaagtttataaaggagatttttttttttaagtgtcagatctttcacaaaatagagagggctgggagctaggctgaggactaagtcgccataaacaatgccccaaaccactttgcaaaactaggctgaggaggaagctgctactgctgctgcctccaaaacagtttctcccatgaactccctcaataaaatgtccccacctgttcaataaaatggaagggtttgcacgggattgtttgcacacttgactcacttcaggactgaattctctcacatggtacatctggttggtggagctgagatcatatgcctgcatcccagttgtgaggctgaaaatttgagttctggtttcaatgttggggaggagatggttatatcatggggatgtccctaaacatagaaaagctgttcatgagatcacaagcagtcacgaacatgacgaatgtctatgacaatacagttacaaaaatgggaatgcatactccataattctccacctacagctacgtactaagtataatttaatgtcattaagtattcttccacagtaccatatttgaggactgcccagtatctcattaattggatgtcctataatcctataatgtgttttagctactccttattggacatgtaggtggtttccaaattatagtagcttaactttgggaaaatccacgatcatttgcttcaggtaaacggggagagattgctaatgtcctccaccactaccctgtcatcccacgctatccagttttaaaccttccttagccttcaagtagcaaacctcagaacatgccgccatatttcacagtgccagtgaaatcgcagttctcctttcctccctgctcacataaccagcagtggctccagtgtttgcacagactaccttgacatcttttacactgtgatcttcatcccatcaccatttgaggggtccatctgaatagctatgtattacgttcttgtcatctcctggaaattcttaaactctgcagactatacttctgatactcccttcacgataaaatctgaaggtcttctacttctggtgcagtattggcatatggataaaatcaggagttttaaggtggtgatataaaatcacttaagttagcttctctggtctctacttttcttatttataaaatggaaataacaacactatgtataccataggtaggatcataatactatttaccttgtagattgttataagtattaaatgagatcatttatatgaagtatgatatggtttaaatgttttgtcccctccaaatctcatgttgaaatgtgacctccaatgttggaggggggacctagtgggaggtatttgggtcaaaagtgtggatcactcataaatggcttggtactgtccttgcagtaatgtgtgagttctgattctatgagttaacatgagatctggttgtttaaaagacctggggcctcctccctctctctcttgttcactctctcgccatgtgatataccggctccccctttgtcttccaccatgattgtaagctcctgaggtctcaccagaagccaagcagatgctggcaccatgcttgtacaaccagcagaactgtgacccaattaaacttcttctctttataaattacccagcctctggtattcctttatagcaatgcaaaatggactaatacaaggtactcagcacagtaccaagtaagtgtacgagaaatgttagctattcaaagtaaccagataaaattgtctctttttgtaggtcactggaagcttcacatccaatagtattatttcagtctgatattatcactcctaagtttcaaaaatgaaattttcatcagcaccaaaacctctagtctattgactagcattgtggccccaggcctttggctttctccatctttatttcccctgtgggaaatgaaggtctaccaaaagacctacaaaatctaccaaatttggggtctagaaaatcagcctcacatgctccttatgaaaactgtatctttatttccctaaaaacaatcaatacttatttcttcctttgtgtgtctacaacttgttccccttctggggtacttcattcagtcttggagtattacagtgtggactcacaagcaagtggtaggtgtttgcttgtctgtctttcccactagattggttcccctcaagaacagaagccacagctcatttatctggttatctctatcccagtactgaatatctagaacaagcttatcttgtttgaaatgaagttaaactactgagcaatggatttctttgcaaataacttatgctgcttcatgactacttagaaatagctgatgatttgtatcttaacagcgttgatttgtatcttgaattaaaattgccatgtctggaaactgatgcacccagagaaaaactgagatttcattcctcttttatattacctttggttacctcaggttacttatttggaaaaaaataaatctctttttcattattccatgaaacattccttcagaatattctattattaaaatatatacaaatatacacgtgtatacacaaacacacacaatatatcattctttttaaaaagtaatcatgaatatcttcttaaagtaaaaagttaaaattatgtagaaacctacatggaaaatacatgtacttatttaatatgtaagctttttaataaacataaatgataccctattatacatatttcttgacaatttgattttttccccacttaataatatgtcacagaggtctttccatgtcaagataccaatagctcttcttcaattctttaatgatgactcgggctccatcgtgtgaatggagtattatttgtttgattttttccttccctgttgatgggcacttcactgacaaataacttatcactattacagatgctactgcagtgtgcattcttgtgcatgtctcttcacacaaatggatgaactgttttctaggataaatagctaaaggtgccctttcctttcaaatacaaccaaatttctattaatctaaatcactgtctccttcctgttctatcccaatgattacttatactttcagttcagaaaggcagagaatgatgcccacaacttcccagaaatgtaactatcagccttcagaatcaaattcacatctcaaagtctctcctgcctatagaataattcatttgcaagccactctgatcaatatcattaacccagaactcccatgaccccatattattcacagcctcatcttaagggtagttctccatagttttgaaagtctgtttaaggcaggcaggaagacagaactcccctgggtccctacaaaacgagggcttatacaaagtcctgatcaggcactgggagggacactcaaaaggaaagagatgtagaaccaaataacagaggcagctagtgtggacaatctcaagctacaatcagttttttcttcatctatttttcttcattatctcttttagaatattaaactttttgctcatgctattcttggcaagattgcctgcctagttctgcttgaagtcagtgtggcaggagatgcagaaacagccaagttgggtgaccaaattcacaaggtgcacctagctagcggaagctggctgacgcgtttggtcctctacttccctctgccaatagtttgcgcagatttaggaagctgctgtccaaggcagagagtgaaggagatgacggaaactgaaagacaggtatgacctctaaaaatatgcatatttgtttccattgatcagcatcatgatacagagtttgataggctgcctatctgcctgtgggctctgccatcccacaagggcaggctccaagtcgaatctacctcagtggttaccgcacctagcacccactactagatctaacaatctaccttgttataatgctttcattggcactcactaactatgtatctacctggcctaagaaacaaaattgaaacattttgaagttatgtgtgagaatttcgtaccttacaagaagatagcatagaagggaggaggggagaggcaggattcgacagtccaaacgcttatcttttacaatgataaaagatacataatggcttaagcataatcccaatgacattggagaaaatgatacacaaacctcttcatcaggaaaatactgttgtttttgtagaagattgataccgtttgctaaaaatgccctgaaattattttggtttgttatggtactagattcgattagtttaatttggaaatctgagccggaacaaaataatagtctggttttgtctaactgaaagggcaaaaccagaaatgctgaaacacaaatgcattgctcatatgcacacacacaccccccacacccccgccttgcatgtgtacgcacacacaaacacacagactcagaacacatcttaaccatgcccaactggctgagctcagatcttcagatacagtgaagtacatccaagaggaagccaaaggtgaaaaagtgcccccactgaggagtatctgagtgaacagatttgcagaaaggacaggagaaagagaaagagtcaggaaactcattattgcccaagagattatgtattttcaaaacggtagaaagggcttaaaaggagtatttagaagagtacaatttatcagattttccacaatgactgcctctgtggaacttccctggagcattcttcagctctgtgtgataaacctgccgtcctgctcatgtatactccacttaccagatatacaagctgcgctatagagtttcaagggatatcacgcgatgtgtgctttgacataagggcacggttatcctgaatgtggctcattcagtggggctttggaagagcagagggcagtgctcaatgattgagggatgcccccaccctgtgcctagaatatgcctgttcccagcaccagcaggcaaaaacaaaacaaaacaaaacaaaaaaacaaaacaacaacaaaaaaaacacttggtgtaaaaccatttcaggcatatgaaaactctgagagacataatgagccctcccattaattctacaaccctatctaggcattctgctaacctggaatgcttgggtctaggaaaaagagcaattctttgtccaatgcttcaaaagattgagaaaggggaggagccaagatggccgaataggaacagctacggtctacagctcccagcgtgagcaacacagaagacgggtgatttctgcatttccatctgaggtaccgggtttatctcactagggagtgccagacagtgggcgcaggccagtgggtgcgcgcaccgtgcgcgagctgaagcagggcgaggcattgcctcacttgggaagtgcaaggggtcacggagttccctttccaaggcaaagaaaggggtgacggacgcacctggaaaattgggtcactcccacccgaatattgcgctattcggaccggcttaaaaaacggcgcgccacgagattatatcacacacctggctcggagggtcctacgcccacggagtctcgctgactgctagcacagcagtctgagatcaaactgcaaggcggcagagaggctgggggaggggcacccgccattgcccagccttgattaggtaaacaaagcagccaggaagctcgaactgggtggagcccaccacagctcaaggaggcctgcctgcctctgtaggctccacctctgggggcagggcacagacaaacaaaaagacagcagtaacctctgcagacttaagtgtccctgtctgacagctttgaagagagcagtggttctcccagcatgcagctggagatctgagaaccggcagactgcctcctcaagtgggtccctgacccctgacccccgagcagcctaactgggaggcaccccccagcaggggcacactgacacctcacacggcagggtattccaacagacctacagctgaggttcctgtctgttagaaggaaaactaacaaacagaaaggacatccacatcgaaaacccatctgtacatcaccatcatcaaagaccaaaagtagataaaaccacaaagatggggaaaaagcagaacagaaaaactggaaactctaaaacgcagagcgcctctcctcctccaaaggaacgcagttcctcaccagcaacggaacaaagctggatggagaatgactttgacgagctgagagaagaaggcttcagacgatcaaattactctgagctacgggaggacattcaaaccaaaggcaaagaagttgaaaactttgaaaaaaatttagaagaatgtatgactagaataaccaatacagagaagtgcttaaaggagctgatggaggtgaaaaccaaggcttgagaactacgtgaagaatgcagaagcctcaggagccaatgcgatcaactggaagaaagggtatcagcaatggaagatgaaatgaatgaaatgaagcgagaagggaaggttagagaaaaaagaataaaaagaaatgagcaaaacctccaagaaatatgggactatgtgaaaagaccaaatctacatctgattggtgtacctgaaagtgatggggagaatggaaccaagttggaaaacactctgcaggatattatccagcagaacttccccaatctagcaaggcaggccaatgttcagattcaggaaatacagagaatgccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagcggatctctcggcagaaaccctacaagccagaacagagtgggggccaatattcaacattcttaaagacaagaattttcaacccagaatttcatatccagccaaactaagcttcataagtgaaggagaaataaaatacttcacagacaagcaaatgctgagagattttgtcaccactaggcctgccctaaaagagctcctgaaggaagcgctaaacatggaaaggaaaaaccggtaccagccgctgcaaaatcatgccaaaacgtaaagaccatcgagactaggaagaaactacatcaactaacgagcaaaatcaccagctaacatcataatgacaggatcaaattcacacataacaatattaactttaaatgtaaatggactaaatgctccaattaaaagacacagacgggcaaattggatcaagagtcaagacccatcagtgtgctgtattcaggaaacccatctcacatgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccaggttcataaagcaagtcctgagtgacctacaaagagacttagactcccacacattaataatggcagactatacattttttttcagcaccacaccacacctattccaaaattgaccacatagttggaagtaaagctctcctcagcaaatgtaaaagaacagaaattataacaaactatctctcagaccacagtgcaatcaaactagaactcaggattaagaatctcactcaaaaccgctcaactacatggaaactgaacaacctgctcctgaatgactactgggtacataatgaaatgaaggcagaaataaagatgttctttgaaaccaatgagaacaaagacacaacataccagaatctccgggacgcattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaaacccttcaaaaaatcaatgaatccaggagctggttttttgaaaggatcaacaaaattgatagaccactagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggataaattcctcaacacatacattctcccaagactaaaccaggaagaagttgaatctctgaatagaccaataacaggagctgaaattgtggcaataatcaatagtttaccaaccaaaaagagtccaggaccagatggattcacagctgaattctaccagaggtacaaggaggaactggtaccattccttctgaaactattccaatcaatagaaaaagagggaatcctccctaactcattttatgaggccagcatcattctgataccaaagccaggcagagacacaacaaaaaaagagaattttagaccaatatccttgatgaacattgatgcaaaaatcctcaataaaatactggcaaaacgaatccagcagcacatcaaaaagcttatccaacatgatcaagtgggcttcaaccctgggatgcaagtctggttcaatatatgcaaatcaataaatgtaatccagcatataaacagagccaaagacaaaaaccacaggattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaatcaggcaggagaaggaaataaagggtattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatgtacaaaaatcacaagcattcttatacaccaacaacagacaaacagccaaatcatgagtgaattcccattcacaattgcttcaaagataataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcatgaaatggccatactgcccaaggtaatttatagattcaatgccatccccatcaagctaccaatgactttcttcacagaattggaaaaaactactttaaagttcatatggaaccaaaaaagagcccgcatcaccaagtcactcctaagccaaaagaacaaagctggaggcatcacactacctgacttcaaactatactacaaggctacagtaaccaaaacagcatggtactggtaccaaaacagagatatagatcaatggaacagaacagagccctcagaaataacgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcatgggcaaggacttcatgtctaaaacaccaaaagcaatggcaacaaaagacaaaattgacaaatgggatctaattaaactaaagagcttctgcacagcaaaagaaactaccatcagagtgaacaggcaacctacaaaatgggagaaaatttttgcaacctactcatctgacaaagggctaatatccagaatctacaatgaactcaaagaaatttacaagaaaaaaacaaacaaccccatcaaaaagtgggcgaaggacatgaacagacacttctcaaaagaagacatttatgcagccaaaaaacacatgaaaaaatgctcatcatcactggccatcagggaaatgcaaatcaaaaccacaatgagataccatctcacaccagttagaatggcgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcgtgtcctttgtagcgacatggatgaaattggaaatcatcattctcagtaaactatcgcaagaacaaaaaaccaaacaccgcatattctcactcataggtgggaattgaacaatgagatcacatggacacaggaaggggaatatcacactctgcggactgtggtggggtggggggaggggggatggatagcattgggagatatacctaatgctagatgacgagttagtgggtgcagtgcaccagcatggcacatgtatacatatgtaactaacctgcacaatgtgcacatgtaccctaaaacttaaagtataataaaaaaaaaagaaaaagaaaaaaaaaagattgagaagcgggtggggcaagccatgagggggaaagaaagcagatgaacgaacactctttttacagaacaaatccctttcttatcagttcaaccatcaatctttagttttctgaacactgttgctatatgctcaaattgtccaaggtatgatgagggcatgaagcaagtagaagtcagagcccaagttttaaaaagttttactgttgtcagggaaacaagattcatgcacattaaaatattagagtacattctttttctgtttatgtacttatttccaacctcattcccccaaaggatttgtgattacttacaaaaatacacacaaaaaccaaatgataaaataaataaaaagtaaacgggcaggatataagtgggaaaataataaaactatggtcaagataaatacaggaatatacagtatgctgtccagactagaggtggactataagttttgaaatccttaagcacaggcagtaaatcgcactgggcgctctatgcagagccaactggtatgaatatggcagagcaatgagttgccaaacctagctgtccagaagtgtcacttattaaaggcttccaaaaactccataatgaacctgaattcctggggcaggcaggcagggaaggaatgctgggaatctgcatttttaatgtcgtcagcccaaacttgggaaccacaactgcagggatttggaaataggggttgaaaaagaactcaaaaaatcagattccaggaattacggtggttgtggatctgaagcagggcctctaaggttagatggagtttaaataggtggagatgatgatagaagacattcccagtagaagtgtgggctagagccaaatcacagaagcaggaaggagcctgaggccatgaaggagacagcatcatccctagtcaccctggagcagtagtaaggggacttaggacactaatttattgctcaacccgctcaattttgatcaaatcccaaaaataattaaagaggctatatacataataaatgagttatatacagaaatagagatggtaagaatgtatatatttgttatctattgctgtgtaacaagttaccacaaatttagtggcttagaataatacacatttattatctcacagtgtctatgaaccaggaatctgagcagagcttagctggaacctctactcagttctcacaaggctaaaatcaatgtgtcaagtgtcagacctcaggtgtctgggatctcatctgaggctctgggtcctctcccaagctcatgtggtttgaggaagaatttatttccttgcttgtggctgtaaagctcatgatgacttgcttcttcgaggccagcagcagaatctctgaggcttctagtttctgacctgtagataatcttttaaggagcttgcctgatgaggtcaggcccacccaagaaaatctcctgtttttattcactcaaagtcaactgattagggaccttaattatacctacaaaagtccttccacaattgccatataatgcagtctaatcacaaaagtgttatctgttatattctcaggttctgtcctcacttggggagggaatcgtacaatggggacctggatcttagtttccatcttaaaattctgctttgccacaaagtacaaagtaaagatgagagaaaaatgttgcaaaggtaaggtatatgaaccaacagaacattggtaattacacatgtcaatttggctctgagcttcccagcagttgaagtacaaaggagttatgacccagtgatttcttagtactctgatcagttcctagtactgacttatacaatatatttctcatgtctattagaaatcatgaaatacagcatcaaaataaagtgaaagatacaaaatgaagtcagatggaatttgatccaaaataactctttgccaagtatgggatatgttgaccctaccgatacaatgggaaattggcaatgacaagaaccaagttcattggggtgcttggtcaatatcaggtaccatgggctggtgattggggtccctataaaagaaatcagctgtgaagacataccaggagttgttccaaggcaaggggggaaactgaagtcacacatgaactgaagttacaagtcagaggtatctaggtgtggaggagatgagagcagaagttgaagcactgcatagctaccaaagaatcttgcagaaaggttaccctttctgcaaccttggaagtgttcttgttgtcttggtgttatttggccacctccctgtggaacaacttttccccgggacatcttaagggcatcacttgatctctgtcagagctgatcaaacatctctgctttgctttacaattctcataattagttctaagcattcggtagcatgaactgcttcaccctgtgttccattgggactctataatgaacctgcttttgcatgcaaaatgctgttctttcttccaccgactaacatattatctctttttatgacctcactcaattccaccactgtctcccttccttgaatggctctcgtctactcacagagtcagcactgtctgtgtaattgctctggcttaagtctggtcttctacaatctgactatctggtccaccacaatgtcctcttcattttctttcgtgttcaaatttccctggagctcactatattgcatatacaaggcttatagatcaaaaaagccttggaatcctccagctcacctgcctttgcaatgaagcccattccagcattgtctgaggacttccagggaaaagaatctttttcataagttctcaccttgtttctaaatgaacaaaagttcttcctaatattagaccacagtaacttctctttaacttccattcttagtcatagtgctgctttcttgagtaaattaaaataccacacttcctttcatatattgttcctgggagtataaattggtataatccccttgaaagactgttgggcattagatctgagatactctattattgctatgtgtagcaattacacaagcactcttaacatatatgtgtatatttgtttaccaagagacatgagagacatgtgccagcatattcataatagaactatgtgtcatggtccaaaattggaaaatatccaaatgcccatccatagtaggaagactatatggtggcagagtcacacaatggaatattatacaacaatgtgcataaagttataattaaacacagcaatacagatgaatcacacaaacataatttgaaggaaagaagccagacacaaaattacacaaaccgtatgattccaattagataaagtacacaaaaggccaaattaatctaagccactggaagtcagtatggtggttaccttagagaatgtgactgaaagggaatttgaggaaggcttctagggtgctggcaatatttcttgttttgaggattagtgatatgggtatattcagtttataaaaatttatcaagctttatacttaggtgcaattatctgtatgtattttatacttcaataaaaaaggttaaacattttcctcttccaaatgtcccaaataaatctaatttatttagccatttctaatatgatatggactgtagaatgttcacgatcctagccacctacttataaaaacttttcatttgtcaaacctctgatcattcatttggaacttaatcctactgattggtgtgtagtattctttaaacgccccacgtgggattaactccttctccccactatgttatgaaacccataaagataaatgttttcccctttgattttccagtagcatgtgtattcagtgtagattgtacactaagaaaatactcatcttcccttctcttccttagcaagtgcagatgaaagtggagattgaatttacataggacctatttgataaaccaattcaagaatctttcttttttatttcaatgaaagtttaatgctaatgtattcagtgaagccaagttttattttgcttattttgctctctgccctcaggctgattgaggagtgacctttgccttgatttatgacagacgtttgggtatggagagatggagactactattaagcagatccctctaaaagatctgagtaagtatttcttatttccattcctctcatcttcattattcataaattcttccaatgtctgaaacccttccttataattttctcttctcaagaaggaacatactcatttggacaatgagacaatgagaaagaagtcttcttattcctgtagttagtggtatcatccttcctgataagctcaatagagggtaaaataaatgagcaacagaatacaaaccacatgcctagcaatggagagaattctaggttctaaataatgaaatgaaaataatatttttggtgctgataatgctcctggccgatagcttgtctttccaaaacaaatatcataagagaaatctgcagacattcacatcatgaatgcggtttttctctctgcacacacactcatttgcacgcttggcacctggaatgcttggttggtacacagtttgctgaaatttcctttcccatttggcacaacttttcctagataacattcatgagcatcagtcacctccacaaatagcaaagagagaggccagcttcttggccacattcatattcctgccaccaggacacctttataaccatacttcagactacacaagcacagccctcgcctgcccaggttttctatgtataaaaagacatatgaacgaaagagagagagagataatgaaattatgagtctgcagattcttaccaagcctgttgaggaactatctctacaaaattgaagacatgtcagtcccttataagatcatacaaaacatagagggaaaatctaagaaagctactcatgcagaaactatttaatcaaaggagaaagacaattataacatctgttaatcttctgtagaggttataattagatgctttggagaaacaccctttcaagggtgatcctttaacatctgttgtgaggacacacagcattgtgcagtgacgaatcacctcggcactttgggaaaacaggggactactgggatcacagacactgccagggtccccaggctgcccttgcatgcagcccagccctgagcccactgccctgaggtgggggctttcctccttggtgctttgataattgcctgtgttgtgaatcaggctgcaatcattgtgtgactatgaataacaggatcacagcactggaaacggccttgagaccatctcatcttctcccccttcactttgcagatgggaacacttgatcctatgtcctttagctggctcatggcaggattttacaaatagaattgttcaatctctctgttcagattactctccactctaccatgctgcttgctccttttggtctccctttcgtttggcctgtaatgtggatgtgttctttgtttaatgagatgagcattataataaagtcctagggcatttgaagattatggagaggtggtctttttctctggtctctggttcattaagagacactgaccatggtcccttctttgctctggagaggaggaggaggacgagcagtagagataaatgaagatgaggagggagaataagagcaaaagggaggagaaaataggagaggtgagatgcaaatggtgtagagggaagaacgaagacagaagattgagaaataaggtggcatagacagagagatgtgaaagaggaagggagcagccagggaagatggtccaggactacagaaaaagggtattgaatgaagaccctatagaaggagtcacatcctccctacacccttctgactccgttacctgcttctactctacttcaaattagcagttctacacacacagaagaccacaggatttgacaattttgccaaacgaaatgcagagatgataaagccaggggcatcacataaacagatgcaatgtgctgagcaaaaaaaaaaaaaaaaaaaaaagcccatatggcaggaacataataaaagcactcatgacccagaagcggattgggggtgcacattgttctctgtagttgttttggagtggcaaatactcatttgtgccaaaatactgagtaaagggaactgttgacatttgacattaggattaaacaacttcctaaacctgggacacacagtgctgtcctcacctctctcattgccctaagacagtcactgaagtacaagggcctacgtcgtcctcaatgataagagccaataatgagaacagtattattaatatgtattaatagtattattaataacgtattaatactacttacatgtattgtgagtctattttggtacaggcacttgaggtagcttatctcatttattcttcacgatgaacctgtaagaaggtaatataatctaaatatgtggctcaaataattactgtgtaatctggaacatattaacctcttggtaccttggtttttgcatctaaaaatgggattaataataacgtctatctcagtggtctgttttaaggattatatgagacaatatgaatagaaagcacaatggggtcagacacatcatacacatttaataaatactgggcaaaatcgctgctgattttttaagaatctcacagcctagagtgcagtggtgcaatcagggcttactgcaacctggaactcttgggttcaagttatcctccaatctcagcttcctgagtagctgagactacaggtgcacatcaccatgcccaggtaagtttttaaaattgtttttttagagatggggtcttgttatgttggccaggctggtcttgaactcctggcctcaagtgatcctcccacatcagcctgagtcactgagattataagcgtgagcccctcacccagctactgttgaaattactacattttatggatggggaaatcatgcctgacaaggttaaataacttgcccaaagtcagtagagttcagaacagagatcagaacccagggatatccaaggataaatgccacatgggtaagagctgtagttataagccttccattatactgtctgcattaattgactccaaagatcaaatcctggtctaacgtaccatgatgtctcaggaaaagaatgtttcacagcatacagggctctagaaaatctctagcccaaagtaggaaacaaaaaggcacattactaagctcaagacatctatctgttcccactcctcttgtcttcatcaataagaagataaaagaaatccttgcccattttcttattcatttgctctcatacctatagagcccccattggacaaatgccatgaatactgattcttgtactatggggaataaagaggtactcacacacttattgaaagttaggtataaaacccaatgccaagctttgtgccccgagtccacaggcattttgactgcatgagatttgaatgccatcagatgaggtataaacatgaatattttcgtaagtataaaaatggagaagagaaagtactaatttaaaaatcagaaaacttgtgtatattcatctattcaccaaatatttgatggacgcctactgtgggccagccactgttctaggtcctaaggttacaatttcaaacaaaacagacacaggctctgcttttgtgaaacataacagcctagatggggagatgttcttaatcaaatagttgatgatatatttaattatacgggtgataagtgctatgaaaaacagagagatggagctacaagagtacatcacaagtaaagaaagccttcctcaggaagtgttctttaggctgagaagaagttgtacccaggaggatagagtggggagaagagaaccttccccagaaggagagatttgggtgaataagaggagctggaaacaagccagcaggtaggaagagaacagctctggactaccctgctcctccccaccactgtttccttgactggaaagtgggtgtgatggagaacatgacacgctctcagctctcggagtctagcttctctttgctgtgtccaaagtgagggcttactatagagtgagaagattcttgtccagctgcatagaatagaaaacccacttttgttgagagtaaggctcactgaaatgtaggcagcaagtataacttgtgcctaggtcaagagagccatcatctctctcagccatgttcaacagtcaatactgggttccccaaaggctcagatcccagggccccaactccaaaataaatgtcctagagagattttatgactaggcctccacagccctggtttggttgatggcttattaatgatctattctaattctccaatttcctcttaagaaaacaatgaaaatgaaaagttaagatatctaatttttccttatagaaataaataagatgcactttaaaataccattttcacagttttactgctatttatcaggaatcctaaaaacaagagcttctttaacagggtggctgtaactgttggcaattggcctgtatgtgaaattttacttagtttaacaaggccctctactggcaatctgcatgaacaccgtctccaaaggcaaagtttcacattattttaagtgaactgttttaactactctcaataacaaagtatctcacattcctgattctataattcaaggctcaaagaataagtggggagaaaatcaggaaggaaagaaataaatgtcattttgagcattcatttagtggttcataaaataacattacatgaggtatcatttgctttcctctgatgaagctatactacatgtcaaaggtactcagaaaggaaggatatttcttacactgaaatgtattgagtattcatgagactataaaaccaagttatgattgctatttaccaactacaataaaccagatcgtttctatttacccaaatatgagtaactggctgtaatgagaataaaagaaacattggaggcaggcatttaaaattgttgctgatatggcacaactaattattaacttatcctccttggcaactgacaaaaaaagaacatggtgacttgagaatataactactcacagaagatgaatgttttaaaaggagattatatttgacatatatgtcaacgggctgttggagcaactgggaaacttcagctatagggtcttagaaaactaagtaaatattaaaaatgaggcaataactttaggaaaaaatgttaacataaagatgtgatcatagtgatttgactcaacgtaaacaatatttgtaatcaaaacaaaaataagcactatgcatgtaattaaaactgcgatataattatattgaagaatagggatgctctgggaggtacaaaaagatatattataatctaccataataataaagaagtagtactttgacatacacacagaaacatatgatttaggaatattacataaaaacagctgaagaaaaaaaaaactcagaaatggggtagagagggtggcccaagagactgtaagattttatataaatatacacacacatatatatatacacatatagagaaacacatactcaatgtttatatatatgagcatgttagagctattgtttagtactaatattcatatatatacatagatatataaacaatttactattgttggattttctgatttatgagcatgtattactttgactttttaagttgctacaaaaccagttagcactgacaatggaaaccatttgagaaatgccttttgggctggcctggatcagttctatgtttctagattcaatttgccaaatgaagcaagttgcctttatggagcggtttgtcagacatgcgtctcgacagtaacacttgttcccacatttcagaactaacagctcttctttcaacaccgtaatatttatctgccatgttattattcccagtgtatgctccaaaatgggcttgggactctcctctttcctcttgaactcagtccactgggcttctacaatgcatccaaattctcctcaaaggaatcactaatccggtaaagttgatttctaaaaggagagatctggtttcttgccctgaaaataccaagattaatttatgtaactacggggaagtaccctgtgtaattgaggcttccaaactgacacgatacacttcattaggcaagtatgtattggggcattgtaaatgtgtgggtaatgttctatgtatctgagagatttattatttcatctataaaggaaggacaattgggaatccaaaattccaaaggcattaaaccctgtagagttagagaactggagaaaaagaaggctataaggtactttgtgcttaactgggtccatgacttgccagagtgttcagactaaacccttctggctatttaaatccactttcacaaaatgctaccatttccttaggttaccattttcagggaccaaccaaatggccaaacattatttccaattttttctttgtatctaatccctggattacactcttgaccaaactttactaggcctaccaaaacccacaccaagaatgtaaataatcttgatgtttaaccataaacttgggctactctacaaaaagattcaggtctggccgggcgcagtggctcacgcctgtaaccccagcactttgggtgaccgaagtgggcagatcacgaggtcaggctattgagaccatcctggccaacatggtgaaaccctgtctctactaaaaatacaaaaattagctgggtgtggtggcacatgcctgtaatcccagctacttgggaggctgaggcaggagaatagcttgaaccagggagtcagaggttgcagtgagtcgagatcatgccactgcactccagcctggtgacagagaaagactccataaaaaaaaaaaaaaaaaaaaaaaaaaaaaagattcagatctctgagattaaaggaaaaataaaaatagtaaaggactgcgcataggcgttagacactttggaaagactagaaaatgtgaattgccagtttgaatgggtggaagtattaatctgctatactgctctgccagtgcagtcaatcggggcagatgtgaatgaccaaaacgtcattgtgggtgaatgtgaggctcatgaagcctccatatccagaaagcggtaaaatgaaaggttaagagtatgcactgtggggttgagtgcagtgtctcatacctgtaatcccagcactttgggaggctgaggcagatggatcatttgaggtcaggagtttgagaccagcccggctaacatggtgaaaccctatctctactaaaaatacaaaaattatctgggtgtggtggcaggcacctgtaatcacagctaaccaggaggctgaagcaggagaatcacttgaacctgagaggcggaggttgcagtgagtggagatcgtgccattgcactccagcctaggcaacaagagtgaaactccatttcaaaaaaaaaaaaagtacgtgctgtgggttcaaatcctgcctctgcctcttatccacccatgtgacttgtgcacattacttaacctttctgagcatcagtatttttgcttggacaatgaatacaatgatcataataagatagcatgagcacagagcttgaaagtgtgcctggtatacagtaaccactcaatagtgattgatgttggaagaaaacattttaaatctgtttttattgtgcccatcaaccatgtatccatacatttttttcatttattgagaactcattgtgtgccaggtgctgagtttacaaactacacttaagattacaaatttgacaactcaaatttggcaacgactctatctcaaattcactagaatctagtggcagcagcggaaggtaaagaaatacttttaaaatggggctatgcagtgtaagcatcccaacagagtttagatagaataccatggggtgtgactgtttcttcatctgagagaagtaagaggggagacagagcagggaacgttgtcagatgaagccaaggaacgtggaaggatttcagaatgcaggaccgcagtcttctctcttaagtagggagggagacaccacctgagggaggagcacaggcaaagctgggactcaagagtgaagcaaggctcacaggtgccaccgtgggaaaggggtaggcacagggcaggagtcaagtggaaatgaaggcattcagtgagcagtattcatccgtctactcaacaagtaattccctaagggcagtgtcatgcatggtgctaagtttggggagtcagttggcaggtgtgccctcgtgagacacagaggctgaagaggggaacagaagcacagtgaaccaatgcggacggagttccatggtgcacagggacacctacctgcggtgactgggatgtgaaaagctgctcacaggacaggaggtgcatgcaagatatggaggataaactgagtgtgtggagaggtgctgcaggagtacaaaggtgcagatgtgctgaagaacatacaagcccagcatatttcagtaatagagagcagctcctggtagctaggccagtaattcccatcgaaatcatctgaggaactttttaaccatggctggatctgaatcccaccttagaggtcatgattcagtaagtctggggtgggacgtgggcatcagcaagataaataataactgtagctaatactcattagcacttaatgtatgcctagcattgtgcctattgttttagctacattaagatatctaatccttctccatcttcccatgaaggaggcactctcattatccacattttaaagaagagaaattgaaatagaaaagttaagtgaattaaccaggatcataaagccggcaagtggcagaagcaggacttgagcctgggcaggccagttccagagtccaagttttcagtcactgtgctgtgctgcatagtgaagaccctgattagccatcaggcccagaatccccaagacagctctaagtccacactgtggagtagagtgaaatgagccaggaaagacagccaggcatcacatcaagaatatccccgtcttcatggtcagaagtctggcatcaagggccttcaaccacagtgaagaagaatttaaagccaatcagcacagtaatgtggtaattttgccaaccaagtcctgaggcttgggtgtttgcaacaggaaaatggatatttaattcattcatttatttagcataatacattgaataactactctgtgcttagtgctgtagctataagaagtattatatagcaagcagcccttgctttcgacggaaagaggtatttaacaacatggcaaagagctccagatcccagggcaaaaaatggcacaagataccatgacagtcgaaacaagtgaatcaccacttggaccaggagagtccaggaaggccccccgcccctaggtaggaatgtcagggacaaggaaggctccagagagaagggtaatggacgggtgtatgcgatctagctgaatactggaaactgaggtccaggcttcagtgagagaatgaagtgggaaggaggaatcaatgaaaaagtgaagagaaggttccactggagagaggggcccaaaagaggaaaagcaaagcaagctgtggccataagaagaagtctgagacttggaagtaaagcacaaacactgagtatcagagttgggaatcacctcaggtatcccagcctgtacccagtgcaaaatgccttctgaactatttcaactgctgaggctgctccatttgcttttaggccattatctgtaaaataatcacagagttctctttggtttgctagtgaaaacaatgaggaacagacaccttaagaaatgtaacgagagccaaagacaaaacgggaatgttctctctttgccagaccaccttcatctgtacacctgcacatagccctgttcctacaagaaggcataggaaccgcgtgtgggtcccatttctttttcaatatttaagaacttgagaagtgggacacatgctggaatgaacacaggaagctcagtttctagttgtagctttgccaccatcttactgggtgctcttggacaatcacttctcttccttgtgccccaagttttcttctgtgaaaggataaactttgatgaatagtttgaaatctgttttagcagcaagtcccttattttaagcaaagaattgcaaagagcactgagctctaatacacaaaacatatctaagcctaatgtgttctgatggaaaaaaatggagctgacaaagaggcaggatgttacccaccttaggactccctggaaaacagtcaaatattttgaggccttttgacactggcttctcacaattctgagactagagacaaggaaaaggtagtgaaggctgtcaccatgtttctgggctggtgacagagcagctgaattcaggagcaagccaggctcctgagtgagtcatggggttcacatgcggagctaacaggctaacagccacttcttgccaatccgtgcagcgggctgggctgtcaggtctagagggcaggaatcagctgggatttgctactggttgcaagaggctgaactgcaggcactgaggagcagagctggtagcttgaaggacagaaagacaatttttcactgggctcttaagcagaactcccgggtggcaacagagaatagctcacgggccagccggtgcaggtgggataagaggttcctgtccaggctggcggcatacatgaagctcactcttcctatttaaatcccagagaatatctggagagttttaaagagccctgaggcaggcaaaagagaacatgtggattttgtataccgatctagctcagtgtcaaagtttgcctttttcagtagtacattaacttgggttccaactcagaagacaagtcagaacattgaacatttctccagatactcaatgtgaaaagaatccaaatagaaacagtttcaatttcaaaatattttttgatacatacacattcctgaggatgaatgagcctgtgtgtgtgtgtgtgtgtgtgtgtgtgtgtgtgtgtgtgtgtttggggagagagtgtaggtaggaggggacgagagaccataaacatcaacatccacacactagaaatccataaaccacagaaagaatcagagacaaaaagtgggttctccctgcagtgtaccagttcatgaaaaagtagccttcatagttgtctgctaaactttctagatcagcctaatagttttttggttggttgtatctctttaaaaaacaaaaacaaaacaaatgaaaaaccaaacctgacctccctgcagaggcaaatgaggattagccattcagtatctccttatcatctgcatcctggtatttgttctcagagacaaggggtcctctacccctaattccagtccactttagggccctatagttacttagaacaaacgcatacttgctgtgacagccgaaagagcctggagaaatatgtaaacatcatcatctcactttagaaggaaaacaagctgtataaataagaaaaactgttacaagagtttaaaaaaaaaatcccaacagtcttacttgtagttagctcttcagtcaacacatatcacagtcctggagacagacacaggaactacaactctctccagctaaaaatttcctcccgcggttggttatcctctgtttatttttgaagcattcaaaggccacgctaacagaacagactcggttttcctgaacatccacagcggctgggaagtcctgccgtgaatgcggagcaagtttgcggagacttgctccctgggctgcggctccgtagttgc

SEQ ID NO: 87 - DNA, 896661 bp, Homo sapiens; identical to SEQ ID NO: 86

SEQ ID NO: 88 - DNA, 1114033 bp, Homo sapiens
atgtgatagtgttggaatttaatcacaggtttacttaacttggattccattgtcttttatagagaaaaagcatatttatgaaattagtattttaatattgtttgcaactaatactgtatgagtttatggtttctggcatatcaagatgaacaaatataacaaaagtacatttaatggctacatctttaagtgtatgaatatagaggtctttaatgactagttaaatccagaaaaaagagagtcaacattcttcctctataatataaggatgggtcttcccttcaaatgcagccttctttactttcccacttaagcacgaaatggtgccgcatataatttttaaaatcaataaatcacagttgtattaagaaatattttattaacaaaacagtaaattccacttgcttagcatttccaataatggataaattggccttgcaacagaaaaacaaacaaacaaaaaaagaagaagaaaacccctttgatacccaatcacacaaagcactagaagggtagggttatgtggcctttctttgatgtcttagggattgaccacttcacacgttattgtagtatttgttcttttaaaaaaggcaacacattacatggataaaaaagaagcataatcaatcagaaaagttacagtctagagatgtaatcaaatttatgccaagtcgtgtgaaatcctcaatcaactgcaaactatgcagggaaccctgatatgtttggtatgaagatacttgggattcaagtcattttctctttctaactctgttcctctcttttctttttccattgaggaaaaaataatttttgctagagtttgtgtaagccaataatattagaaataattttgctgataataaactatatcaatcattgcatgtaactttaaaatttacgctggggagaaacattgaaatcaatcccaaacaacacatttcatagatatactgcttaaaattaccattattcaatttattttctattatattttagaatctttccagatggaaactggttcaagcttaatagataaaatagaaaagcaatcttaaaaaaaaaaacccttcaagctgtaaattagtagttttacacttcccttcttatttaactggctttccctgagtaagactgaatgagacgggggaaaagaaaagactcgtgaattatttaatgtggcaaattaaaaaaaatgaaaatctagaaaagaagcaatggatattaaattttcattttataccttctactttctgggtcataaaaagccactaaatttctttgtacacaacaattacttggcaaccatagatagtggtgatttgctatgaattatacatatttctaaggtgctgtatgtctgaaatccaggccacttcttggcttttttttcatcaactaaagtatcacaaaagatgttttgcattttttgcctttgctgattaaagctaattggaaagatattcttctcttctacaaaattttttatcgttcttttagaaggtattcaagtaatgcaaccaatttttcctgaaacatcaacttgcaatgtaataatgcattttttgcactaccttctcatattagtaatttattgctgtgaacatcattgaataatatgcaaaacaagtgtataatctatacttttccactacttaatgtgttaaactaaaactatatttaatgatatatatgtaaaaccagaaaagttaaaacatagtcaataattaacagagaatgattttttaagtgggtagtaatacagaatcaaaaattactgaaaaatactttcttagtcgagagaaagtgtttactttccagaaatgttcatcatgcacatcagattcagagatatatatattattttattagaaagaaagttttcaattgcagcagccagagttaaggtgtagattaaccaattttgcttccataacctgcccacataatggttcttattcatgcagcagtatatcagtgatattctatttgataaggaaaggttcatttctttagggactaaaatcttcttaaggttacctgggagcaagatctcaatgaagcaaatcaccccatttgtcatcaataccttggcacaaccctcttccttcctgcttttcaatttgtcaataaatatttgctactgtatgcacgtttggatcttccagcatatctgatggattgctgtggattcgtgtgtgtgtgtgtgtgtgtgtgtgtgtgtgtgtgtgtgtgtgtgtgaaaatagtgaatgtatgtgggaatgtgagtatttcagggagaaaagattataagatacatatgtatatatgtgactttctaattcacacctttcatacaagtactaaaacttaattgcaacagaatgaaggctgtacatataagaaaagaagtagctgagtctttgtatatacattcatacatatcttccttagaataaacactacactgtaatttctttaaaaaataaaagtaattgtggcaatttataatggtggcaaaaaaaaagaaaaacccaactgaaataattgttgctctgatgtcataaaactccctatacttagcaacacttataacattgaatttaccaaaaatggctgaagagcagagatatattttgcattttctatacaacaggctataaaacgtcacttatcacagtccagaaagcacacagagatggattttatataaacatatgtaataacataataagcgtgcatgaaaatttcccaatgattgcatctatgccctcttgtttttgttttgaaattttgtgtgaaaacgtgccttatatttcacatttttgaaaataaggcctccatacttttttttcctctctcacaaccagaaaggggctttttgaatgtgttcctacacaagtcttcaaaaaagccagcactttgtttcaaatgcaagttccaaccactgctccagttgcaccaggcggcaaactcttaaaggtttgcaggttgagtcactcaaaaggacagtcttctctggcaattggactgacttctcaggaaagcgctagcactttggctaaatccaggatcataggtagcttcttttttgtgttatgttttgtgttggtttttgtgttgtgccttgatgctgtagtactcctttgctttatgaatgcgtgcggtcatcactgtcttttagaaatgttccagcaacataaagacaagcagagtaaatgaaaacactgtggatgttagggaatttattggcccctgttttttgttttttgtttttcttttttgagaaacaagagcatgagatacttgtttttattttttaaaaagtctttccttcctgattgcattccctgtcttcttttgtatgtgcttcataaaaaggaaagtaaataagtttatattatgtctcagataaaatgaagactatttctatacaagtgtccatttaagatcttgggatcagacataatactctttatccttgtttttcttatttttgttggagcttttcgcactgctgggttgtttctcctttacaacagccccattggactgtgctgagttactgatgtagtttcgactctcgtccacatggtatgagccttcatcccggtttctgtacttgtacatggcatagaggaggataaggatgcacagggcggcagcggctactatcccaacgaccatacccgtggtgctgctggactcccggatcacttctgctgagcctggatacggctctctgccgcctgctcgggttgggttggctatagaaaagaggatgagaacaaacacaaagtgatcattgagttcactgaataccagagagctatattaacatttattatctaattctaacagcacctatgctttaggaaaggtatgctattgataaatgtagccatccctttgcctcatggttactaaaaactagggactgtgatttaaagttctctgggagatttgttgctgtgtcttctttcttcacaaatcaattttgttcacagagtttggtaagcattgtcccaaataaactccaattagctctaaagggccatgtgggtgacttaagtaaaaaaaacccacaaacccagcataaagaaaagcagaacagccctaccctataatactagagggaatcataagaatcaaataggtgttgctctagaacataggtctaactctagactgaatcaggacaactaaatttaggattactttagaaatcatattccccttgtattttaaagaatacagtattgaacaataagataatccatacattttaactgtctgctttttaaagtataactttagttacatttttataaataaaaatagactaatttccattttgttggagattcatttgtttacataagtatgtgtgtattttattaattgattggggagctcccaagatgaactttggaggagaaagtaataaaatattctttctcagttttaaatacagtctagattgattttttggtcaaaactctgaactacctaatagattagataataatagaaggctggctagtctagttttattcaactgacaaaacccttcttcagtcttcccaaagtataaataaggctctttcttggatgagaccaatggattttggggtgcctacgtcttcttgaaggcctggtcaggcactgaaattgatgattgatggggaagaatggacctgagatttaattggtagatatgaggagaaggggcagctcttttcccctatatataataaacttttttgatataaaaggatagaaactgtagcgagagaagaagattctatcctactctgactgtaggtcattttttccttgtgaattgtgttttctgtttttccctgaatctctatcctctcgcttgtcttacataaaaatattacttttcagatgtaatgtattaaaaatgctacaactttcaaaacactattctttgccaattatgtataatgaacaaataatctcatgattccatatatattagataagaatgtgtgtgtatgagtgtgtgttcatgtatatgtaagaactgaaaactcaagaagactaaaattgtgcttttatttcgctactactaaacatcatttagtaattaattttaatatttctgcaaaagttcttgttaattactgggaatcattttaccaaacatatggctctatactgctttgtaattccattttcaaatatcaccaatatttcttttgcctaaacgtgtgtgtgtgtgtgtttttctgtgattttcttttccttcctcaaataaagccttaacaaatacagccatttccaaagtagtagctcttagtctcaaagtagcaataagctatgttctggtgctacaaaatgtagcaggtaaaactttttatgctgaatgtgtcattgcttgttttacaaaagcccacggagtgtggctgaataaaaagctttggtgttgcttctgtggacaaggtgaaaggagacaaagactataatccacagtatttgattacaggaattaatttcctctcatgaagaatagaatctactgcagtaactctgtcactacctgacaaaccaaaggcagcactttttcttttaaatacagtcatctttgccaaagtgtgccaattaactcagctgctttcactaaatgaaaactttcattttacagagcattcttttactatggtgtctcaagagctaaaaagggaattttgtttaaatgttacctaaatcattttttccagcctgatggaatgctttcattttaaacacattttcacaattacctcacttttactctgtctgccagaaaggaatagggagaatggagataacatttgaatcatttagcttatgacagtaaaatttgagaattttaatggagtggagggtttatattttgtatactaagaatagacatgtatttttttcaataaggaattgatatcgtaaatggactatcttatcaaaaaaattttatttttatctgctaaaatatttctgagaggttttcaaaacaactatgcacatagcatgataacagcaactttgtgttaaaataagaatgaggtcacaaagaccataacaaagcctgaaacacttcaactgtgccatatgcatttgaaaacatctcctgtttaaggaaaacactttcttttttgcaacactagccaaattgttgcttaagtcatatgaggcctaaaaatatctctacacaaaacccagatgtaaatcccagatgtaaaaattctaaatatcatgtttcttaaaaatataacctagaaaatctctaccaaaattaaaatctaaacccaataaacatgttatctttcttttccccagattcacattaaaattttaataaccatcatagcagatattattataggtatgttcggaataggtagttactccaatatctaactgattaattaatattctttttctatttatgcttcaaatctgaaggctaagtgaaatttttcttaacttttcttctgagactagaaatatttatgtgttggtcgggtgtggtggctcacatctgtaatcccagcactttgggaggccgaggcgagtggatcacgaggtcaagagatgcagaccattttggccaacatggtgaaaccctgaaatacaaaaattagctgggcatggtggcatgcacctgtagtcccagttacttgggggattgaggcaggagaattgcttgaacccgggaggcagaggttgcagtgagctgcgatcgcacactacactccagcctggcaacagagcgagacactgcctcaaccaaaaaaaaaaaaaaaaagaaagaaagaaatatttatgtattaatgggacatctctcccagatatgcaataacaggccaaagagatttaaatatattcatgaattataaatgtggcttctcttattgtcgctaatgctttattttgatgatcactgagaaatctctgatgaaattttatattaatgtaaatgtagagaatagtatcaatgactaatatggttaaatgtctttttatataatttgttcaaaatttatataaaaggtaaatgcagtcatctcatccatttactaaaatgtgaaaaaaagagaaacataattaatttgtatatttcatggatttaagaattttgcattccctctacactatataataaactaaaataagacatttttaaaaaattaaagcaatctgcaacatgtttttctcttagcagtgctgaaatgtgaataatgtaattaattaaaatttactttcatccttttctttctttgtcccagcacgtgacaaagaaacaagtgaaagagaataacttgttaaaaaagatttaacttgttaaaaaaagcaagtaaaagagaataagggagggggagctaaaataatggcatacacacaaataagcttaagtctttaagtcttgaatcttcaaagattaactccgacgtgtaggtaaaattaagccgatgtagccagttcattatattgggcccaggggcataaggaactcggttcaatggaaaacttcagtaggactgacagtggtctactacaagcaaggagagcaagaatgcacaccttcatcacaatacaaaggcttttgacttttgctggcatttttaacctataaatgatttggaagctaatgattattctagcaaggaaatagagcagtacaacagttatgacccatttcatatttatattcacttctttctcacttctgagattcatttagccaaatggctatagaaaaatccctgggactcttgcacttataaagcatgttaccttaaaggaccactgaaaagtagtttttaatccttcctctctcttctagcatttggtaagatacggtggtctctagaagttttccacatggtctgctttgtccctgtagatttatcaagaatcctatgaatcttcttgttttttgttgtctaatatgtattgtggtaacttcggtaaacacgagctatcaaatgtttggacagttagtaacctatttctgcactatgctctaaatcaatttgttcatatctgatgataattcagatgataattcattgtggaaaatgaacagttactactaaaggcatattctagtgccttgtcacatagaaaaaataaatgcaactgttgctctccattaaaaagtaaaaaaaaatctttaagattttaatttgtcttttgctgagatagttattttaaacaacaacaggaaaggaaatcgccctatgtattatttatttatttttgatagtctttgatacagtatctgtgaaagaacatcatttcctcaaattagaacaaatttagatccaattaagaaacacatggggaaaatatgtttgagacacattagacttcagtacagaccagagagggctgtcagtgcaggcttcatctcttaccagcttcttgcaccctctgttgcttcctccattctcctctgtatttctcctcccacttacccttctttattgcctctgtgccttgctcttccagctcctgaattatccttgtaggggccctccccacccccaggtaaatgaagaaggtcaggccagcaggggccaggactttttgcctcatgggttagcatattactcaggaaggtgttcaataaaccacaaaatttattttcaagttctgaatttcaaaacacaatgtaaaataattcttactggcacaaatgtctaagtgtgactatttcaccagaacaggttttgtgtttcatattggcatgattacttttaaatataactttctaaatttgtttgcaaataaaattgtatggtttggcaaaacaaataatatttgatcactaatttaaaagacttttgtgatgcatctggtgatatgatgggggcacattaagccattaaactttgcattgtatttatcagtttgcattgtttgattatatctaatcacaccttagcatatgcaaacagaagttaaagcttgcaattacttagtacaatgattcacaactgaagtgctaaaataactaagcaatttgaaagatagatacatttttgaatgttaataaatttttccaaggagatttccctttgcaatggtgacatccttcatttttctttttgaaattggaaacagcaatcaattattgtcattaaagaaaactgctcttgatctatgtttttgcaactctgcatgataaatggtgtttaaaatcctaattcctgatatagaatggggtttggtgggtggtgggaccttatctttctattgacaagttcaccaaggcattagcatgccatcagatggtctttttatcactcaaattgtcatttttatgaaattattttgtatacttgaatgagctgttcttccactgtaatcttatatatatattttggttccaaagttaactttcaaggtaagtttgtagtttctaggtaatttttcgggctggttttatttcttcagtatagactgttaatgtatgtgtatgtcgtcaactatgaacctggcacaccaaggataaagtaagagtatcattataacctgatgacaatggaaattcagcttttgagctttgagaaaaagattgtaagaaactaccaatcttaggaaataataaagaaaaaaacatgctagtggttaaaaaaaaaaacataggctatatatttaagatcaggaggggaccataagggatcattaaactccataatgcccagcacgcatcattctgctaaccagaattgttagatgtcctgtcttgcaatgatccttaaaaaaaaaaaaaactcttggcaagatgcatttactgaatttcttctcactaagagtttctgaccagtctttctggttttctcataaattaagcttaaagtaatagattttaaatttctgtctccaccccacctaggaaagagttgcctaaaatgatctcattagaccagagttctatactgtgtctaatagatgtggaagttattataattctaggctagacttgaaagtgattttggatttatagggggaagatttgacttttccaatactcagtttcattaatactgtgaaaagaaaattggaattgtagcctcctggggtgtttgtgaattgagattagcacacttttttcccccatttgaaaaaaaacaactcaaagtttattactttttcccatttttttgcttcaatacagtgtaggccagaagaaacaattatgatgcaatcattcacaagaagccatgtttaaatactacatttgtaggaaagcagggacacaatgatttatatgacatgcattaatttcgactcatgcggtggttttgtaagaagtgagggatgctgactgtttcaaattccttcccttctccctcccaccaattccacccatgcctgcacattctgaagtacacttacggaggtcagacaagtcttgagagaggacatgtctgacacatcttagcccttccccaatacatcggagatttagaaagaacttggaaatcaataaacctttgctacctgcctggctgctgtctccgatattttcctctgcttctttcaaaaccaccaaagcatgcatttgaagggcagttaaggggccaccactctgatattgagacgttcattatcttctccagagatctaggtattgaatgggaagggatgctagacacggaaaaactcatcatgtgcctgcatgatggagaaacccaactaggacaggctgctacctcatatggtaccacatcgaacagaagagacaatggatgtccacactctgtatgaccttggtgacactgaagacaaataaacagaggaacatgcacaatctccctcatctccaggggaagccataggatcatggtatttacaaatcttattcttcaattattcactatgttgtaaactatatgtccacagcttagtcatctataagcttcatagactttttacatagtcattgtatccttgtggtttgcatctattatggtgcttactccagcaccatggtccttactgttcccatggccattcatagtctgttcacagctacctactccaatttgtcttccatatttgtcaaaggaagttagagccataatattattgctgtccccaactcctcacataccaaaaagagttcaacctttatgccttgctcatataaccttttatctcctgcctgtttaaatagtacttatttctcgaagcttggctcaaatgtcccatcttttatgattttttttctctaagaaaatcccctccttctatcaacgagtatataatgagctatagttaacattccagggactatatgaggtcctgagggtataggagataacgaaacaaacttgatgtatatgtcctcatggaccttaaaatatagtgaggcagagaggcatacaagaaggaatcacacagttaaagtaacagctgggatatgcatgatgaaggaaaactgtaggtaccatgcaggagtaggacaaaggtttctgattgcaactgcagaatcagatctttctgaattagtgacacttatgataaaaatgagtagagagtcgtcaagtgaaagtgggtagagaagtctacgaaaaacatgtcgaatgaccttgaggaaacaaagtttacttttcaggaattaaacaacagttagagtggttgtagcacagtgagatttaagggagagtgagaagaaatttcaaggtggacatgaaatttatcacagagactgtagactatggaataaagtcataataaaaagatgagcgtatttaaccccataaataacaattttatgtggcaaaagccataatatcattaacaaaatgaaaatgacaaaggagggaaatatctgtagtacatatgacggaccaagagtaaatacctctaaaatacagagtgtgtgtcaactgataggaaaaaagacaaacaacctaacagaagtatggagaaaactacacacaagcaagtggagaagagatctcaatgctggtgagaatattcttaataattatttgattgttattagaaagtaatccaataacatctattaaattttttaaaataaataaattctctcaaccgtatatcacatcacaaattttaacattaattctatactattgtaaaatctcacttaaatgtttcatccaatagttttgtcttttttcaactagactgttggtcctttgacagtttcctgtgactctgtttctctttcttattagttctctcaccttccaaactctaatgaagattgaacacactggctgaaaactgcatgttttatgtatagttagatgaaagcttttgtaacttgataaattttcaagggtaaactaggttgaatctaatcattaagaaagtgtgaaagtgtgaaagccaagaactgtgtggctcacacctgcagtcgcagcactttgagaggctgaagccaggtgttcaagaccagcctgggaaaaagaacaagatactgtctctagaaaaaattaaaacaaatattagttgggcatagtggtgcacacctgtagtcctagctactcgagtccgaggtgggaggaccatttgagcccaggagtttaagaatagagtgagccacgatcatgtcactgccctccagcctgggagacagagcaagaaagtgagagacctttgattttaaagttttgagtaaaggtgctaagcaagggggttgaacactgacattaacatctcatatttctttaactcactacttctctaaccctcaacctttgtaatatctgcagtaaaaacgataaatgtaatatttacttcattaaatcagaaatcacttcttctgtgctttggagaattgggatcaatatacaataatgaaaatactgcatttgctttccctatgcttcaaggtaatatgtcacttaatcccaatgactaaagtcactaagctatttaaagttaactgagtcatcagtttgattcatttggatgccttatttacatcaacatcatctgacacccacagtactgcaaatagttgacagctaacttgagctcttttttcaattcagagtagttgtagaaatttctagggtgcttttcagtcctgttgctattggaattgaaaagggtctctttactcaggcccaactttccataattgtcaagcagaagaaagccatataggcaataattgagaaaatcagtttcaaaactagggaccccagagagtctgtatatgtttttcctcaaaatgtattacattccagaaaaatgcaagaagagttatattttgaaatgtggatgatactccttattaactgatttcaactcaactgagcttcttgataccaaaatagcttctcttcctgggagctcattgactacaacacccaaaaatatatacatccagaaatcacttttcttaagatccatttccttttttatatatagataattgaataatctatctttacaaaataatgagatttattccacagaattcttaaggcctgaaactagaaatttttggaaaacctggtttatagtaagacaaaaatggcaacattatagctagagtaatgaggagtatgtgtgtgcatgtgtgtgaatgtgtgtgcatgtgaatattgcagcattccttccaattctctctcagaagttgctgagtttgctgggcatggtaattcatgcctgtaatcccagtgctttgggaggctgagagaggagtattgcttgaagccaagagttccagactagcctgggcaacaaagggaggagactctgtctctacagaaaatgtaaaaaaattagcctggcatggtggcgcatgcctgtagtctcagcttctggggaggctgaggtgggaggatcacttgagcccagcagtttgggggtgcagtgagccataactgcagcactacactcctgctgggcaatagagaacccaattaaagaaaatgctgaagtcattcttcttatcctttcctttccttttcgctttccttttccttttcccctttcacctttctttctcctttctcctttcctttccttcctcctttccaaattaataggtaaagccaagctattaaatagttccaggaaacctttagcaataacttgggggtaaacttacttaactaagtaatcaaaaccctcatcaaaaccttctttcttacattcttccatatattttaacattactcaattgtcaacttatgcttaacagagctactatgacttccctgtaacatctatattttgtttcttattttatgtagttaacagctattatttttactattattatatggtaattgctgtgctatacattttacacataaatttcatctaatttatttctcataacactatgtggtgtaggtattatcattacaggaaagaaaactaagtctcaaagagcttagcctatttagactttataaatggcacagccaaaattcaaactcaggtctgtctatggctactaatattttatatactcagtgtgtctgcatttatcactgtggatcaatttgttattgcttctgattttattcctgtgttaagtgtaaaaacacttagcactttaggtgtattttctttttttgtttgtttatttttgtttttgtttttgtttgagacagagtcttgctctgtcgcccaggctggagcacagtggcgcggtctcagctcactgcaagctctgcctcccagattcacgccattctcctgcctcagcctcccaagtagctgggactacacgcacctgccaccacgcccggctaattttttgaatttttggtagagaaggggtttcaccgtgttagccaggatggtctcgatctcctgatctcatgatccgcccgcctcggcctcccaaagtgctgggattacaggtgtgagccactgcacccgggctttaggtatattttctaagcagttgcccagttctagcccttccagccacattcctcttcacctgctgccaactctctgtcctttgctgtgggagttaacattcccacagaatcttagaaaagcagtgaagagtggtaaaaagaatatcgaattatgcattaggttctagtctaggtcctgtccttaactttttgagtgacagtttgcagttcattatcctctgctaacattcctttatcagaaaccatgataatgacacataaattatttatatcccaggggttactgtgggcatcagatcaggtagggcattcagtatgaaagtatctgaggaggatgaggactttgtaaaaacagtgattatctgattgttttctctacatcttccacacagaaggtactgaatcagcagctgtcccaacaattatacagttttgcaatatgcactgcacacagtgtctcaatcagctgtggcagtgaccatcaaggacattatctccccgggagtagttgtatttgaggacttccctttcatgaaaagaggccttgtgaattcaggtggcaaaaatggtcctttgcattgtagggcatgttgtttcaggccattaactgtggtgctgcatgtggagcttgtttctgtttttctgtgagacattctatctttaatggatcagtgctctctggctcctatggttggagtgaattacatttctctctctttcaaaattttattatgatattttatgttttaggtgtcataaaatcaatcatctaagactattctttggtaataaatagctgacagcaaggcttattatgttggtaaaaactcctttgattaggtttcattgtttctttctaaaattgttaagtcaattttcccccacttccttccctgctctggaattgcacagtgtactccggatgaaatccaaaggagactttccactgcagaggtgcatgctgggtcctaggtgcacccacccctccaccagggtgcccgcacagcatctatataaacctgagtcattctgtgtaatggggcagtgtacaattttcctgatttagaattgggtctctttgctttgggtgatcatctttatattgctgtcatgaggctatttctgtctcaattttcttttgttgggaaaaagatcagattctttttggtgaaaatgcaatagctaaggtgaaagattagataacttcccctctgagcccattagagggaagtgtgtcaagtctagcattaggaaatacgaaagacaaggcatccatcatggtggggaggctgtgtgggtaggtgtgcctggtaagtcatgctgctgggagtattcctgagtgtcttaggaaggaagcaggaaagttaatcatttcttctctcgaaagcactctccctttctctctctctctctttttgtttagtataaaaagcccaatttttttccctccaaaaataaagtaagaagagcagatgatacgtgccctcctcctaccataggaacctaaatttatccagctaaagcactgctcctgtcttagtggtcactgagaaaagttttatgctgatagaatttagaaatactttgaaaaacttgctagatgctgaagtatccatcattaacatttccctttcttgtttggggatatttccatttatgatatggtttactatttagttagtttgctactactactaataaaagctaatttatgttatcaaagctttcctgtggtagactatgttaagtgctttagatgcattgtctcatttttatcagtacagcaatgtcatgagtattgaacattattcctttcattttgcagatgtaaaaagctgagtacacagagattcaatgacttgcctctaattacacagtaggtggccaaattgagatttgaacacaggcattgggatttctcaagtttactcaataaaacaaaatattttagtgtgctcttagatgtgacaacgtcagtatttttctttctcctatttttttttaatgtaattaatggcctctggctatactggcatctttaatacaccatttttaacctggaaatgtaaagtattctggtctttgctattatattgccagtgtcaggcttcttataacattttgtttatgagtaaggagtaactcatgatgagagtgatctaatcgacaagttactgtgttgagatgagagctgaaggctaaagccaaatgtagcatttgctgccccttggagcatatgtgccaacaatgaaagcatattggctcctcatggaggcagcatgtcctctagattggaattcagaatatgcttgctggcttacctctgatatcatctgagcaaatgtaattaatgaggtaccaagagaacgccacaggaagccaatttcattatcaaaacaggtatttgacacaaattacaagacaacgtgactttatccttcctggatttcatgttttcataagaggtaaacttaccttatatttttctaaacctgtgctacattcctcccttcaaggtggttaaatatttcagagcatggatgtgcatcttgttatcttcttccaaagctcaacaggacatgtgccatactgttaaaaggctattatattttagcatcttccaataaaaaattgtgatgtgaaaccgattattaatgctctaaggctggatacatacaggctgcctaaaaacttatgctgtactcactactgaacagagttttctgttgcttattgtaggaggtttctgtatcagcagccatctattttttacagacttcaagtaaatgcttaatctcacttagcaaactcacttatatgctaagtaattattataagtggccaatcatatgttagttaaaacattttaacagaacccactctgtctaatacctaaagagactgtgctgattttttactcagatcaaatgcataatgccttatgagcgacctcactacaaggcagaataatgcctccattggcacataaccagtgctagtagcagtgggtcctccacctgtcattggatgtgtgataattatttgttaaacccttagtatgtggtatgttccagacactctgccaagcattgtgtatgaatcctctttttccaatctcataattaaccgtattctccccattttacagactaggaaactgagcatcaaaactactaagtaaatttcccaagaccaggaaagggctgcgtctcaaattagttctatataattccaaagtccttgccataactaatattcatttctggtggcatgtcacagttcttttaaaatgttgttaagagcttttctaaagtgtagcaaccattatattgttaaaaaaaaaaaaaagttcaaacctcagaaaagggtcaaaatagttcaattaaatacaaattgctatattctaaaaaacaaaacaaaaaacatatgtacacacacacacacacacacacacatatgaaataccttttgcttgtgattttgttttctgctgaactcctagtagaaactaattttgttgaataaaaactggttgctgggaaagttgatgtcaagttgaccaaacaaagataggcttcttcctgcctctgggcccctggccttccatttcttagggcatttgtaatttcaaatactttatctgtccctttgatgtgtaaatatggaggacttgggagccatctcttcgtaatataaacatcagagaagatagcgcccctatctcctaatttctgtggaaagggtgggagcctaactttagtgggctccatgctccaaactgtaaaactatccccctgtcatgaaaacatgagatagtttgtttacatttcctttgggtgaagcccatttgcaagcacagttggtcccaaatccatccatcccagcacttaaataccctccagccttttttgtttgtttgttttcagtgagttgccctcgggctgaaatctggcccacctctcctattgcaatagccttgactaaatcttccttgcctgtttaactttgttcaatataatttttattctgacattactgccttcagaaaagcaggggaaaagtgagtaaaaatgatgtgtgataaatctcttctactttaaccatgtactacttatttttattccagtgttctggacaattaaatttatatggaaaaaacatttcctacaccagcacgttgcacactgaaacccagctagcacatcagtttccaactccagctgccccatcccgcacctgaatgatgagctgggccctcagcgctgattctagcctggtacacaggagatgctctcgatgttccctcaaatggaacactcattgctactgtttttctggctgcagctcaaaatcctccattttgacagcaatgtgttggctattacggactaattaaagtcacttttgaataattacataataaataacacacatttaaatgtagaacaaaattattttctaatcaagctctaaaaatatgacccagcaagacagtccttgaaatgattgtgatgacttatttaatgaaaaggtgcaccttgttcaatatacatatctttattcctaatgtgtttaatggtatcaattgaatagaaatcccttgaccttttctcaaaatagcacactgaaaaaccactgaaaattgcatggtaattgcaacaaatttagcttaatagtaatacatgtaaagaatatgacatgaaattatttaaatgaacttttgaaaaatcgattctatatttgtgaggtgcctgaattttagaggaaaaaccttctgtgttccaagaaactataagcccaccttttctaaactagagaatacaccagctctctcatattacatgacataacttaatctctctgaatctctttagctatgaaaatgcttcatagtttcataaaataatgagatagaataatgtttgtaaaggactaagaacaatgatggagcgcagaataaatcttcaccaaatactagttattattgctatttatcattgcttatgtaatctgaaccttgatcaacatgattcctctgataggcaatcaacagttgtcttttgagtggttgtactgatgacctcacctcctgtgttccagctaaagagatgccacaaaaatgggtgatccttttcttcccccaatgactaatgagatattttattattcaatggaactcttcttttcctagttttacaaaagtttaattgatttgagagtggcctaatatcccattagctatccatcccctaaccactcacagagaattgacgtattattcttagcactgtaaatctaacaggaaattgtccttcctaaacagggctccagaaaacaggaggcaggtctggttccctttgtaacaaatgataaattagagttatttattagggagctactacagcaaagagggtctttatcttcatttaggatcttgaatatcaacataaaactcacctttttaaaacttcttcaggagttttcagaaagggttctatttggaagagggcccccaaactaagagatactgacatgattaaagaccttcttggaacttaagtggttttgcagtgttgccattttgtcaatttactaagtggatctaaaatgtaaaatttcaaagacattttataaaaacttatatttgtgtgaaaaacaaagtcttggaaaatatgtgcgtgtgtgtataaaaataacaaatactaataacaggaaacactcatatagcacttattttgagcaaaacattttttctataacatacttttcatatattaactccagcaatcacatagcaataactatgctggagcaataactccagcaatcacaatttttttctctaggctgagaaaaatcacggaagctgtaaacgttttttgagaaaaattatgaaaaaaatgttatctatctctcatgtgtctacgcttcttaaactgggcactttaggacaacactggcctgtaacattgttaccaatagctggttcaggtttctacctgttcactaagagctggggttcaattagccctcctccatcacatagccaacattttgtattctgaagccatccttttgtattctgaaactgatcatatcaatgtgaagttatcatccaatgctaactgtgcaggacagtgtggctaaaatcaagtataattgagttccatgtgttcccacccaggatgttgaccctgatctagttttaacatgcacagttcccatcaggaggcctgagtggtttcatcagttgcccaccaattttcagccaggaaaagtaacagcattatgtaaaagggaaaatagcttggaatattctttttgtataactgaattgggggaaaaagccaccatttatgttctacattatgccagacattgcaataaatgtcttcaatatattaattaatatagaactgaaggtataaactttctatttttgctcccagagcttagcagagcagtaggtatatagtgacactcaatacctgatcaatgttgaagctgataacccaccaaatatataacttccctgttcattaagagttctgaatggaaccacaggtaattccaatttatcaaacatttgataaaaggaataatttactagtactcaagatgatgctagatttttcctgtttcttccattaacagctttaggaaggtacctaaataaggaacataggacattttcagagaaaaagccattttttgaaggtgggggagggtcagagtgattagaaaactcatgagtaaatacttagggagagtgaggtactcagaagatttgggcaacgcatctataaaggtaatggtgcatctccttacaaagatttgctctcacttgcccaaggactagcaaatgtgcatagaagatacatctgtttcagaatatttacctcaatatgttagttttataaaaagccagtatcccaaaatatagcctaatatgtgaaataatttttatttaagtatttctaacatctaatagcagcagctagaattatccaatgtctaataacagcagcagctacaattattgttatattattttatgtttgcattcaagatggattgcaagcaggaaaaagaaatttaagaaaaccagtacattaggaaacaatgacctgcaggaggggcagcccatgatgaaacattattcagacttaaacaggattcaaaacaaaaacaaacagaaaaacacaacccatattccaagaaaaaagttggaaaataggaaaacatcatataaactaagaatttcattagaagctatcacataaataaaaccaatttctgcccaaagagccaccttcatatgaagcattaaagacaggcttgagaaaaaaagtaatagggaggtggacagaaaaagctaatgtagaaagagatttaacatcagaaatcgaaagtgaaacaatttatggcatatattatcaagaccgggggagataagatcagaggacaggtttacagtgaatgatcccattaacacaaaataatctgaagttcttgttttaacaggaattgatgaattgaaaactgaagagtgaggagggacaaactgaaagagaggagaaaaagttaaactaggcttggtacaagagtgttaaagtagctgtcgttagatagaatcagtagctggtgtgttttgtattttgggtaacagactttggtgcagtagaacagaactaaaattgacagaacaagtccatgcaggcagcaagaaaaacagggttcctgcttcatggaatttaccttgtggggagattcaagctatacattaatgaatgaaaaacaaatacgtaaacatgattgtttcagatagtgatagtgtggtaaagaaaacaaaggtagaaagattccctggagtatggcaattaataagctgctactcacttttcattgtgctatgatatttaacaaagcagacaaaaatcgggtgaacaagcagaagacgatggcaaaagggttaccccatccgccttttctctcctctcctctaccttcttcctccaccatcttgttcttaggtctagtgtcaccagagcaaaagacagacagtaaactagtccataaggaatggttaatcagacctataagcaatggctcgaagaactggatcattcagctgagctcacgaagaaaaagtgacaattttaagtgcaattagttactgtgattcactaggtactcaaggtaaggattctgcaacaagagtatgatagcctatacttagacagtaaaagagggattcagcaagtcctgtaattagtaagaacttcaacagttttcatcgctgtattaatactgtgtaaaatactgaaaaatggattaccctgaagaaaacactaattgagaaaacaaaatcaactataaataacacacaccccaatatacaaagaccagactttgttacatggataactcatgctagaggatgtcagagaagatgagatagaaaaaagaatgtcctggtgcaaaagattaacaccaggaaggttgggcatgtgagcgtagaagaaatggggaagggaaatttgagggtgggaaaatgcagagatgggactgatataatgacagaaaagcaatagcaatgactttttttgttgttgttgttgctaactaacagattaagcataccaatgaaaaccaaggcaagatcttagtaaaggggcctaggatagtgccatgatgtgactttatctgtcacgacaaccaagagggaatgattgcagaggccaatgagctgggagaatggaatggatgatcgtgacagagctgatcattgtgaatgatagatgtttctgggagctgagagtcctgactggcactgtggagccaagaggaaagaggaccagagcatacccagcctggtctcccacgccctgtcctgttgcgaggtgactgccgagctcttccccctccctggcactcagcagctgctctctaagcgctacagtcagtggttacaatcagtgggggaagtgatattcaaatattcaaaacgagatgcacgacatacatcccgatttgctctaaagagcggatttactctaaaatggtattcttcacaagaatgcaaattcattactttcttgtgacatgaaattctcctgggattctaggtgatgtcaatagacaccactagcagatagtggttagtccatatccacctcactcattttgttaatgcaaacaatattattattattattattattattttattattattttgagacaaaatcccactctgtcacccaggctgaagtgcagtggcgtgatcttggctgactgcaacctctgcctccaagattcaagtgattctcctgcctcagcctcctgagtagctgggattacaggtgcacagcaccacacctggctgatttttctatttttggcagggacagggttttggcatgttggccagggtggtctcaaactcctgaccgcaagtgatctgcctgactcaggttcccaaagtgctggaattacaggcgtgagccactatgaccagcaaagaacattattgaatttaaatactgctttaccaaaaaccaaaccaaaccaaaacaaaactaatggaaatgagcctaacacttgaagttatgaatatttggaatcaaatctaggctatgaattcattcatttttcaggggtctacagccaccacttaatggtataagggctgtatggtaacagtatttacgttagtcacatcagaagatgcaaacatatcataaagaagtaaaatgtttcagcttgaattttagggaaacatggcaagactcaaatatttctctattaaagatatcaacgagtctacctgctgtttgttttactactgctataatactctcacttccgaaattcagaaatatatcacttaaggtaatttgctggcagagtgagtggtggggactttttgtcagtagaaaggtcaaataattttgcacaatgtgctgcaaatttttagctttataattttactataagtgacccaagggaaagctcattatattgttacacacaaaaattatgttgtgagctaatggaaagtgaacagtaaggtagaagccctgtgtgctatacccactgctttttctgaaatacataatcttggcatgttttgtttttaattttttcaataaatgtggaaaaatttatgtaaaaaataagagtcctcatctcacaatcaacgatggtataggagggtagccttctatacatgaatataaggcccttctaaggaatataacatgcaacaaagatttacagtaaagccaaggaagtaagaaaaaaagttgactaacctaacccacctgagctcggctcacaggggtcaatgtcctcatcatcgctgggacactctgctgaggccacaaggatgtcatctgtggtctgcaaaagaatcacattcagtagattaatttaaagggtcctaacagattctctcatctttgtctcattgacaagtgaaatacaatttgtttatcaagaaaccaaattcactatttccctttctaaagacacagagcttacattttagatccttcatagaagtaactgcctatttgtgaaaacttgattacactttagtttacatgaggacgcagaaatggtgacagccaacttgtagatacccatccactcaaatgcagatagaagctgcacacagtatcatacagaggtttaaaacaacctggcagaaacagatgatttgaaatttattacagcctggagtgctacaatgtatgcatcagtgggctttatgtagtacttgtgcttggcttcctaaaagcagaaaagccataaccttttacactcacgactatgtagagtttgatgaatctttgagatatagcttgttattggaggaaacacagattaagtagagaattagatagctctttcattggtgcaaaaaggcaaggaaatacaatccatttaagacactttcattttcattatgatttcacacttgaagctcatttttgtaatgttcagatagcaggtattgcttcctcatcatccctttcatcattatggtttcataataaatgaaaagtgtattcaaagtgggggaggggaagaggtggcagttttctctgtgacattctagttgcttcattgcgcttacagcaaaaaagatacctatctctgtaataaaaagcagagtccataaatcctagcagttagtcacataatcaacacactgataagcacgaaaagttgttctttattgccactgacaagctgcagtaaattcagcatagatattgcatggaatctgtaaaggcttccatcagagttggctctgctaaggtaaaacagagaatccaatgtatacaaataaataaaaatatctcattacatctactaaggactaaagagattagaattgttcaaacaattctcagaattgcaacattgatacagttctcatttaaaagtggaattaaaataacataggtcttacttcaaagaaaaagcaaaaatacgatatgagcacctaatattaaaggagcacctaatattgtcacagattaaagtataactaaatttttaagaaagttgtggcattttgaaaaatggagacgaggggtgatgaacttttatagaaagtattaggcttaaaaatctttcaagtgcagagtctttaagaacaaagaatttgttcagatgcgaatgctttacaatataactttaaataaacacaaacctttaaatagcattggagatggtttcatgttactctgctcttacttcttctgagacaattgggagagtttctggattcatgcattttgctgctgctattttagaaagggaaggtgaaaatattggtttgcctggaagtgtaagtctttttttttaactgttgaatttattgacaaagttattcataatattctcactttttattcttcaatgtttgtggcatttgtagtgctaactcccctttcattcctggtatttgataatttgtgggggttttctctttttttttttttattatacttttagttccaggatacatgtgcagcatatgcaggttacatatgtatacacgtgccatggtggtttgctgcacccatcaacctgtcatctacattaggtatttctcctaatgctatacctcccctagacccccaccctccaacaggcccaagtgtgtgatgttcccctgcctgtgtccatgtgttctcattgttcaactcccacttatgagtgagaatatgcagtgtttgattttcagttcctctgatagtttgctgagaatggtggtttccagcttcatccatgtccctacaagggacatgaactcatccttttttatggctgcatagtattccatggtgtatatgtgccacattttctatatccagtctatcattgatgagcatttgggttggttccaagtctttgctattgtgaatagtgtggcaagaaatatacatgtacatgtgtctttatagtaaaatgatttataatcctttgggtatatacccagtaatgggattgctgggtcaaatggtatttctggttctagatccttgaggaatcaccacactgtcttccacaatggttgaactaatttacactcccaccaacagtgtaaaagcattcctattctccacatcctccagcatctgttgcttcctgactttttaatgattgccattctaactggcatgagatggtatctcattgtggttttgatttgcattgctctgatgaccagtgatgatgagctttttttcatatgtgtgttggccgtataaatgtcttcttttgaaaagtgtatgttcatatacttcacccactttttgatggggttgttttgtttttttcttgtaaatttgtttaagttccttgtagactctggatattagacctttgtcagacagatagattgcaaaaatttcctcccattctgtaggttgcctgtccattctgatgatagtttcttttgctgggcagaagctctttaattagatcccatttgtcaattttggcttttgttgccactgctttttgtgttttagtcatcaagtctttgcccatgcctgtgtcctaaatggtattgcctaggttttcttctagggttttttatggttttaggtcttacgtttaagtctttaatccatcttgagttaatttttgtataaggtgtaaggaaggggtccggtttcagtttcctgcatatgtctagccagttttcccaacaccatttattaaatagggaatcctttcctcattccttgtttttgtcaggtttgtcaaagatcagctggtcttcaaagaactagaaaaaactactttatatttcatatggaaccaaaaaagagcccatatagccaagccaatcctaagcaaaaagaacaaggctggaggcatcatgctacctgacttaaaactatgctacaaggctacagtaaccaaaacagcctggtaccagtaccaaaacagatatatagaccaatggaatagaacagaggcctcaatgtaactcttaatgtcagtgaagatcgttagcaattggcacgataatcatgtaggtatctttttaaaaagaaagctttaaaagcaaagacccattctccttttggcacaactacatcttgctgggtaatatacaaacagacttgataatgacgtgttattgaattatgtagtcttgccggtcagttgctccaattccctccagaggagataatcagctttttgtttttttccccccggaccaacatctagcggaaagctacttttattctcaatttcaaattaatttcaaggttacagataatttctcattttctttgaggaatgttaaatatattgatgaaatcaatatagtgttgttcctattggtgttttattcttgttagagggaggaggatataaataaattctttaaaccaatggctctcacatcagcagtgatattgccaccttttccttcctccacctggaggcacgtttggtaatatgtggaaatatttgaggtcacaattggaattctgaggtctgctactatcattgtctctttttgactgctaaacattcttttctttcctcttcctctcttctccttctccttttttctttcttttttttttctttttttttttttttttgtagagataaggttccagctcagtctcactgtgttacccaggctgatctagaactcttggcctcaagcaatactcctacctgagcctcccgaagtgctgggattacaggaatgagctaccacacaatgcctaaatattataaaatacacatgacagcttgaagacaacaaagaatgatctaacctgaaatgttaataatgccaaagttgagaacccctgctcaaaacatttaaaaacagttctgtcttattgttctcctaaaaatatggacagcataatagtatctattgttacaaggatgaaattagtacatgaaaagtacctagaaggggacaacactgtaaatgtttattaaaactttcaatattattatcaacttttttcaatatttcatgaatgtaataccaatttaatttttgcactataattacaaataatataattatagatattaaaccgaaacttgtacatatgaattattcttgaggtctcatgttaaaatttgtatcaaaatacagtagctacattggtattttgttgaactaagtaccatcttttactgtccaactttgaccttttaaaaggcaaacatcaaatataaacttaaaaaactgcttcttaaaaaaattcatgggctacaactgtgtgactcagtgggtagtgtttcatgcagactaaattatttacgcaatacaagttaagctttgttttaaaagctgacctattttcttttggaacaattctacactaaccagaacgtgtgagaatgttctcagtgttaccttctgcaaaacacaattcctaaaataacaaaagatgtcatacaatggtacttcctatagccctcttacagtagaaaaaaataactacaaatgcgacccttttgtaaaactatattttactttttaatgtaatttccctggtataatgaaatacgttcttgattttcatatatgtttttcctccagaaattaaaaaccagcaacaatcttgagaataaaagacctcaaatcaatagatggcttggcaaaaatcatcatcgcagtatgaaaaatcaggaagtggctcaagtgtaggggaagaaaatcaaatttcactttagaagctgaattaactgcacaattttctagccaaagctgtgtaatttaaatttaattcactgtgtttggagctgctgctatgacttgctgttgagagagtggtagaaagaaactcaaatatgtcacattaatcaattctattctttagtatacttttccctgatgtttataacctttttgagaaaagagacaacctgctgaaaaagacagaagcgtgatcaagcagaagcattagctttacataacagtccatttagatgagtgtctctaactgtgcatttaaccacccacaggtgaaattgctatgctgatcttccttaattcagactggtctgtacatgcacatcgtaagcatctcttcttgttgaaaatgtgcactaaaatctaagtctctatacttttaggaagaaaatgatttgaacagaattcaagaaataaaggctgtaaaacttaatccatccttttctatatttgaacaccaatattttgtagggtttgagaaatatgtcaggacgggggcaaaagaatgttcttaatgaatggtaagaaggtagaccaagtgatttaatacccagggatattaaaaagagggagcatttggttggggggaatttagagaaacacagatgtatgtttgttattttttctcacttataggaagccttttatttttcaacatcattaatggtggaattttctgtatatgcatttgctgtcactttaaaaaatatagcttaactgcatatctgtgtggtaaaaatatacaaggaaagcacgaataaacccagtatgtaatattatatccctgctaagaataacattccaagactttattccttatgataaacagctttcctgaagactaatatattccaatgaagacgcttacagaaaactatactattaagacaaatctgttttgtaaggaaaagagcaatttccaattgtaaaataggatattcattgtcagtatatgatacccacaaataaacccgatttattctaaaattttaattgaaagtttatttctaaacagcaacagtgtatcctgctatacctctaaatacgaagccaaaagaattgtctcagacaatgacatgagcattgtataacattatttagcctaatatttaactgttgtgactgatatttagactgaattgatagcaacagttagtgggtcgaggacagtgctggctgaaatatgatatctttggttaactgatgggcacttgttcttgctgatacttttctgtatgcaaagctgctttggaagagagagcgctctcaagtgtggttttcatgaatgaatctaatagtttctccagaaaatatttatcactaggtgaggttccttgaaaaaaaaaaattttaacaggattcaggattagtatcacaaattcccaagtaaggtccaacccagtgtcctgataacctatggagcaagaagtttctaggaggtaagggaagtcataattctcaccagaaggaaaaactgcagaaaataatccacttgtaatgtgtatataggtatatgattcccaaattgcggtctatttgattaaagcaaatcagtaaagaaatagatcaaattggcaatttcagttaatgaacaatcctattaaggtgcaagaggaatttagaggctgtctagatcttattcttgtttccactgtctcaatgaagttgcctcaattgacataaagatgtcaatttcatggctcactatttaataaacataaaaataataagctgagatccagtatgtggaggatgaattttacctccagcacatgaataagaaagacagtgaggcccaattactcaacaatgaatacaaagcacctcatctatgcgtagcattttctgataggcataaaatattctcagtacacatgaaggtataaattgtggttccgatatgcaaataatttactgttctctctctgttctgaggcaaatgaacaaataactctttaatacaaataacaatgaagtaaattcaaatagcttatttttctcggaatgtaacaatgttcccatatccattacttcatttacaattcaccaatagcatccttatctggaatgcagatggaggtactgttattcagagtgttatagttaagtgtctgctaaaaaaaatactcatctgtacactcatctacccaatttgaatgtgtgaacactggctttcatgaatatgtagggcaaagctcaaataccccttaaaacagccactttcacatttctttaatgttctttcccaattgatgccctaggctattacaaaaagtgaccataaatcagctgtctgcttgggaaaaaggcagacttgaaagccattcaattttcttcgaatttttttcagctgtttaaaaagtatgcaatggttccagaaccactaaagtgggtttgagtagaagaactctgccgtggtaaagaaatcacatcttactcagtctaacgttcatttttatgtacatttgatactggttctcctaacaggcaaaactcaaaggaaaatataggaatatggaaataatgtcacagaaatgcactttaattaagttatggggaaaagaataaaactgaatttttgagtaatcaaaaaataacatattttagcaaacttattcaaaatagaaaacctacaaataaggaacctgctgtcagggaacttgaaattaaatttatgtttaaaaaatatgttttttattatttctttatgctactgatgacctctatgctcatattgcatttccatttttagccaaggcaatgtagaaggactggcaaaataaattaatatgaaatttaaactttcaggaagccatggaacaacctatttttctgaattctcactaattagaatttgagaatgtcagacctccaaagactgctggtaatggagtagaggtactgaatgagtgatcaactgtgtttcccgtctctttgtttcgcttttggacaaagcactttctgaaataattttggccatttccaaattaaataaatattgaaagatgtttacaaatgtaaatttaggcttctagctgtatcagtatgaatatctagtcctattatggattagtcacacaggttgaaatgaaaagtagggttctaagctgtatcaacatgagtatctagtcctattaatggattggtggactaattaatagattaattagtcacacacattgaaatcaaaatccctttcggtaaaaggccaaaataaaaccagactttatgattgcaaaatgcctatgatggataatttcaactagcatgactccaaatccaagctttcattgttgccatgttagggaatgaaaacatgttttagttaagcagtcatatatcttcttgtactgagtcagatcttagagatcattaatctaagctcttcattttacatattgggaaactgaagctagaaaattttaattggccacagttataatgctagttaatggcaaatctatgagattatccgactcccagtagattatgtttttctattatcccagatgacttctacctatccattcatctatccatccatcccaaaccatcttgttctctaatgaattttatgtgatttacgaagatacatgataagataaacttaaaataagtgaaaaggttgcaaaggtagagtactggattttagataagtaaccactaaaattgtcctgaagaaatacacacagacaggaggtgcatattcacagcttctgcaccatttgatatggcagcacatcatgtaacactaaaaggggagcacaattaatgctagagttcaacttttaaaaatccaattacagaaattcaaatattgacataattacagttattttgaaatggagttaacccagagagttctttatttacttgtgaaaatcttttctgaaattattgttttaaagaccttacataccatgccctcagtctctgtacctaaatgcataactaattttttggtgacaaaaagaaaatgcaaattattgaatctctttctgtctttttatctctttgacttagaacactgcaggctatgctggctacaaaattaaatcaatgaactccctgctctcttctcattaagccactgattaaaatccttccaacttccaaggtctctctcttactaactactgtcttcacaatgtaagtgccaatgagatattcatctttgtttctctcacacaactatcattagagttctgtcagattatttcttattacatcttgggaataaatacatggaagtgatcatttattagccatattggtagtttctccagaaacaatttaaacatgtattgatcaactcagtcttattgacacaatgaccttcgaagtgaaggttcaagatcaaagatgtagaaggagccacatttacctttggacaagcagccagttataaaaaacatttctctgctactgggtagtactatgaccaatgtcacctgataaactttaacttggggatagatgagaacttccattccacacgatgcttggagtatagaacagcaagaaatatggatgtggctggaaataatcacttagttaacagaaggtgtattttctgattttgagttgattcatgagttgaatatatgcaagactcaggactgcatgcccccaaataagccagtatctgagtagcatctctatgcttgtatctatccagtggtgattgagaataaacattatctggctcagatgtcacaatgttatcttgttcatgtgctaagaggatccagtgtcttctagttctagttaaactggaactccaagcttctacacttgactacttcattccttctggtgcacattggttctttaatacatatttacgatgttgtactgctgaaacacctcagtttaatttatactatgctgaccaataatgcaaaataaatactactccagaattcaagtctcacttttagttttcatgagcagtacacatcatcttggactggtttctgtgttctaaacatgacatatgaatatatacatattatacatttaaatacatatatttatatatgtaattaattgtgtctcacaggatgttaagggagtcaaatttcatatgtgtgaagacattttggaaagtgtaaaagtgcccacgatgcagtgtttgtataaattattattatagaaaacacatggacaccgggagggcaacatcacacaccacagcctgtcagggtgtgggggacaaggggagggagagccttaggacaaatacctacttcacgcggggtttaaaacctagatgacaggttgatgggtgcagcaaaccaccaaggcacatgtatacctatgtaacaagcctgcatattctgcatatgtatcccagaacttaagaaaaaataaaaaaattattattataactaataatttttgttcctcacatgatgctacaaaggagagctccggatagtgcttgaagaggacaacccaatgtccatttacctgaatacattttattttaatgtcctgaaatcctcttgtccctcagttgaataggatctgtatctctcacttacactagcccctcacacagatgctgttcttgggctgcttcctattatgccagcattgaattcattttggcattccttatttagggcatatgtgtggatctcactggtaacttacaaggtaggtagcaccaatctatgtctggcattatgattacctttcctccgaccagatctcctggagagcttagtgcacagactcagggatacttgagctctctctaaattctaagttctactcattagattgtgagaacctgatttattttatcactgcatccagaatttaccactctgttaaaactacagcatataaatgaacagatgaacagggaaaaacagaccacttagcaaacaatgctaattaaaggagagaaagagagagaaaaagggagagggagagagaaagactgaatctctaagtgtaattcatgcatgacaatgctccttacaataggagtggttgtatttgtagttataatatgactttacctatggtttgtcttctatacggattaataatatgcttatcaactcctgttaagacaatgagctatcttttcttagtgcattagaatagtgggagtacttgccttttgaaatcatcttgaaatctaaaagtatgaagactgcttagtgatatgttttattttatttcatatgctgcttttgggtacagtttatgttttatgcccccagggcatctatacaggaattcagtagagctgacttaaaatgacataatcactcaaaaacctggcttatattcttaaagcatttgcgtgaataaaaggattttttgaaaataattatgacttgaaaaataattgttatgaaaatacagcttagttaaaagtgagggattcatcttgactttaaaaatagaagaaatattatacatgacacttgaatttactagaatcatcacattttaaataatcttactcttgatggtcatccactctaagctcactacatttttggttatgaaaaaggcatgattgtcacaattgctcatttataccagctaattaaatctcaatataaaattgaacaagtatagattattttctaggaatacacctaagagtgggagatgagaattgtggcaaaataacactttttcaaagattttatctgccttataacatctctagaagtaacaatgaaactttctaactggcttccacattataccccatggctggaaatgtatggtagagaaatagcaaaaagtgacattatctttaactgaaagagagaatgactgaaggttagaaggaaggcaaagctaaaaatgtcttgcaataagttggtcttcctgcttttatgaagcattcctgtcctttgagaaagcagtaagataaagcctactctgtggaagggactgagaaaaacatagttaactatcattttgggttttttttttacctacataatattcctcaactatctctatctcttacaaactctcttgcaatagtctattgcattataaatgcttttacttagttgcaaaaaagaaaaaaaaactattcctttgtaatgttttccttcaaaatctaactacaggatgaaagctttatctttttcctgaaagaggccagccataagattcacaccaagaaatagtgtaagacagaatgcactaatcaaatctatatctactgattctgccattcattcattcatccatttgtactcatttgttgaatattttcatttaataaagagttatacaggcaaggaataaaaatacaattttctgactcagaacatttagaatactgtggtggcgcatgcaatccagtttcttttgggtttggagaaggcatctatcattttatgcattaatcttttacccatgtattaagtgttcacactgtatattcaaggttgcatccccagggcctgccacagtacctagcatgtaagagacaaatatctggccaatcagtcagaaatgattccagccagtataatcagaaaaatagaagtaatttgataggaaaaataagtccaacactaccccatcatgctagacaaaacaaaagtaccttagagttttacaaaaacgtttccaaatgcaagggattgacagaaccaaagatgttctatgttctctgatacttcagctatcagctgattagaaaaggtatcaatttgaaaagcaacgagaagcattgtcatgttaacttttttggaaaatgtgactgctaccaccattcactgtaaggcaatttgtgctccttcatttttacaactaataaatggtgccagtgtttatttttctccttttccctttgatttcatttttttcatctcttcctatttcattcatggtgtcccaactcccagaggagctacctcaggaaaaaagatctcacatagcaagaaaagtccaaggagcaaatgctgtttgactctaaccaacataccgtagcaccttaggtccatgtataaatttagggaagagaattacatgctctcttccagttattattatatgattccataagtcaaagaaatctggaaatgtttctatgagtagaaatttgtgataaaggagatagtcttttttactctgctaaaatattttttggtacaaggaaggtgccctgtatataactgttgatttaatttgagatatcatgagccctgacacttgacttttagttctccaatttaagttactaagctgcctacattcgatcaggataatttgccatataatcatgaatgggtaggggaaattggcagcttttaacggttctcaaaggtaattcctaagagaggtgagttggaactgatgaaattgagatagatgctaagtgaccaggcatccctgctttgaattgtgaaattgaacttcaatgtgtaacaaatgcaggccttctatgagcagcaagttgctttttccactactgagcatggaaggagcatgaatgttggagctgaacagactggtcttaaatcccagctctgccacttactagctgtgtaaccctgggcaagttccccaacttctctggatttctttcgatgtaaaagtgaagttatttacacctattttgcatgagtattacatgtattaaattatctagacctagataggcatactatctagcacagtagctggtatatggaagatattatcatgaatatttattacatagatacaaccagctttcaaaatgaatggctcttgtagacattttcacattattctcaccgcaatatggaaattaaactttattcctagcactggactccctaatctttagagacaaacacacccttcacagagaaagtacaagtttctcacctaaattcacacatccatgtttaaatattctataaacagagaagattatatgtttgataggacagcgcttgtaaaagcacctcaaaaaatcacattatcagtatattgaaaatacaaggagcatctcttctctctagctacacgatgtaatcaagcatttgtcaaatcatatttggaggctctttgaattatgtgctccagttcccttttaggtaaagagaaggaaaccctaaattggcatggtcaggtgtgggtcagatgtacagtaccaaattactgcactgcactgttcaggagggacttaggagtatatcccagtttcctggctctccatccagttggcgtcttgctccttctactcctcctagtttcatgtttgggtatggggcagataaaaataacagcgggaataatttactacttttcccaagtttcttatacataacttgactttttaaattcttccctatgtcttactgaaattttaagtaaggcctttgaaaaatactagggaatgatgccgtcactcacagctgccagactggagagcactcagtggctggtgcaaagcccagtaaaatccaaccaaagaacacaagtgcagaaacaggacaagaattttgctaattgtcttctttgagaactaggagcttcattagagaatttgcctttgtgcatgtatttaatgagatgggatatgctgctgaactcttcctgcaggtatttcagtgttttatttagttatgatattgcctaatgacctctttttttggtccactattcagacatttttgggtcatttaaaaagttgttataaataaacatcacttacataacatttagatttctaagtgattaaacatatcctctcttggatagctttcctcttgccagccttgcatttacagtctgtctcactcaattctgacatatttcattgcagttgttatcacgcctctgccatctgggtttgtccttttccttcccgcacacctctgcaatccccgcctgccctcttcccttcgttatcattgcttagatgcctactaattaaggacaagaaagaaacctattcaacataaatataccttttatcatcatgcgaacttacacagatgtagctttttaaacagttcagaagacaaacttttcttgatgatttggtgtcatttttatgagcacgagggctggaaacacagtagtgatctcaaagagtattgctgactattctccataggtacccaagttgctcgtttactttttagtctatgaaagctcaatctagcttttgtcttttgtcagcctttatagacctctttcttccttccaatttgccccttcggatctgctttgagctggaaatccagataatcaaagttctccgtcctgagaaatgagaaattggctataaggtaaaggatatcagagaggttctcaaatgagaaagcccaggtgcatgagagcactcagtcaaggctcatggcttaaaatacacaagacctgttagtttcttccaaatgcaaagttcttcgtgaaggtagtatatttatttctaagcgaatctcagtaatattttcactatgataattttcaaatgggcttttcttattttattgagtccaagcatccttattgaaacaagattccacatttctaaatttctattttccaagatctattcaaacagaagccaagcctccttttgtgttccactgagttggctgggagggagggaaatgaagatgaagtaatataataagaaaggtggctgtcttactgtcattgactgctttgctacctgaaaaactcgaaggtacactggtttatatttttacgtagaacctgatgcagccatgcaggcatccagctgtatctatccagagtgggtgattcacctggtgtaccctgaagagacagagaaatgctcttcacggtagcatctttttggtttcctaggaccagttgtttgcttgacaaattgagaagccctggtacaggttatgggatcttacaatgctgctttccagtgatctgctgcatgggcattggagtcagacttacccaagtttaaatctggactgtactatttagagctggtagaacttgtgtgatttatttaacctctcatttgtaaatgggagggatgcactgccaatctatgcagtagttgtagggattaagaaaatcatgacagatgatatacttaacactgttcctggtgcgtgataaattcaaaataaatattggctattatcaccttcattattattttataagacatacatatgttacctccagcatgctgaaaataacgtttcttaataaagtaggcaaaaccccagtatcctaacattcacaagaggtagacaatccacttttgtccttgcctagcatattgtgaagtggaaggggaaaaagccaaacagtgcatgaagaatgcaaatgtattttttttcctgaatgttctcttttgctttttgacttttaaactctactttatttcaaaacacagtcccaaccattccaaagcatttttgaattggaaagccttctttttttgtttcataataagctaactgcaggtgcaaactcaagggagacagaccttggaaattttaagtatgttgccatggcaatggtttgcaagaatgtgtatgagtttcatcttagctttcaagcattcaactgagttcatacgtggaggttcaaatcactaggcacacaatgtttgccactcattgtgtcctgaaaggtttggaaataactatctgtgttgcttatagcaaccagaaaccacaaaattctatttatttatttatttatgcaaatgtagagatctagtcattcatatctgctcttaggtggcctatctcaccagtgtggctgctctaagagaagctgtacacataatttcaacactaatcattttcaccattgttgcaaacacagttgtactcccaatatggagtagctataaaaatgttccactgaatatcacattaatttcctcattcaaatttgacagatccttccagaagcatgataattatttaaagatgttgcattaaagcaaaatttcagtctaatgaattgtggagtatttccttaaaagtgtctcatcctatagtggaagaaagaaagtgaaagcacacaatccagtcattaaattaacaccaccctccccagaaaaagcaccagcaccggcactgccaacaaaaagacatgcaaaaaacatcattttatcacatattactaccccagtggttcttaaatggttcagctaatgcttctaaattccaaaacctgcacactgaactcatgcttcattgacagaggaggcaatggttcttgacaaaagcattcttttccccataaatggaatccatagcatactataattgggtaagttttaaagctatctattgggtacgggaaataattattaacaaattctcttcaaattacaaggctttttttcatgtaaaatgagtactaaacaaataatatcatttttaattaaataaatgatttatttaattaaaatccagcaagaaaaagctggatttctaggggtgtatgttcttcatgttttctagcgaaaacttgctgcaaatgattcatcatgatacagcagaatgccctacataaaaacatggccacaggagaccccagtatctcctgcattttgttactgactgaacccttcacaaacgcattattagctaccaaaccctggcagctatttaaaattcgcattgttgctttaactttgacccatcttccaaaatgcctgcgcacgcatgcacacacacacacacacacacacacacatcaatctctcaatctcccgtcctccttgttgtaacattttgttgacgtacttcaaaactgcagtagagcttccctgccctgaccctccattctaagaagcttacagcaatgctggaattaaacaaatgagaacacaataattagctatgcaaactgtcaactagatctaaaaagaaaaacaacccagaaaacacaacaatcagcagtttcaagccctaacaagaatctgcattgaattctcatttattttaaacaaaaatagattaggccttttgaaaaatattcagtgaaatttctatggaaataggacaaattagcctataggtctttacatctctaatttctgtgttgctgatacagtagaaaagtccaacactctttccaaataaatgctcttctactctttaatagccagatttacttccaaaggtgagtagcaccaaaaatatttccaaagtggatatgaaacaggttagtggatcaaattatatggtgtgacaccgcagttcccaactctgtccccacaacctcaccctaatcattttatcaatggtaattaaaatataaagggaaactgtaagggaaaaataattcttgaaatatatggtgtggctgggtatggtggcacacacctctagtcccagccacctggaggaggccgaggcaggagggtcacttgagtccagcctgggcaacatagtgagaccctaacactaaaaaaaagaaaaaagaaaaatatctggtgtgtttgtggtatatgaaggggagggaataggtattcaattctttgggtggagagtattgattatataatttgtagctaaatctctcagtttcttcatagataccaatcaactgcctcctcacccttcgggaaccatcctgagttctgatgaagcaacatggattatctctatgatacagacactttgaatgaatactaatctaatgcttcaattgactgttaaatgttctcttaacccatttgcatcccgtaatagaaatttggatttttttaaattgagaattgtaatgactctgtaaaagttttgttgcttcaagtcttttatctttaaacttgctgaataactgcctactttataaattgagaatgtaatatgtaatgcctgaaactagtgtaggacaagaaatagtaatctaagttttgactaagagttctatgtaacccattgacctggggcaaatcactcctcatcctaatataagtaggttagagtagatgacctttcatatttcccatgcaatgatggagagtaacacaagggagtcctgtggtaacggtagagggtaatatcttgattgtggtggtggttacaagaagctacacatgtgataaaactgcatagaggccggacacggtggctcatgaggtcaggagatcaagaccatcctggctaacacggtgaaacctcgtctttactaaaaatacaaaaattagccgggggtggtggcatgcacctgtagtcccagctactcaggagcgtcaggcaggaggagcccttgagcccaggatatggagacagcagtgagctatgatcatgcaactgcactcagcctgggcaacaaattgagagcctgcctctaaataaataaataaataaataaataaataaaatgaaaacaaaatacaaataaaatgaaactgacaaaataaaacaggaaatatcacggattcactaaaaattaaatatccatatttatatcccgaggatgctgccatttctgcccagttagctacccctacaatgtgtaatcttatttttcaatcctcaaatcctgcagaatccttatttatctgataattcaattgtgctcaatatgcttccttttaacgtcacagaattcggtgaattttcctgacttccatgtggtcgaaaaataatggctggtgacttagaaattttactgctatgtattggcttcaaaatttgtctttcaagtgacaggaatggggcagaaaaagacagtagatgccactagcagagttctggtgtaggcaaagtagaagaaaagaggcaaaacaaacaggaaataactaagcaagagaatgagcagaaggaaggagaaaagctaagaaaagagttcctccacctatgtttgggcggtggcagagtgtctctgtccattttacaagtgacatctatgatacagctatttcatatttaggaaagtagaatgaatcacgcaatgagatgtgaaataagtcttgattacagtattctagaaaggggcttaaaagaagcaaaagactttactcctggtaaacaccaaaccttcagacacagaacagaaatgtgccgttagaagatccctctcacccccatcctttaacatctttcaccaaacaaaacagggtaaaacaaactcaggcagtttctcaattactttcattaaaatgtctatgaacggtgaattaaatgacgaatctctttcagaacccattaatactttttccagagctaatactatcagtaaattttaaatagtgggaggaattattataaaagaataaaatatgtaacagatgctgaatcggtcatatgtcccagagctgctgtaacatacccaggcccgtacttcatgtgtccataacgaaaagagctggctgagaagttatgaggccacacctcacaacacctcaccctgctctctccctagtcccacagaggcacaatgcttctaaagctttgaagcctgaagttcagggaatgctttaaagatgaagtgtttaagctattttctggaagccaaatctatcattttaagattacattaaaagctacacttctactgttcatatcaatttacgctccaaactgctggtttctcagagcatccattgaatcctggtgggaggtaaatagtttctgtttagattttgacagaaaattaaaatttaaaacataatcactacatcttccatatactaagaagtcttcggtggctcatgctgtaatcccagcactttgggaggctgaggtggatggattacctgaggtcaggagttcgagaccagactggcaacatggtgaaaccccgcctctactaaaaatacaaaaaattaatcgggtgtggtggcgcacacctgtaatgccagctactcgggaggctgaggcgggaaaattgcttgaactagggaggtggaggttgcggtgagccgagatcacgccattgcacttcagcaaaaaagccaggcctggtggctcacatctgtaatcccagcactttgggaggctaaggcaggtggattgcctgaggtcaggagttcgagaccagcctggccaacatggtgaaaccatgtctctactaaaaatacgaaaaattagctggacatggtggcgggcacctgtaatcccagctactagggaggctgaggtgggagaatcacttgaacccaggaggtggaggttgcagtgaaccaagattgtgccattgcactccagcctgggcaacaaaagcaaaagtccatctcaaaaaataaaaaataataaagtcttgaaatgataaatgtaaaagttctttattttattttttgagacgagggtctcactctgtcacccagggtggagtgcagtggtgcaatatcagatcactgcaacctctgtctcctgggctcaagtgattctcccccttcaggcccctgacaggtgcaggtgcacaccaccacacctagctattttttgtatttttggtagagacagggtttcaccacgtttcccaggctggtctcaaactcctgagctccaatgatccacctgccttggcctcccaaagtgctgggattacaggcatgagccactatgtccggtttcaaagttctaattacgtttccttgtgtctaagaaaaaattttttctgcctaaggtttctaattattatagacaccagcaggctataaatatgtatatatattttgagacagagtgtgcctccgtctcccaggctggagtgtaatggctccatctcggctcactgcaacctccgcctcccaagttcaaacaattatcttgcctcagcctcccaagtagctgggtttacaggtgcccaccaccacgcccagctaattttttgtatttttagtagagacggggtttcaccatgttggccaggctggtctcgaactcctgacctcaggcgatccaccctccttggcctcccaaagtgctgggattacaggtgtgagccactgcgcccagcctaggtttttatatataaattgtgaacagtcataaaaataatttgtcctacacaagtttttgtgcctactatagactttcacactgatagaaaaaaaaatgcttacaaagcctttttctcagaggatctcatttggcagttttgaaatttacttttccacaaatctttatcagtggtaagaatgtttctgaggctgtgctgtcaatcacttatgtcaccactttccttcccacttcattaggaaccacactgtactttatttcttaaaggagaatctgaaactgatttggggaagaaggacttttagtccagagtatgcagcattgtataaaatatgtattgatataaagcctaaaaatacacacagtaggtacagcattcacatacgcaattatttagcaggttcagctggtgtgattttacaccacagtgttcttcttacgaataccagagagaaaatcaaagtttcttgacatatggtaataaatattttcacttacagtaaataatttttgctcttttggcatccattgtataaaagctagtttgaaatcattccaaattagcaaagctagaagtttggtaacacaaggggaacgagcagtataggcccccataccttcgttttcactgaagtgtgcttgcttttgagatacaacactgagaaaacttcctcattttcaagatgaagagatgttatttcttcctattgtgtttctaggactcgaaatgagcatctgtattcttcattatggaaatggaaaatgagtttgccctataattaatgctagacatgacaatttttctggcactaccttcaaaataaaaattttcaatatgaaaatctcataagaaaatctcagatgcagattcatctcaaaatccaggtgacataattcaacaaaatgaaaagcagcctgtttataagaccaattttctttaaagcatttcttttttttttttaaggaaacacatttattcacactctaaaatcatgaaatgttagacctgcgaactcctcaccttacaaacaagaaaatcaggtatcagatgattaagccattaagtcttcaccagtagatacagaactttctccagtacaatgtcttcacataaatcaattaaaagaaaatgctctaaaattagataagctccaaagagtaatctgttcacactgggacatgttgaatttgaggtgaactgatagcagttgtaagggtaaatctgaagttgagaagagaattctgggctggggatcatatagatttcccaacgaaaccaaaagagaaaaggagattctgagaccaccttcagaaaaatccaacatttaaaagggtagaaagaaaaagcaggtacaaacaaagaactgctttcctgttaattgtttttactcctaaaatatttgattgaatgtttccaagtggaaatctgaggagcccagtgaagaggattctcttaggcaattggtggattctcttaggcaattgatcgaacccagtgataaatttcccaaagtagtcttatgacacacagtgcatctatgacacaaaaactgtaaagtaaatcacttttcaaaagtaattcaccttaaaaattgattaaaattaactgaatgttaatttcttagtattgacagatatacaacggttatatgacatattcacattagggaaaaatgaacaaaaagaactctctaaaatatgtttatgacatttctagaatctcaaattattctgaattaaaatatttatttttaaaataaagcatgctgatctgattaactcccatatattacatataaaatgacaaagctgtgatatttataaatacattctcttttaaaaaatgatggagatacattcaacaaagaaaaatacaaccacaaccaaaacaagcaacctacaaattcctccccacttttgttacgtttatagacataaaacatgcattatccttgtttgaatggcatgtctttgaaaatgtcctcccattttagagtttcaaataaaacaagcatatacttttctacttaatctcatcaatttaaaccttcatatcttttcttaaagtactgcaaagagtagatgcatcatttagggattgctaggtagagtgaaataggctggagtcagtatttattttgttattgcaggagtagccttctgtttaaaatgacaccttctcttgcaattgaaatcttactggctatgtggaaaactagaaagtcaggaatctagaaaacacttgttgcagtggatgtcttaagaagtgtcctcagcttccttttctctagcctgaggttttgtaaagcaatcaagagctattcagtttaatgttttatacctaggtatcatttcagtcagttttaatgaatggttcacaaaatatcccataattcttcaccatattttaagctgcttactgagaaaataatactattgatgaccattccagtatcaagagtaaatggtttacataattattattacttattcaaaattgtttcacctaaggccagattctcatttactgcccagacccactcacactcacctacccactccatcccaccaaaaaaaaaaaaagaaaattaagagctggcgaaggaagtagaataaggcaaacaaagaattattgctacagcaatttataagaacgctcaattataccctaagggtctgagacagttatgcagttatgccaaagtgtccaatttactttttctgaagaaaaacacttagcaacaatggctaattttaatgaataaagagaatgaatacaaactaaatatgcagatgacttttaaacaaaaagttgcatccattttgcattacttttatatttcataaagcatgaaaccggcttttaagaaatcagtatgttgtcctgagaacatgtagaacaataggaaacaacccccttgactgattttgagacaagctacttgggtcctctctggatattctagtaccctcggtgtccgtaatgccattttagaagcaggtattgatattaagggatgtgtagcctacctgatttgacctgattttgtgttaccttttatttcgtgactggataactagtgctgctcaaacacaggaaacatacagcgaaataacatgaatgtatctccttgaaccacattaaactctcctttctccaagctaccttgaaatatatagaatacaatgagcaaatatattgacaagacaatgagcaaatatatattaagtaatgctatagggtaaaatagttaggccttcagtgctcctctagttttatgcctatttgtcttgaatcctcaattgaacttttaaggcagcaagtgtctcatttttctttgcataacccatgacatctagcagtgttctggcatagatacaatcatgcagtacatattttaacagatcttaactaacaatgtacaaaagcactgagaggggtgcttagtaattacttatatattttaattttcaacattctggaaagagatagtaaaattcctaaaggctaagaaacctcttggcaagtccaacagtagcttatccccggccaaatttttggcttgctatatgtacttttaagcctattagttaatagctacatgtttaacaatgttttacatagacacacattttatacaaatgttgtagtcccactacaaatctaaagagtagatgatccactcaaatctagctgtgctaatggagggatgcatggtatataattaaaacaatgattttgaagccaatggagggtaactggtccaaaaagcacatctaatcatgcaaaataattcattatgtagacagttcatacatggaaaattgagaattgactcccaaggctgtacatatgcaacttctaaataaagtgctttaaaaaaatcaaaattctatgtaaaaggtttgatctgacaataaaatggttttgaagtcataatggcagccttagttttatatatgtaattacaccttattataaatacattttattacatatatataatctatacatttgcatataaagtatttttttcattataggtaaattcatttcactggacgactgattaggaaagaattttgtctttgatatactctcccatccgagtactaaccaggatcaactctgcttagcttctgagatcagatgagaatgggtgcattcagggtggtatggccgtagactgatatactcctgtagagttttcaacttgaacgatgttaagtcagccaggtaatggcatttccccatactgttaagccttcactgtatccatgactttactaataaatttaggctgtgaacttatgtaatcatgttttccatcaaaaatctgaaataggcttagagccaagatggtggaaccctacaagactcattacattttaataaaaaagcagggggaacaaaggtgagagcacaaagactgcagaactaatttctttcgggaactgacttattttggctccccaaaataatattcaagtcattcccaccatgataaatagtttttgtctttcaaagtaatgaataaagtaatggagactttataacaaaaggctatacattatagtcatgggaaaatagtaaaacaagtatttgaatgttttttattcccaagaagatgaattgtggcttaacccacagatcaaaaaatatatagcacaacactgaaaaaaattatcattgatttttgggaaatctgagctagttacttatgattaatcaaatgaattaaaataaaggtgaaaatttgaggagcaaatggaaacgggtagtgataatacacatagtttatgatgcaaaaatataaactatctctcatatatttctgctttttaatagttgttactcagtttgaactcatattgtctttaatgtgccaaaagaccctagatatatccatgaatgtataattgtctgtgactctctccaatttttctgtatactggaaattgcctacctactccacaatattgtccttagctccattctctatgctagagtgatgagggaaggaggccttcaggagattcaaatatcagctgtcaagtaaatgtaaataagatagcagaaggtaaaatcagtctttctggtcaatactggtaactctagtgtaaattttaaaaacttaaatgctaaagaatgtataaatctaaacttagtgtcattatactatcttgaatttgcacaaagattattgtttatgtctttaataatctcaagttctgaagcaaatggatgccatttttttctatctattggtgtttgagtccataaaccacaggtaaagcaacagaggaataaaacactgggagcagggaaaatgggaggtaaaagagaagactaaataataaaaggcaccacttgatctaagtatgattaaatattcattaacgctgttcagctgtggattttggtagtgctcataatactagaattaacagcactaattttgatagggtgaaatctcatttaaatgtcattttctaaatgggcagagtataagttcttaaatatttaaacttaatatagacaaaggcctaaagtacttggctacatgcttttttcccatttgaaaactaaaaagtgtcagctaagagggcttttcctatcaattagcattctggttactgaatccatcatatagttaattgattgcccttgtaccttatcaatgcacccagatgctgtggtatgaacacatttcataaattaaagaagcatatggaagtgacacagacagtagcatttcatcccagaacatctttaatatgcgatgctacatcactaattattttgtaaatatgtaagtatttccctagttaatgtgttggtgagaagtttgcttggcagttgagcccaaatgttattgtaaccagacatttaataacagttcaggactcttgtagtttcattccattctgcccataaggagaatgtgtctcttagcctactgggcaaccttgattgtgcaaagtcaatgaaaatatttatcctttattactgggtaattttccttaatgaacagcagtctactctccataatataaatatctgtccaaagatcggtctggagactctttctaaaaatgttacagggaatttgccaagtgaggagcatattgctgcttagtgaatttttttccattaatttctaaggatagaatatgaaggaaattgcagcagaaataagttggctttattcttcaactttgggaaaactagtataatgatctgagtatattatcctgaatttaccttaaggtaccaaaagtaaaaatttttttcttcttgtctaagtcataatttcttgtcaagccaagtttcaaaagttaagtcaaaagaactttttttgagaatggaaactttctttggagaatggaaattctctacattaattaatgtattaatacaaaatccactagataactgacaagtgagctgcgggcaacccaaaagattgcatttaaacattttaaatttgtgtttctgttacattttagaagcatgatttttgtcagattaatttgcacttaggactgaaaactgtatctgggttcaactagaattttgtaagagtcattaaaatcagaggattcagaaataagttgattttcatcctccttcagtcctatgacttttctgggcaaaaactgtgtccagttctctgggagctgggggtgacagagggcttgatggaggctgctgagagattaatttcatttcagaatttgaactgggtattggtcaggctccacgctgcatgataaaatcaacaaatacttaaataaaatattcaaaagttattctgtaaatggccatctattaaaaagtcagaaggaaaataatagtagattagtttgcatggctctaaacattttcagaattgaaaacttatttagggaaaaatttggtaagccctatagatgcttgaatcatccaaagtctagtaaataagtttagtattaattgccacttttatatttcgatgctactaactaaaataatacaatagcctactgttaatttctcttctgcttttcctgagcttggcaaagagaaaaatgtgacaaacaccacaaatagacaacacaccatttgtaatctggtaaagcaacttctattcatggaatttcttccctttatgaagcgagggctatctaatttaatgaaaatagttgtcaccacagatatgacattctgtctcctaattaaatgaagatgcaatcagaacttcccttgaaaagagaggccaggcttccttcactattaagcacactcttccctaagggcaccctcctaccctttttctgatatgcaatcccttctgtcctccatctgctccacccccacctattgtctccactcactccaagcatgccaatcccatctggctatactcttgcttctgctagctctaattctccacaggcctagggaatgtttgaatgccaaggcatttttgcttttctcgagaataaggactagctaggagggtatcaaacaattccccaaggaattcacacacacatgaacatgcacatggtctctcacatacacaaacagcagtttagaatcctcctctaggatataatttctttaaaaatgtttttaattatttcatctgggaggcattttagaaaattaaaatcttactattgttgaaataatcaaaattaatatttcagaaataaacactttcattatcccagacacgcatttttttcagtaagcagaattaatgtaagtaaatgttactcatatcttatcatgaaatatttacattaatcaggtttaatcactgatcactaatacgttttctgttttagcaaacatgcatttaattcagacattccatctttacaaatgctcatgaaaatcccactctgccacaaaagcatgcatggtcagaatctaagcatatttaagcaaaaatttcagcaagtcattaacaataataaagcagtctggcaagtactgaaagcagcttttattcatgcttttacttgaactaagttaatacatatatacatacatatgcacacacacacacacacacacacagacacaagttttggttgtttttgccacaagcatgctgataaacccctgaagctcacacaaagcagcagacaaaactagaagcaaccatgctcagggtttaaggacattttaaaatttaaaacaacctttccacatttcacatacagcgtgcataaatttgacatgcaatcttcaagaagaaatattttaacataaatcttaaaattagtttatccaaatgagtttattcttattttcattattattgtttttaggcttctggtatcttaaaccctgcatgctgcagatctaagctgtgctcagcagcggctgtgacagaagaagctacctgcaagttttcacagtgccatctcatatccatgtctgtctggctaccctgcgtgcttagagcttttttcttaattcttaatggaaatcctaggaaatttagtccatcctctgaaatcaatactggtgacaggagagctccctgactcagtgggagatcaagatgataaattgcctgcgcatcagcccggcctatcagtgccctgcacacagatgggcgagaaaagacacagaaaacgctctgtcagtcacgtgtcactgaggagccaatggctgacgcactacggcaggaagggatgctgcagttccgtctgcagttgacgaggctgttggtacacagcccagcccggcaccactcaaaaagtctcagcagtcgttgcttttcaatttgctcccctaacgagaccgcataggtaaacagacctccctctaacccccgaccgaaaaaaaggcttattttcatgcacgaacattttctgtatattacattcaaatccagtgtgattgctaaacacagaggggaaacttttttttccccagcccttaaactgttatgtgtttttcttgagataattatctttttacctaatattaaattagaagacttaaaactgtgcaattagcatggaaccctcctagtagaatctcctcgaagccttgtaattgtaattacaattttatttgtaagttaatgaatgacattttttgaatgccaagtttataatgagtatttttatgggatgagtttgtaaagacaattatgcaacattaagaaatacattcttaggcttttttttttttggccaattacaactgttgctctttaaagacaatttaagtcccaataaatatgccattttatcaatcattaaaaataaaaacaagcaccaaaagatgcacatcctgtttcccaaagcctgaagaacaaatgtattattcaatgatgaaaatatgtacttatttgctgccttttctctgaaatttacaataattatttggtaagcaaagactacacatctggaataccatatggaactatatccccaaatacatctgtttccagtgatcatactgtaataacagatatgtttacacacttcttcaatgtgagatgattatatatagttatatatacatatacatacaattatatattatatatatgattatatacagtctgacagggtaggctataagtgatgagaccggtgtgtgtttcaaatgacagtatcacggagattttttttttaaagctcaaaagtagcataaaacaatcttcaggaataaaatttctagaagaaaaattaccctagccaccctggcacttttattgcttttcattgcccagttttcatactattcatacatttgaaagaattaattctaacatcttttagagtctggcaacactatttagaaaaaaagtgtattggaataaacattgataggtgtgcctcataagtaaagcttatgagttgtagaatgctgaaattccaaagctcaatttgtcttggcaactatttttttaaactaaacacattcctgaaagattgaaccctgtcaagtttttttgcaaattctttctttcattcaatattgactatcaggaaataataaagcatttttcaagttttttaaaatagatgttgtcatgtgtttttttctatttattcagactattcaataataacgtaattctcaacaaactttattcttaaaaaatattatgactcagagcacctgtcattaaaaacaaaataataataaaacatcaacactaaacctattcattagagcactgtaatagccccaaactagaaaccaccttaatcactgatagtaaactgagtagataaactatgatacagccttacaggtgaaatactcttcatctgtaaaatacaatgtggtaaatcatatgtccttatatgaagagatttctcagatacatttgaatgaaaaagccataaaatttaaattgtgtataggctatacttacttacataatacatgcatgtatacacacacaaatgattgcatatgcggaagaatttttttttttttttttttttttgagatggagtcttgctctgtcacccaggctggagtgcagtggtgggatctagactcactgcaacctctgcctctcaggttcaagtgattcttctgcctcagcctcctgagtagatgggattacaggagagtgccaccacgcccagctaatttttttttttttttgtatttttagtagagatggggttacaccatgttggcctggtgggtctcaaactcctgatctcgagtgatccgcccaccttggcctcccaaagtaccaggattatagaggcatgagccaccctgcccgacctacaggaaatttctgtaaggacataaactatcagttaatagtggccaaatagtggctacatctgaggagactgagttcaaaggtaggactgagacatagttttattaggtatcattttatacattttgtttaagtctatggtttacttttctaatttaaaatgaattaagataatgttatcgatgttcatgtaggtttagaagagcatgactggtatgttttgagggaaaatcttgagggaaaggaaggaagacagagggaaggacatgtggcctgctttttttcatgtaaagaaaatagtgtaggtgtgggcaagaagggaactgtaaaataaaggttctggcaatctctgctgaagaccttcacatctcatatcaacttgaagttcttttatctatgaatgcaaataataatacagacatggattaagagctttacaatttagagtgacgattaacccaaattttgtctgattcttccaggaacgaatgtaaaaggctgagaagtaaatgatttgtatatttacccagacatgggcaaattaacctcttcaagccttagttttctcagctggatgcaattagcaaaaagtggccaagctaaacttgaatttcaatttagggtattgttcactgctgcttcaaaggcaaaataacatccatgtttttaccaataatggtgtagggctaaagacaaaacaaattttcacgtgtttcctccccagaagcagcttatgttgtccaaaactgaaaacttggcttatagattctattgttggctcttgttgttattcagattcttgtaactttaagagatacaaacctaaaaaaaaaatgaattggccaaattaagtcaaagattacaatttgaataatttaagggttttggggttttacataaaagtgctgtaaatcagtggtttcggatggtgattttgctccatcccaccccccagggaacatttgacaatgtttggtgacatttctggttgtcaaaactggagggtgctagcagcatccagtggatagtggccaagaatgctgctaatcattctataatgtacaggacagtccctatcacaaataattatttggacccaaatgtcaacagtgctgagatagagaaaccatgttctaaatgctaaacttttctaccttctttccgaaagattaaataaatatattctgtattatgaagcatatattgtaacgtgacaagatttagatggagaagagaaggggaccaaggaccaagccctgggtttctccaattttaataagttacagaaaacaggaaaaaacagcaagtgaggatgaagagatgggaggacaactcaaaggatggtgacctggaagtcagtggtaaaagtgtgttagtaaagagattagggtcaatttgttcaaatgctgtgataggtcaagttatctgttcttcataggttttttaaaagaattaaagtgagaaattaacctaattgaaattaacagtatacttgaagtctttattgctctgcatgatatttgcatttttaaaggtatggacagaaaatgtagcggggcggtggctcacctgtaatcccagcactttgggatgctgagtcgagtggatcacgaggtcaggagattgacaccatcctggccaacatggtgaaaccctgtctctactaaaaacacaaaaattagctaggcgtggtggcaggtgcctgtaatcccagctacttgggaggcagagccaggagaatcgcttgaaccagggagtcagaggttgcagtgagctgagattgcaccaccgcactccagcctggtgacagagcgagactccatcccccacaaaaaagaaaatgtagtaattacagggatcacaggaggactagctgaggaaatatataaaggagaggaaacttctgtaactctcaaattataattctgaggctactttctctacaaaggtgggcttgtgagcaagaaagtgaacaaatcctatcttggaccaccctacaccacagcttgcatgggagacagagtgccaccctctccccttagaaactatgtctgcagttcttgtcctcgggctctcacgaagtgtctctatccatagataaggtttctgaaaacagagttctaaggactaacttcaggtgcttttcctcctgggactcctctaatgctaatccccacactgtcaggcctgtggtgttcagggttagtgcagcaaggctcaaagacagagccagctggaggactaggacactggagcagctttaagcaaagctaatgcctttgttgcaaaggaaatgttagaaatctcacagaaaaacagctgggggagggagggcagaggagagagagagagatagccataaaaagaaaagagaggccacaaaaaaaaaaaaaaaaagatgaccacaaacccatggatattattacaaactctatggtgtgggagaaaactacatgtcacaattctcttaaaactagatagatttttacaaattgaatagtccaactccttcgttttagagatggattttaatgtagagaggttaaataatttgttttaaattttaagtgaaagtgacattctttaccattcaaagcaatcagtgaacctgatattgacaaatttcaaggtgctttcaaaaatcatcatagataacaaccagggtaagacttaggggaaggaggtcgggtgcgggggctcatgcctgtaatcccagttctttgggaggccgaagcaggtggatcacaagatcaggagttcgagaccagcctggccaacatggtgaaaccctgtctctactaaaaattccaaaattagccaggcgtggtggcatgcacctgtaatctcagctacttgagaggctgaggcaggataatgccttgaacccaggaggtggaggttgcagtaagccaagatcatgccactgcactccagcctgggtgacagaacaagactcaaaaaaacaaagaaacaaaaacttagagggaggggaaaagttgatgttcagtaagagataaatctccaaagccttctctttcccatgctgatgctgtattaaggcacggagagcctttgctatcagggagaggaagtattatcttccaaaatattccaatgagtatttataggttatgaaatacaaaagaagaagccttgagtattctcctttcagaagaatttaagtggctgctgaagttttttttaaatgaaaattctcatctctatttgcactacagtcatgatgaataggatgcatggatgactttcaaaagacatatgtcagaaagtaaactccagttgacaggaactatagcatagggaaatattttggactgttttcagtttttaagagatgggaaaaatagaagtggtggaaaatccaagcagattgtcttagttttttattatttttcctttttctccttataattgaagcactactttgagactatggagtaccattaaattcctattaactattaatttaatatttgcaagtatggattagagataggatggaaattaatgtccaagtgagtaaaattccacatagtcttatattgtttttttggttttttttttctgctactgtattcttgtgggttttgtttttcttactctggttgtttatctaggtatatatgctttgtaaaaagcaaacagaaacaaaacatctgtggccccaggcaatcttttcattaacattatatcctaaaaattattatgctaatgttaaaaataaagaaattgggactcagagggattaaataacatatatatccatgaagctagcaactgaaagtctacgactacattttgaatgttctctccaaatcagaactagcgttccagaatagttgttgttaaagtttattatgcataagaaccaacaaggcacacgttaaacatccagatttctgggcccttccatggagactgattcctactctaactcagatggattccaagagtctgcattgttaacaaacattccatcttccatactttaagaaccttgggaccatattggagtttcagcttcggaattcttctttgggaaaagccatatcaacaagatttcaatgaatagaaatgggaagctttaaaaaaatagaaaggaaagttggtaggagtagttttttaccaagagagaaactggagcagagaatagcttcacagcagagaggaaaaatgcagatgacttagagccatccattaagggatagtttcccatattgagttagataaagtatgaagtattttagttgaaaatatttttgagcaaggaagattaatgtgcatagaagaaatgtacaaatcatagcatttagaataggatgacccttttgaacctacaaatagggcacttggctgaattggttcctacctccactgctgcaattagaaaccatgaatgtgcagatatacaggcaatgtcattttgtatatgctagaaaataatttattttcagaggggttttcatatgatgggtttctagacctctagagagaggtaaagtttcctttataagatgagaacctactgaagtcagatgaaaacctccccaattgcttgacaataaatcttcccagagaaaagtcctcagccatttcatgtgaaatgatgactcatgaaaatgaaatagtacactgtacagaaatcttgcaattctagtttttctcctagctgacttctaggttggaaagcttaaggtcaaagattagtggtgccaaaacatgctcattttaggctaatctctacatttcctactgccagtctctgaccagtttttaaattttctgagctttttggcatgctatgtatttctcttactttgacagaaggatgacatactattcactttgatccaacctcaagacccaaaggataaggttaataaggaactgaatctttcaggacaatgcagtttaccaaacagtagtcagtgactaaatatttttggtaactgattgatgaaagcactcatcaaaaaaccatagtccatggacaagtccatcagaagaaattaaggaaaattggaaaaaaggaagaatgaaggggagggagggaagagggaaaagaactaaaggaaaaatgaacataaaaccttacatgtagttgaggcacaacaatggactatacgagaaacttttggcttgtcagtgaatacagcttgtcaggcattatcaagtgtaaatcctcttcccccccacttttcccgctcttgataatgacccaagcaataatattttatgcaacaagaatgacttaaataagacacctatgaagaaggccacagatgacttcataaccctatgcatatgtacatacagaacccacatggagtgaatgttgcctattaacaaaactgtgaaatctgagttagaaacaaagctcagcttggactgaatatataaaaaaatcagtgaacagaagatattttcaaatggacacttacataaatacagcattccaagggaaaattccagcctcagatgcacttatttcatgaagactcaatattttatagcaatggttttccaaagttaagttgcttaagatctagggtgcttattaaaaatgcaaagtgtctggacccaccctgatctaaggaattataatttccagggatgagagtgaaaatctatatgtataacatgtactccaggtgatcctgacgtaggttgttttagactttatttgagacacacactctccaatgtacataaagtcaagaaccagattcttctccaaccatttcctgcagatagtcacaccagccttggacatgccgggtcatccaattcaattattaaacacaatgtctttcatttggagagatagaagattgataaatctagaaaaagattaggaatgatgagatgaatagattatcaatagatttcatgaaacaggttcgattcaatttgggccttgaatgatggtagagttaattattttggcaaaggcattgaggtataaaatgtttttctttaaaactgttagaatttattattaaaatgataaacttctttatcttttcagctggagggcttagcaatgcttccagcacatatgaaatcaccaataactcttagttgaattagtaaattacatgaccacaaaaaagtaaatctacttaaaaaaaacacacaaaatcccaccaccttgacaaaacttcatgatttttgttgatgatgctgttgttttgatttttatttcaaattcttcatttcttatttgtatagtttgaatagttatagtaataaagatataattttctttggttttataagttatataatggcacatacattttccatcttgatttagaatattcataattattctagtagcaaaagaataaataaaatggatgtattgtaatgtacatacctattctgtgttttttagataatggacgcatttctattctgcatttctgctttgtaaataacaattttcttcctttgtatttttttcataacataagtgaccataaatgagattactagactaaagacatagtgtttttatagatcttgaaacaatctgttaaactacttttcaaaagacttgttctaattttcacattgtctcaagcatgctatgttctataacatctttactggcatgaacatgctgtcttttctatctggggacgcccttttcccatttaaataaaaaatcttggtaaactcctacacattgttttgtactaagctcaaatgctattctttcttgcagcctttccaaatcctctaggaagagttagtcattatttccattgtgtttccatagtactttgtaataatactatttgggacacttattcaaatagctctgtgtttgttatagtttgtatatttcttttctttttcctagattattagcaactcaagggatgagccgctgtccacttcatctttggaacatcagcttctagcacaggggctggttatattagacattcaataaatgtttgttaagcaaatgaggaataaatgagtaaatgtcaatgtgatactcaagtcaaaatctgtggctgtatgttgggtaaaaatgctttctttccttaagtcttttataggtcatttagtactaggaacatttatatttttacgggtcttttaaattatatttttatacttttaatatttatatattttgtaggtctacatttttaatacctttgctgatgactttcaggcttagatagcacaattctatgatatgctgtgagtcagatctttgagtcctttagataatgacttttaggtattctggaatcagaaaatgtctttttctagttcatacagaaacaacttttgttaattaagtgttaggactagtaaataagattagaaaccacctgtggagaacacagcatgtacatggccccactgtagatggaataaatgttttaaaataactgctgataaattatttaacaaaatataatcaataattattctaacatatatcactgtgcattttgttgcattacatatattctctcattttctctctaccaaaactggtaagaaatacaaagactggacactgtggctccttcctgtactttgggaggctgaggcaggaggattacttgaggccaagagtttgagatcagcctgggcaatagagtgagatctcatttctactaaaattaaaaaaaaaattagctgggtgtggtaatacagcacctgtagtctcagctactcaggaagctgaagtgggaagatcacttgagcctaagaggctgaggctgcagtgagctgtgatcatggcactgcactccagtgcggtcaatagagtgagacctggtttcaaaaaattaagaaaaaaaaatcagaaaaagcaaatacagacaaagcaagtataccataaatgtaatttgaaagataagtaatctaacacacagaaatgtggctagcaagtggaaaaatcagaaccagaattcacatattttaagccacattttagccttcattctagtaaaatcactacacccaactgaattttgctaatttcaaactgagaaaatgagatctgacgtcgtataaactaaacaggtgttttaaaaacaaacagaaacttctctagcaataaaaactttttttccaaaataatgcttatgaataattcaatataaaaaacaatatcagaggactcatattgaagtgagtggccagtgaaggggggctcctttctctcctcttttatggctcttggtagttcctagagcttgcactcaggaaagcactgtattgggccatttctttacttagtcattcagtcattaatacatcttacagcctaactaggtacaaagaattgtgggaaagataaatacaagacaaagtcctttgagaacacacaaacacacacacacacacacacacacacacacgatagtatattataaatgccacagaagttatattgcatagtagtaagcattctgaaagttcagagaagaatgatgtctagtcccataccctggattgagttccacatgtccacctaaggacacacagattttgtttcttatttggtgacttggtacaaaccatttaatctgcctatttgggcatccattcctgagaaataaaagtgatcaatgttgccaatccaatgcatgtaatatgtgactatagggagagaataacttagtggagagaatggggcagtgaaatcagacagatctggttttacagctttggcacttagattgagctagttagttcaacttctctaagtcacagctgtttcacccataaaatgagagtaacagcaatatataccttttgaaaatttccataaggtatcaataagataaaatataacacctagcagagaaactagcatagattcaatggtcaataaatagcagaaatccttattaactattaagatgaagaagttacatctaggatttgcatagactattttgattctacgattcaataaattttatttttgacataactcattcaccgtggaagaaattagtgttctatatttaatgaagaccaaagactttggcttggtaaatactattcttagaattttcctccttttcaagctgtatagattcatgtgaagcctggaaaagacgctactatgttttattttgcaatgcactagattttgcttgtactctttagaaaatgttaggctttatttcagtcgtcatttgtgcataaactctagtcagatcaagcaaaaacaatgaagtcattagtgtgcactgagtttagtcacttctttaaatgctacattaattgctttgagattctctacttccactgtgacaagcaagacaaatggagtttacctgcaggacacatcaccagtcaccttcccagcaagctggctacaacctcatctgctccttttcacttaagaaggcatactgtcatgcaaatgagtgagaatgataacacagacaaaatcttgaatctacattgcttgatatttacaacaaaaaaaaaatattcactcactttggaagttaaaccattattagtaatactgacaacacatttcacattcgatggggccataccaatatgtaacaatttatggtacagaatcacttcatggtatgacccaaggaaatgtacttcatttgtggaataattaaaagtccatcctttctgtgaagaaaatgctttatactctgaagaccactatcatgaattaaaaaatccagtatcacaaattgtagacaacctaaaagaatgttaacttaataatatgtgacttcgatctaaatgaagtgataaattggccagaaactcagatgccacagggcacatatgttacataaataatcacataaataatctagcatttctctaaagcagcgattctcaattttggtcttagatcttattgtcactgttaaaaataattgaaaactccaaagacatacatattgtttatgtagattacatatgtggatatttactctattagaaattaaaggtgataaaagttaaatatttaactgatttaaaaataacaataaacccattaacataaatttaaaaaggaactacattttcaaaaacatacattttaaagaaaataatactgttttacatttttgcagatcttttcaatatcttttaaattagaagactggggctcatatttgcttctgcaatctattgcaatatttcatgtcatgtagtctttaaaaaattccactgtatccttatgaaacaatgagaatgaaaagggtaaagttttttctttttttgttgacatataataactacatatttatgagatacagagtgatattttgatacatgcatacaacatgtaataatcaaataagtgtaattagcatatccataatctcacacatttatcatgtctttgttttgggaacactcaaagtcctctcttctagctttttgaaaatatacattaggttgggcatggtcactcacacctataatttcagcactttgggaggccaaggcaggtggattgcttgagcccaggagtttgagaccagcctgggcaacatggcaaaaccccatctctacaaaaaatacaaaaaattagccaggtggggtggtgcacacctgcagttccagttacttgggaggctgaagtgggaggaccacctaagctgggcaggttgaggctgcagtgagccactgcgttccagcttggctgacagagtgagaaaaaaaaaagaaaatatacattaaattattattaaccatatttaccctgcagtactatagaacactaggacttattcctccttatctaactgtaattttgtatctgttagccaacttctccctattcttacttccccctttacctttcccagcctacaattctgctctctatttcaatgagctaaatttctcttagctcccacatatgagtgagaacatgcagtaaaattttagtattattttgaaaataattttgacctcactgaaaaggtcttacaacactcctttcccctgtcctaagccttggcctcccaagacttctagatcatattttgagaaacactgctctgtttttataatatttagagcatatattatttattattttttgtgtctaatttacatatatgtcctattgttgtttccctatttgaaattttcctgatggagatcatcattacaaaccttaggtatcactttacagcatgtggtaagcctgcctggaaccacagtgtacctcaacatgtaatattgattcaatgacccattgatagattgaagcctatagtgtcttatggtccctttaatgacctttaaaatatgtgatatagtagtatttttatagtttgtcaaattttgagcccattatgtcaacattctacctaaatagaaggatgagctaatcatacataaatttattctagatgaaacaacgtttttttttttttgactcagctgtgacttttggaaaagaaactagaattctagagaagttattattatacatttttttcctataaaatttatcctaacatatcaggcaatattttaaggtctaatcaatttatatatttagttgtaatttcacaattacaaaacaattgaaagcaaaaatatgaaaatcatcagtttgaattgatttgaagctatagtttcctatgtctatgagtggaacaaaaaaagtaacaaatattacttttatgtgttctactgccaaatcagatcctttgaaaggcacccacttagtaacttggaaatgaaacatttatacattcatccctgctaaattgctgcaaaatgtgatggttgggaaatatatattaaagagtgaaacagtcctcctaaattaaaggttttcttacataataaataatttctttgactctttgaaaatggttccattatctcctgatctaggaaacccacagagaaagacttagtgtctgccattaccttggtaatcagataattattctgactattctatcagaaaaaaaaaaaactgtacatactgaaaagaagactctttcctgctaaaatctgggtaaacaaaatagctgctagactgggaaacaaaaagaggggtcacagatctgagttgactcttcctttttcatgagtcataggacagcagatatactagttgtcttttgctttcagaagagttttacattacctaaactcatggctgaatcacaaagtacatggccagaagacttagtgacttagtaacagagttctcttagacattttaccctccttaaactaattttggtcttgacacagttaactattaaaaaaaaaaaaaaaaaaaagccctgaagcctgcctattcacctctgatcactgagaatgaattgaattatcaccgtacaaataaatttgggaagcaagataatgggagggaaaagagatgattaatatttgaactgtaaaggatatatgtctgaaatttaattattaacaaatgtgcattgatgcaattatgtaccattacatagcagagttaagaaatctaaattaagtaaattgcaaatgctataactaaacttataacaagttattttaaaaattaaaactctcatcagttgaaaactatatccaacagaaatcaggcaggaatttctaccacctgttcatatgcatgtacagtgggaatctgaagcattgcccagcacaatgtggcagccagactctagattattccatttgagttctgagtaactgtaattgtatgctattttaagcttatgaatgctaagattgtttaattcttaataagctgataggtagcccttaattgcatgatgaaaatccaagtccaatggcttgtgtgccacttgcctataaaaagcaaataaaggacttacatttctggttcaggttgtaatccaccaagtgaaaccttggggtctttaagctaaggatctttacttgaaaatcactgttttatagcttattaaatttccatgtcaaaaatatcaaagaagtcattcaacaaacatgtattgggtctactaagtggcaggtctctttaggactctgcagatgcagtagtagcaaatgtgataacaaggctctaagtgaattcatcttctatttgaagaaagtcagaaaaccaacagccaaccaacaaaccggtcaatgcactccagggaaagaccatgaggagcatacctttacttgaacaagtgagtttattaattgttgtagcaaggaagaacacacaccacacggagccatgaagtatcttagtaagatactaagtaagggcattagtaaaggcatattaaaaagaattcaggcttattcggtgattctggggagggtttaagaaaacaggactttgttctgtactggatgctgccagaaagtagaagcaattctaggattggatagctcaataaatcttatctatagcaagagcagactagagtgagaataaagttatgattggtaggaaagtagtattcaacttaaccaataagatggtttgacattttgtgggttatatagtgacaccaatttttatctgttttttaatgaaaaaatgacatagcattattttcactcactttattatggtcttagtgtgactgtgtttcatgttggtactctatgaagttatttctctctaatgggtgaacaatatcatctacctgtgggctccaggccagcttctaacaatgctgaggcctcacttacggattagatcagttcccagacaacaggggctacttttccctttcaatcatgcaaccagccaagcaataaatttaaaaaaaaaaaaactatcaaagagtgatagaacatagtaaaagggatggccctttatattgggtgttcagggaaaggctgttagatttgaacaatcagaaggagccaacatatgactacagggggaaaaacatttctgtcccagtgaataactactgccaaggccctaagataagaaagagtctgagcatcaaaagaaagacagtgtgatctaagaatgatctaagagcacagcgaggaaagacaaaaggaaggagggagagccaggtggccagatggaagttgtgtagggtaggtagggtattgtgactttattctatatatgataggaaatcattgaaggttgtaagagcagaataatgacataattttatttatatatttaaaagatcatcctgtatgttccatggagaagcagagatgtgagtcaggaggttttgcagtttaggcaagagataatagtggcttgccacaggtattggtggtggagaaggcagagctgactgttctgaagtcagtgttcataagacttactgataacatatcagtaagtaatttgggaagtgaaaagcaggaagaaatgagtgaaggatgatcttaatagttacttggttcttaatgtcagtgataatcttattcatcatgttattcctaatacctgattcacagagggcactagatatagaatgaaagaataccttttgtagctaatgttggcactattagcaagcttcaaaagtatctgcatttattaatctccagttggggtttggttcctaatttcttctgttgatttgcagttaactcagtggtggtagcaaggtacaaaataccccaggactacacagaacaacacaatcaaggtagaattgacacaaataactcctaagaaaatgtttcctacatatagagtaaataatttactaaacatgcttaaaataaataaatttggaaaaaaataaaataaatagaaaacttcctcaaattgataaagaacattcttaaaaacttattactaacatcatatgtaatagtgagaaacttgacacttctccactaagactagaaacaagacaaggatatctccctttcaccaactgtttcaacatcatatgggaattactagctactgcaataagacaagaaaaaaatagtaggaatacagattcagaaggaagaaataaaactatctttgcttgcaggtgacacaattgtgtatgcagaacatctgaaagaatcataaaaacctcctggaactagtaaatgattattgcaaggtcacaagatacaagtttaatatataaaagttaatctctttcatatataccaacaatgaacaagtaatattcaaaataaaaaaaacataataacatttacattagcacccccccaaaatgaaacacatagatgtaaatcaaacaaaatatctaaaaaataagtagttttcttctatataaggagaactacaaaaccttgaggaatgaaatctagtaagtaaataatggatagaactaaataaatggatattccatgttcattattattgtcaaaatgtcagttcttcccaacttgatttatagcttcaatgcaatcccaatcaaaatcctggcaagttattttgtggatgttgacaaactgattctaaagtttatatggagaggcaaaagaactggaatggctaacaaaatattgaaggagaagaacaaagttgaaggactgacatcatctaacgtcaagccttactataaagttataacattcaagacagtgtggtattaatgaaggaataggcaaatagattaatggaagagaagaacccagaaacagacctagataaatataatcaactgatctttgatatagagcaaaggttacataataaagcaaagatagtcttttcaacaaacggtgctagaacaactagacatccatatgaaaaataatttagagacagacaattgacaaacattaactcaaaatggatcaaacccttaagtgtaaaatgaaaaaccataaaactcttagaagacgacacaggagaaaaacctagatgaccttgggtatggcactgactttttagatacaaaaccaaaggatgatccatgagagaaataattaatgagctctacatcattaaaataaagaaaaaacttttggaccgggtgcagtggctcatgcctgtaatcccagcactttgggaggccaaggtgggtgaatcatgaggtcaggaaattgagaccatcctggacaacatggtgaaactccgtctctactaaaatacaaacaaaaaaaaaacaccccaaaaacaaacaaacaaacaaaaaaccaattagccaggcatggtggtgtatgcctatagtcccagctagtcgggaggctgaggcagggaaattgcttgaacttgggaggcggaggttgcagtgagcccttcctgcctagcaacagagtgagactctgtctcaaaaaacaaaaacaaacaaaacaacaacaatacttctgttatctgaaaaactctgttaagaaaatgagaagacaagccacagactagcaaaaaatacttgcaaaagacctatctgataaaagactgtgatccaaaatatacaaagaactcgtaaaactcaacaatgataaaacaaaaaaagggccaaaatcttaacagacacctgaccaaaaagagatatagatggcaattgagcacatgaaagatgctccacattatacaccatcagggaaatgaaaattaaaacaacagtaagatatcattacacgcctattagaatgaccaaaatctggaacactgacaacaccaaatgctggcaaggatgtcaagcaacaggaatgctcattcattgctagtagaaacgcacaatttcacagccattttggaagagagtttggcagtttctaacaaagctaaacatacttttaccatacaatccagcaatcactctgcttggtatttactcccaaaagttgaaaacttacgttcacacaaaaacctgcaaagagatgcttatagcggctttatttataattgccaaaacttggaaccaaccaaggtattcttcggtaagtaaacgggtaaataaatggtggtacacccagataatggaatattaatcattattttaaaaaatgagccactgaaccataaaaagacatgaaggaatcttaaatgcatattactaagtgaaagaagccaatataaaaaggcaataatatggtataattccaaccatatgacattctagaagaagcaaaactacagagacagtacaaagttcactggttgctaggggttttatggataggatgaataggcagaacatagaggatttttaggtctgtgaaaatactctgtatgacactataataatagatccatgccatgatatatttgtccaaatccacagaatgtacgacattcatgtaacctctggcctttggttgattatgatgtgtcaatgcaggctcaccaattgtaacaaatgcactactctagtggagggtgttgataatgagggaagctatccatgtatgggggcagggagcataaagaaaacctctaccttcctcttaattttgctgtgagcctaaaactgccctaaaaattgtcttttgagaaattaaaagacatttagaaatcatggaaaaaatagaaaaacgtaaggcaattgctcatcatagcagataaaaaatccaaaggttctgaattctgtcccaaaataccctcaatagggtgtccacctttacctcattaacttatttgaatggtacatttgtatctcttgaagaactcttagaagaactggctgtggtgatgttttctgccttctgtcaacctttcaaaatcacatgcccatcagatggcattctcaaatttcctgccctgtaccccaagagaactgtcctcaggaacaatacagaaactgcctaactaagtatagtcaataaaccactgcttcagaatcacaccggggatcctctgtttcccttcacaagcagagtctctcaggaagcagtaatgaagcatagtacgggggtgctcctccttaatgcctatgaagactcataattggaacccaaacttgctcttcaatgtgttgatgactctgcagacaaacctgggcttctctggtgtgctttcttattgtggaaaccaacaggtcaaaatattaatatgtgcaggcagaaataggtgtagaatataagcaagaggcctctttctttctctattggtatgtttgaagcaatatgactaatagacgaatccagtctgttttagaggtttagtttgggaaagtccttgtaaggcattaaaggagtagttttaattcacagataatacgacactcagatacaatgccagaatatccaaaataatttattgcattctacacccatggattcctgaaggttagagtatatttaaactacaccggtaagagttgttgggaaaaatacaagtatctcagagatcacatggtcacaacctacctataaggacctcaagccatgtaaaaacatcacagctgagggaactacttcaaggaaacaaagacagaacatggtcatcctaaaccccagaggcaaacttacagccattaaatagactcctttggccagtcatgctcattcattctcatttaaaataattatttgatgatacagtcaaacaagaaagtattctgctttttgtaaggcaaaaggtgagagtgaatttctagaagttaataaacaggttggtagttttcttccactttgctcataacatcatggaaaaatcactgaagtgtgagaaacaggattctgtcacaccagtgcctcacatccaatgctgcgagagaatgaaatattgacaatttaggtgtagttctcataatttcacccaactcaaaggaatgactgaaacactccttgataacaagaaaacacctgaggaagggagagaaaataatcattctctccaaccttctttgcacctttcgatttcatatagctaaggatacacatttctcacagtgattgaagagggtggcaacatctgtcaaatctgtagagtcaagacatgaaattcaattttaaattctcagtagaggagaaaaatgagagaaaggtaacttgtaatttcttccaattagatatacaggaataactaattgaaatgaatgttttataaaaaaccttcttttactttttaaaaactgaatttctacattttaataacattgtcatgtgtaattataggggtgttgaaattttgtttcctcttttctgagccctaagtttgccttctgagagaaaatcttgaaaatgtagtcatattttaaaaagtggtaaagcctactactgttcatatcattttcaaccatcagtagaccttaaagataggaaaagaggccgggcgcggtggctcacgcctctaatcccagcactttgggaggccgaggcgggcggatcacgaggtcaggagatcgacaccatcctggctaacatggtgaaaccccgcctctactaaaaatacaaaaaatgagccgggcgtggtggcgggtgtctgtagtcccagctactcgggaggctgaggcaggagaatggcgtaaacctgggaggcggagcttgcagtgagcggagatcccatcactgcaatccagcctgagcgacagagcgagactccgtctcaaaaaaaaaaaaaaaaaaaaaagataggaaaagaaagaaaatagcctgtacttcaagtatgaaagcaccatgctggatagtaaaaaaaaaaaaaaaaaaaaaagaaaaaaggatttagagagcctaagtgtatgccccttgggtctcatgactctgtcaaaatgacagggtgatttccagaaattcattaatcctttcaatgaatatttactgagcatccacagtgagcagtgatctgcacaggaagctaggagtgggatggggtgagtatgatgtacaatgataaatgagacacagaaaatgcctttgaggaccttatggtgtagaaggggagaacacatactttctcctaccttgtattaaaattatttgtgtgtgagagtcatgagaagtataaataaggtattatgaaagttcacagaggtaaaaaattaattcttacagggaggaattgcagaagtagaaataactgtctttgcctggaaggatgaaaaatctcaggacatgtagagaaggtagaagaacattttctttgaaagggatgggataagcaaggacattaaaaagatagcatggtgtacccacaaatcattcagtttacctgaatcaagaggaggacaggaatggaaaggaagattggggatttacatagtatggtaggctaaatccatctactttctaatctctggaatttttaaataagttaactgacatggcaaagtctttgtaggtataattaagactcttgagttggagatattatcctggattgtctggtgggcccagtgtaatgacaagggtcctttcaagtgaaagaataaggcaaaagaatcagagtcagagagagagctatactaatggaagcagggatcagagtgatgcaaggaaggggccataaactgaggaatgcaggtggcttctagaaaatgaaaaagacaaggtaacatattctcccctaaagcctccagaaggaatgcagctgccctgcccatccatgctagacttccaacccctagaactgtaagcaaatttatttgtgctgttttaagccactatatttttggtaaattgttacagcaacaggacacagatatagagtggaatgttttgaatatactacatcttagtccaaataattatttatccattctctcttggtgtacctcaacttttacttattatttcattacaacatttatgttgtattttttatttttataaaatatatttgcctgtctgcttcgtttgagttataaagaaggtgaaagtactactaacagaatacagaaaacccacaaagagaaaaatatttaaaagcaagatgctgaaatctttttcgaacacagtacgtttgaaataccaatgggtcaacacggtgggtggacagttggagatggaaattcatgcctcctgcttgaagataagagcgcatatctcttggaagcaattacaaaaatttattatagctcacaaaagagaatcattgaagtgtgactattgaccattgggaaaatttaaatagtatgtattcatgagaagggaattatttaatcagggtattttgacataggttgctggaagaagtgattttatattaagtattattagctaaaatattatcattttaactacctgtgattacctataggcaaggcataaggcaatctactggagatgaattcacgaatggagaaaaagaccttttaaagaaaagtatgtcatctacaagtttcttggtttttgaaatatctctagcaggacattaatccctcaacttctcaagtattttctgagtatctactagtgcaaggtaaggtcctttattcatttttatcctaacatagcctttggctttgagaagcttattgtctccttgccatgtaaagttgtgtacttcctcaaaatactagaaatttagaattttcctaaattatgattttccccaagggtatataagttttaagtctcaaaagcatacatggcctatcttacagcctgttcctagagttcatctctctaagatgagtctgaggtcactctctgcctgggaatctgaggaagctgggccgccggggtgcaagggagacttcacatagggaaaggaggcaaggaaggcttaaagtgagggcaataaaaataacctttacctgtttcaagtcttgggttggcccagactaccaccacttcagggatttttataaaatgctgctgcattgcttttgctaaaagagagccaggtcagcagagtgggatgacctttcccaacagaaatgccatgatgtttagccatcaagcagaaatttcagggacaataagatactgtagtctgcatgcttttatcccaaagtgaaaaccatagaggtcaaaaatatgagttaagggaggaaagaattaaaacttttacctgctctaaactctgaaaagatgatggtgtgttcatccctgaaccttgtctcaacacaatttcagagaactataaatgatgcctcctaacagactactatatgacccgtgactcctgaagtagtacaatgagaaggataaccttcaccacttgcaaatcttaatgcccatgtatatacacatgtacatatttttaattgtaaaatgtgtgtaatgaattcccttcaagatagggaggatataatttcccataatatgtacttggttgctttttatatttttttagaaacgtcaaacttttttcaaaactttttttggaaatacccagtatttttttgctacccaaaacacatgtgaattggagcatacttctttatgtaacaattaaaatgtaaaatgaaccaatttttgctgaaaaaccaatctgaaatgcagtattcacttccctgccttcttaatcaaaggatgatggacataatttaacctttttaaaaaaaataatgtcatggctttcattattatgaatgataattattctacgtcgctgcgatacacagagacccttagggattgctgtggtgtatggagcttcttgcctacacgaagtagtgtaggtgctttttgttttttcattttgagccagctgttcataaatttttctctgtcttttctcactggcatgctgtatgtgggttgccttttttactactgtcgttgtagtcagtcttcctgcttccatcaactcctagccaaacaaagcaagacattcccagtgtgccaaagctcaggcaaattaccttgtactagcattttaggccgatgcttctcgtactttagtgtactacaattaatctggggatcttcttaaaattcagattctgctttggtagctctggaatgggaactaaaaatttgtgtttctatcagcaaccaggtgatgcctttgctgctggtctttgcaacacaccttgaatagaaagatattagctatcatgactttttagaattgtgtctagattaaaagaaaatttgttttgagggagtgattggctactctcctataaataagatctaaaaatttagaatatgaattttaaatatgctatctccaaaatgactttccttatctttatatccctgacaccaccacataaacatatttcccttctctatactaatatagcatttaatttcttcctctcttatggaatttatatatttataacttattatttagatataagtcaagtactgaacatgaagaggaaccaagtcttacatatctgtattttttgaaactataccttgctcaaaaatggttgttgaataactgtagcaattgaaagctataaggttctttccgtataatttcatattctttgttgcatcaatttttcaaataagtaatcaggaaatgagacaatagtataataaatcagtataaatttcaaattaactgttaagaaagtaaaacatgttttcagagttcctgcctctttgtcgtatacttatttcttcaatttgcctcctcccaccacacctcatagaacacacaaatagatataaaagcacatacaatctaaacatatatcatcttcatattctttaatttctaaaaccttatttcaagaaagggcctggaattaacttacactaaaatgtaatgactaactgcagcataaagtatatttcctaccttcaccccaagaagggcttaaacgttttaatagaaatcaaagcctacatagtggaatgaagctgtggaagaagatttttcggtttttaatcataaaacaaaaggtatattaaatagaacctctcctaatactctcacattgggtgatgtttgcactgaacttcccctaactgagaattgctaatccacagctttcctgcacctgggctgtaaagttgctacatagtgataaactgcttgtatcctgatatgatgaactaatatgcacagaaaatcctcactaaaagtgcaagctatagaaacagtcaaggctaaagcagggcaaacacaaaagtcaatttggcagctcatttgaatctacattgtgcttctttccaatggcagacagaatttatcatctactggaaaagaataaaacaaagccccaatttccattaaacatttgtgtaataaaaagaaatggaaattatataactagagataattcaaatatgtaaataaaattgtcaatggaagcagacatcatcatagcttttgagttaatattatgtgatatccattttactaatttcatccagcacacaaatttgctacttatctcacacctctaattaaattagtggccacctacatgaaattcagaatgcactcaataacaggtgcttagaaggaaaaagtgaggcataaaataagatagtcaacataatttacacagatttatataaagttgctctgcatcaacatattcctaaacaatagagattaataagaatatgactctagataatagtcccagagtctagagtcatttctcttgttaacaggatatcaatgtggtgaaaagtgtacaaagggtatctggatctgcctttcctgactctgtagattgttcgctgtgaaaatggctaggatcagctgagaaatctgagcataaaactggtgagcaaggcaggctggaggtacagatgagttctggctgagatgcggtgcagacagctataaaatgaagttcttacagtatttgctttcttggtcatccaggggttgttcaattgtgaaagtcagacaacacggccttaatttcagataagataaaagtcataaaattgttattttcttcccacaacaaaacaaacccaacaagtcagcatattttgctcaaaaggaaagagagaataggtactagcttggcagtgccttacaaatctcagaccattgtagtcagtggctttagcatcaaagggacctgggtttgaagtcacagcccaagaaagcatggctgagctatttaacatctctaatttcagatttcagtgtccttatcacaaactgtggatggtaatctttatctcacagagaggttataggataaataaaataacatttatggattgcttagcaaaatgactgctcaataaatagtatttataactgcttacattgaagacaatcatactgaagtacaaattttatgatcccttccagtttatctgaaaattaaggagatgaagtgaatgcatactaaaattctttaatcaccaggggcttaaatattaaagtatgtaaagcatttagggggtatataaaagagtaagctattatcacagtgagccacagaatgtgttaagaagatagactctggggccaaattatcgcattcacatacctattctgctgctgcccagctgcgtgctttggatgagtaacttaaatgctctctgcctcagttttctcatatgtaaaatgagaataataacatttaatttttaaataaggtaaaaacgaaatgggttaataaacataaataagagattggcacataccaacttctacgtatttacatatatatgttttagagcacacacatactgttgtaaacagaccttagactgataagtaatttctgcctcctatatctacatcttattggaattttctccctttaagcgtggacatgacctgtgacaggcttctggccagtataaaatggcaaatgttaggctatgttataaagactccatcttaggagaaaggagtgccagactctcctgctggccttcaagaagcaagcttcttgatgcaagctgctaatggagagggtcctatggcaggcagcctctaagagttgagggcctcagttctccaaccagaaagaattaagttttatcaacaaccatgcaagcttgcaagagggccctgagctctagaaaggaatgcagccctgccaattctgtgattgtagtctagtgagagccaagcagaggacttagttaacctgtgccccgacttcagtcagaccacatgaactgtgagataacaaatgtgttgtctagagcttgtaagtttgttgtcattcattacacagcatagaaaactaatacacatacttccatatagaattcagagaaaagaaagggaggaaacgaaaaagcttattttctcagtgctctgtcttagtttcaggctgagcagccttgacctggccagtcattgctgagtctatcattgtaaagtacatttaggacagaaagatcttactctagtcaagatttctcctataggccctattttagcctctggccttcatgaatggcaagaatattaggatgtcagtgatagttgtttttccagcttcagattccagttaaggaattttagcaaaacaatatgaactagaaacctttttgagagtgggaatgagagatcaaaatatttgtcttttaacgtcaaagtttactaggttttgctgacaaaactaatcttatgtattactggctttctgatgagcttctgtcatccttccctcatttttctgccctgctctgtccgccattcccgagaaatagactaggagtcaagggatctgtgtacaagtttaagcttggcttgtagttagttgtatgactaaagatgataaagatgagccagctcaactctctcttctgttgacctgaaagtgttgggatgggggaaaatagatgaacaataaatgaaaataaagttcttgagaaaagttacaagggcagaacaaatacatgacagtaatgttacaaaacagtcttgaaacctcagaggaatctaggcaactcttaaaaagcctcaagccctttccaaagtatgaacctgcttatgatttagagtctgggccaaaagatttataggatttgagaaatgagaaataagtttttctctcttagacaactcctatataaaagcagtggttttcgagatagttatgttctaaggcttggtggatgagaataccctgattaattatgcatcaatatggaatagggtccatatataccacttctgtcattagtcccttctgtacctacaacaggtacagagatgagagatcagaggcttggggaagagaaatagcttgttaagattatagagctagttactttcagctgtgggacataattacaaaggaaatttgtacatttggttattcttgttaagtatctctatttgtaatgccaaacacaaatttttgctacttcaaaagctgttttatttcttaaatttgtgatgtctctattatattttgccaatgtgaggaaatgagtgtctaatcttgtcaatgtaatatttattctcaattcctgctatattcattcctcctaatttgaaagttgataaaatctgttggcaacctccttgaagctgcaaagcagttactcaaaacaattttcagaatgttcagtataaatgggcacatgaaccattcttgaaaaccgatgtgcctttttgcttcacatgtttaactaaagtcggttataaattttaaaattatttatttaactttttcacatccttgttttaaaatttccataccataatacagtgttctttcaggatcacatgtgaaatagataatatttccaacatttcatgaggagctatggggaagaaatgatgagcaattccataaggcactgatagacataaaataagagtacatactttcatgtcattccagatagaaatatcaaagatggaacattttccttccccttgacttaacagatgcccactctcatttagaactatttcctgacaatgaaatctagttggagagatacaacataataattcaaacacattgaaataagttttgcactgaggtaaaaaagccacagggtatgaaaaggcatggtgtagttggtgaaagggaggtgaggtattacttgagtaaaaagtttacattggtggggtggcagagataaaagaagatggagatagagataggcaggagttagatcatagtgaaagtcttgtagttattttagggaacccaggaagcttaaatctatcaatcaggatagtgacagggtcagatacatattgtagagacactcttgtgagtaaggaaagactcatttataataaaatatttgtggtagtccatatgatttggtcattctgcaatacatttatcaatatctcaaaactcacaagaacatgtaagcaaaagttaaggtatatatagagagagtggaagaatctttagtattctctggtgtcaatttgtatgtgatttttaaaaattgtttttggaagcattttattttctgtttagtggttgctgtagttttcttgagtcttctccctactgctaatttaggctatttggcatattcagcctcatggttgcaaaactggggttttaatattaaaacttccattgttcatttagatttttccttctgaaaatttgtagaattattcaaggcaatcttttatatacactttctaccttcctttgcctcccaaatcaacaacctgaaggtaggccgaattaatacacactagttgtggtaataatgtagttaagttgacactgtgagctgtggtctaggcagagaatgttacgtgcagagcttctattgtcttctttctcccaaacacagtggtaggttattcacattcattccttgctacacgcatctagttaaaataacttagactttttcaggaaagacaaactgaggccaaaagctattgctcatctcattgctaaaactctggcaacattttctgaattccacagatccacagtttgagaagatgattgtttaacttgtggcatcatgagggcccaacagtttagaaaacagtgggacagcctgttgccctgcagccaggtgataatccacagtaaccaaaataataacaaatattcatgaaaccactgtctttctttttcagctcattattgaatatttgcactgtatttattatttctgctgcaaagaaagtaagaaattaccaaccaatagatcatgttcttatcaagtgccaggcaaaaataattcttataactacacactaggaagagagtaggaaactggtaggaagggaccaaaatgttatacaacaaaatactatgcacgacaaagatatggtatactatagaaagcagattatttttaaagaagcgatatagacttttctgcaaatgttaaaaattgattcttattacttgagaggaagacaacttgctccaattctaaaatggctttaaatcattttctctttttaccagtcaactgctttcctacaggccaataatagcattaccaaccgggacaaccatgagagtctccttactcacagttgtccaaagcctttaggcttcatactgtggaatgtatcatctactttttaccagcattatcttccagaacctagagcaaataacttctcattactactaaaaacaaaacaaaagcacaaccaaaaacaaaaacacactcttccagagcttcccattacctagagaattagtctaacctcttttatagagtttttaatattctctaaacatctgctcaaaattattcacttccctgcattctaattaccttctgcaccaaattctacagttctcaaacacactgtgcatcttcacaatctttgctcatgctgaagcctctgcctcagacgcatttctgctaattctccatctgacgataacttactgcccttttaatgttagcatttttgccacagttagatctattaattttattggaatcaactttgccctatagagaggtttctgaaagtataacttgccaccggtgtccgtgctattaaaaacactcatgcagagaatgcatgttgacacaccttggttgtctacctcatcagtgactaccattgttcttatataacataaatcaatcctcagtaagtatttgtagacatggaacttcctcagcttgttccctttctctttggtatctcttctctccatcctcaaagctcataatcaatggccaattaattcctcttgtttcggcaatgttcctcttgcctacacaatattcccacttccattaccctagttctaattttcattacctccttcttgaactaccgcacttgcttccttagctattgctcagcttctagtctctcccttcttaggccattttgtagtcagctggtgaagtcattttcccaaagcacagctctaataattccattccctggcttaaaaaacatcaattgctctctaatgcctgcagaccaagtccaaactccttagcaggttttctatcatctgcccaccatttgcctttgcaaacttttgttatacattcccattatactcattctgcatgccagtcattccctgaggcattctgtggagtctctcccattccctgacctgatgtatgaattctctcctttgatctcttaggttactcttttcctcaacattgcctgttgatatacccacctttaaagaaacaaatgaaatgcctcttccacaatgatgtatgtcaagaatgtaattttagatttttttgctcctagagtatattcattgtattgctaaaaatgtattactccactttactactattgcatacaaaactgtgcttgtgattcaaatccccctctctgcagggataaatcatgttttgtttacttctcttcctggggttgggccttaaacagtgcaaacacaaagcacaacttctggatcatcagaacgatttagcaatgaaacaggctatctcgaagatgaaaaatatttgaagagaggctagatgctcatctatgaagatgactgaaggaaatgcatgcactaggcagatggtgagattgcatgaccttttaagtcccttacaagtgtaagtttctgtgctatcaagggaacaggccaggtacagtggctcacacctgcaatcctgataccttgggaggccaaggtgggagaatcacttgaggccaggagtttcagaccagcctggataacaaagcgagaccttgtctctacagaaaataaaataataattagccagacatagtagtgcatgcctgtagtaccatctcctaaggaggttgaggcaggaggatcatttgagcccacacatttgaagtcgcagtgagctttgatcccaccactgcactccagcctgagtgacagagcaagaccctatctctgacaaaatgtggtggtcacattttgacgtttgaggggtcaccacccctcgacaggccctggtatgtgatgttcccctccctgtgtccatatcttctcattgttcaaatcccacttatgagtgagaacacacagtatttggttttcggttcctgtgttagtttgctgagaatgatggtttccagcttcatccatgtccctgcaaagaacatgaactcatccttttttatggctgcatagtattccctagtgtatatgtgccacattttctttatccagtctatcattgatggacatttggctgggttccaagtctttgctattgtgaatagtgctacaataaacatacatgtgcatgtgtcttttatagtagaatgatttataatcctttgggtaaatgcccagtaatgggattgctgggtcaaatggtatttctggttctagatccttgaggaatcgccacactgtcttccacagtggttgaactaatttacactcccaccaacagtgtaaaagtgttcctatttctccacatcctctccagcatctgttgtttcctgactttttaatggtaagtgttattctaactcccaatgctgtctacctaatgtgaaagttcaccattctaagtaaccagtcctggctttgttatgaaatttggatgctgaatccaagagattaacaacatgatgacaaaatttacttattctctttaaatgtgtataaccatcaacaagagagacaagattatttatacatcaagatccttgccttattaatttcgtctccccaagtatctagacattcccaaaataggaggttcaatgttttaaatagcattgatacatggttttccaagtgacttgggagtatgatgacatctcctaagcaagagtgattggacccatgatgaattcagtttctaatgaacagaacactagagaactgggtttggatctaacttttggttcttttctatatcctcttggaggtagttagcttcctttactgtttagatgtggaaagggccttgtttgctaagtttggggaaatacaaaaagcttggcagtcaggaactaagcaggaatccaatggactgaaaactcctttggagaaggatgccattttttttttttttttgagatggagtcttgctctgtcacccaggctggagagtggcatgatctcggctcactgtgagctccgaggatggcatcttatggttctttttgattccttcctccctagaaaagtccagaatatgactctgaacactatgtaagatatgcacatagtaatgaaaattaattgacaaaattttctgtggaatctcaattgccttgcaagaaataatacaagtgcagatcgagtttttaaaaccctgcataggaaggagaagaaaatgaacattctgcttcaggattggagttttctttctgatctgctaattctacaaagtatataagattactcaacacgttttaagtggaaagcaacaagcttactctacattatagtagccataatgtcactagggggtgtatgtttggttgtgagagggtgttatcaatgttaattacaaagtttttaagagttgataaatttcttcataaaacaatgacataaaatatctcttcaaggtaacaaatcctgagagtcaaaaagctcaggatggtttcaatcaataactttataactaccaactatttgtttttccaaaattattaattaacaactaagaaattgctgaaagcctccttggagcatttttacaatctttgtatagaagtaaatagtatttatgatagtatcgatatatttggactagactttaccatggctatgggacctgctatagttcttgatgatcccttgtcatgaatggaacttaggtagctattgtcacaatctctgcagtcactaagcatagaaagtcctcactaaatgcactaagcatagaacgttctcactaaatgcacaagattcaaataagatggtattttccaattccttcactcagtcacttatatgagggctaaagccatggtaacatagaggctcaagtaacttaaaaaataacatatttgaaatttacttgctggaaagggacaccccaccttgattttaatgaatttcagagcaaatacaagctgtcctcagtggctttcatatgaattccctgcacagtcttcttcctttagaaatgcaaaaactatttcaagatttttatgcctgcatggagaaaattgctattgtgtacaattagcatatttactaaggtttgtcattacttttggtaattaaaatcgtacaaaaagagagacatatccaattcaagaaaattacacagtacagtaatatacaatcataatagtcgcctgacaattattaaaatacaccaagttctcccttacagtaaaagtattcaccagagtagcttctgaataagatcattgcagtgctttctatttaaatgtttttctgcacagaaaattataattacatttgcataactactgtaatcaatctagaattatggctgaaatttttattcttgaaatcactgttctttctaagatagtaggagctctgaggcataatctaggtttgtgggccattattctaatttgtaataggattaaatatatttttgcactctctttacaacaatcaatcactctagagacatagcagacgatacaactacatcacacaatttgttttcttctgtcttgaaaaaacaaaccaggctttaatttaccaaatccattttgtccaaaaagcaaaacaaaacgaactcaagttaaaaaaaaaaagtcaaatttataaaaggagaacaccaaatattatttcatgaaacagactcaataagaagtcaagcattcatctctacatttagatgctctgtacttactgagattagctgggatggccgagataatttctgtcccatcatggaaatactggctaccataaaccaaagatttcttttgaatgttctcctttactcctgctgtattcaacaggcttccttggagcctgatgttattgtcttatctttttaaaatatccaagtcagatctgatgaaaacgataagcagacctaaatacattaatctgcaaccagattctggtagagctagccttttgcaacgataactctaagaaaatgccctgctagccccttcttctgaccaatgagctgataatgtaagaccctcacagacaccatctgcatgcattctctctcaggagtgcagagactcagacactgtagcaggccagagaatgaggtgttctaaaatcccctctctctggtcctgctgcaacttgtttttggttacacagcccagctcctcaagagaatgacatctccagggatcaggccataacaaaagaaattctcaatagcacaaacaatatatatttcctgagaagcacaacataaagtcactacagaaagctaccctgaagcatttctctaacatgtggtttcaaaatcatttccatgttatcaatgctaattataaagtttttaagacttgaaaaatgtctacatgaaacattaatgacataaaatatctctgcaaggtagcaaatcattgagagtcaaaaagctcaagatggtctcaatcaataactttgcaactaccaactatttgtttttccaaaattattaattaacaactaagaatttgctgaaagcctccttggagagtttttacaatctttgtatagaagtaaatagcatttatgacagtatccagataagttcggactaggctttaccttggctatgagacctgatatagttcttgatgatcccttgtcatgaatggaacttaggtagctattgtcacaatctctgcagtcactaagcatagaaagtcctcattaaatgcaatgtctttttaacaaagatattaaactgaactcaatattttcatacttttttactttggaagatttggagctgtgctcaaaattgtacaaggaactgttttaatgaccaattaattcagattggcagatacacagaaataaacatgttcagagaataacagcaaagactacatagatacccatagattatgattgacttttggtgagaaactcagataagctgaggacaaacattaaatcagcagtggaattataaccttacttatctttgtgctcaagtgtttgtttataagcatagataatacctacctaagaaaaatggagcccagcaggcagctagatttatatttatataattttataaaataggttcttgcctcaccatcagaggctggtcaagttgccagcctctagaaaacattgagatctctaggtatagatatatccttatttggaaggtgtatgaagccaaaataaagacaattccaagattcctcttctttaaataaggtgaagacccttaaagatggagaaaaatagtcaaagaagaaggcaaagaatcatagaaaattggagataggtggatgttaagcacattttattttttattttcattttatatacataaaaattgaggctcaaacaaatgaatattcttagtcatgattacatagccagcaaatgcattgatgaatatacagctaaatcactttccattatacaacactgaatttgaagaaataagatcacattatggatgtaaggcaaacataatagcccagggtcaatatggcagagaaataaaagttagcatttttctatcttaaaagtattctggattttccccccatcttcataaggttggtaacaacaataatggttcatggacaacctagaatatttcatatttaaactagagtcttttctcatggaaaacaaaccatccatgtcttgatcaaaacaggggcatgaattactagaagaataagagcaaagaagaaataagcataaaatgtttttcaaggaccatcttgagataatactattataactgcatttacaacttgtatgtctttttaaatctgatatttgtagtagtgtatagattagcatacttatggaacaaatgtgtttctctttgtttaagacaagtaagttataattcatacaaaatattagtcatggtgtcatctcttcaccaattctattatcatgtataggtcacaagctatttctggttttcatttttctttaaaaaagaaagaagagcttgaatagatatagcattttgaaaattttgtcctgaaagacttttccacctccattcatcttacagatctgataatttttcaccaaggaaacagtctttgtcctggagtctcatatggctcttgccataacagtatatccaaagattcattcatttatttactcactgaataaatgaaactctacaaggcaccaagttctgtaccatggctatgtatactgttaaaaacaagaaaaagaagtagttgaccttttagaatttacactacagtgaatgggaaaagtccattttttttataatgtagttttcatttgagtattgttttgtattattaatagttaacccatggaatggaatggattgcactcctgaagtattacttctgtgggaccttcaatgcttgtggctgtgtccttctttgctgtggcacatgctttgctagtggaaagaatttgcaaagcccttttgtgggggagaaaccctacctgcttgggatctgatctgaaaacaaaacctacatttgttcatcaccactacctcctctctaaatcccttaaatatccctctactaacagtcactcaagatcatgatttaatcatttcatgtccaataaagtattgatttcattttcattggttatcttttatatgatcatttagccattttaggcattatatcttcaagaagaaggagatttgtaaatactacaaaggggttttcgttttgtgttgttgagatattactattaaagtttctttttttttttttggatacagctgtgtaaaataaccaagatctatttctcattctagcatgtggtctcagcattctgtacaaatgattttactggcttcgtaaactcccaagttaaagaatctctttaggaagaatcttaattgacctcttgaattgttggcctggtacccagagtaaaagaattgtgttttaataaggattacttttgtcgtggtttattatgctttagcaccacacgctaattgatgtagttgcaggaaataaggtaagacatgccatggtttggttaaaagcttcattacatgtatttatgaagagtcttatggatgaaataatttacaacatctattacatatattgaaatgtatgctactgcttccatttcttataatctgcggaacccaggtctgaaaccacttggtggaaaacgtttttaaattttattttggtaccaagtggcaataacaaaagttcaatgactggctgagtagcaatttggactgatttctaaatgtgggcacagcattaatgaaagacatttcttatttttgagataaagcaaacctacatgaaagagaaattacatcatttgggtactagtttcagtgaatgcctgacaatgggggagtcggaagagtggtgtaatgacggaatgctaaagctaggtgagttaggaagggttatttggagataagccttgagtaggacctcaaagaagggaagcaatgtggataagctagtaggaggctgatccagaagttaaatattaaaagtatagcactagagatagcaacaaccatgtgtctagactaaagagcttgttttttttttgtttttgtttttgtttttagaaatgagtatggatggagagaggggattatagcagagcgaatagtgttgaagtcttggtggggacattccgatttaataagtaagtatagtttctttatcaagagtaaccattcgaaaatgctatttgaggattagttaccaatgcaactaaacttcataatgaatgatgatcatggttagcacccactaagtgcttactatgtgttatatactattttaaaaacttcatgtatgtccttgtgtttaatccaggattttgtaaccatgatgcaattgacatttaggattaggcaattcttacttgtgggggactgacctgtgcactgtatgatggttagcagcatccttgacttctattcaccagatgccagtaatcacaccaaaacatccccacacaaccacaagttgtgacaatcgaaagtgtctccagacattgccaaatactcgagggcaaaatctccctagttgagaaccactgatttgttcttaacaccacgtttcagttaaatttcattaattctttttttattgcctctttttgtagttgaggacatggatgctaaataacttgcccaatgtcacatggttaataaacaaattttaaagcctccctgtgaactccagcgacttaattctagggcctggatttgtaaccactattgtctattacatccccataatctttctaggcaggaatctagcataaacaaaaaaagaaatagcccagtgtagtaagtctcgtttgaactgatatatgaaaaaaatggcagacatttaaattttaggtaatgctatcacagccggtgtagtcaagacttctgtcttttgttttgcaatttatcaaaaggctgactttctcatctaatcctatttcagtggtatgttctacataatttttaagagattttgttgtatctaaccttaaatcaatatcacagcagttttatgattttttagtgcctctctcatcatttcttctaggctttggctggacaaggggaataaaagccctgtgtttttccacaactataagaaatgcaattatcagagcatatcttgtactttccaagtatccctagattgtacaatatgcctaactgtcctaacacaaggggacacttgctgcacactttatgattagagctgttccatgttcctttaacgatatgtggaaagcaaggaaaagaatgctaggagggaaaaaggtctctcctttctttgatgtggaagttttgcaaatcatatagtgagacctcctaagagttcatctcactctaggcacacaggagactgtggctggagtagggaggaagaaatgagaataacatagaaatgattataaatggtcacagcctgtctttggctagaaaaataaacagggatttctgccaaaaaaaaaaaaaaaaaaaaaaaaaaaagacctgggcttgggaggaggcagcctggccctctgtgtgtggcctctgtttacccttctgtataatattatgacaggtccttttcaatgataatgttccatgcatcagtaataatgaatgaaaaacaagaaagcacttgcagggtttgcctattaccttaaaccactgaacatcatagagaaggcagcagatgtgacagacaaaaagagattcatagattaatatagctgaaagcacactgacagccaaaagcatgttttttttccattccagaaagttctacctgtgaaatctgagactctgccttttcatctataaaatgggataaaactatcttgcaggattttgtgaggcttagataaaaatctccaaggagatggaatttccaacagtatccatcaaaatacaggcactcagtaaacttacacgggctaaatagataaatagttttcaagtgaaaatgtaattgtgaagtgcagtttagttctctttgcctctctagggctttgtagaacatgaaaaaaagaagtaaggatctttttattttattttttattttaacaagacccatggactaaaggtaaagagtaatgcaatttaaaggaccaatgcaactaggtaggtaaagtcctacctagactcagaaagtccagacaccagttacaggaaacaagataaaatgtatgagtctcaggataagaccgagggtttcaacattactcacagaaggcaagatgccattttctacaaacttaggggcctttctttgcgtttagtcaactaaacttgaagtgagagaaggaactcaaataggagaaatggctaccatttctttgccggtgatgggggagaagtgaaagcagtggggctatgtattattctgttctcaccctgctataaggaactgtccgagactgggcaacttataaaggaaagaggtttaatttactcacagttccgcagggctacggaggcctcaggaaacttacaatcatcgtggaaagggaagcaaacacatccttcttaacatggccgcagaagagagaaattagtgcccgcaggggaaatgccagatgcttataaaaccatctgctcttgtgagaactcacttactatcacgagaacagcatggggaaaaccacccccatgattcaattacctccacctggtcccactcttgacatgtgctgattattacaattcaaggtgataatcagagcgcagacacacagccaaaccacatcaggctatatggaaaaaaataaatcaaagaagtttgtcctcagacacagaagcaacatttcacgttccaagacattctacaatgaagtgagaagcctggcacttccttcctccacttccagacttaataactggtagaacaataatatccgtaagtaacaaagagcctggaatggatgagtctgacaaagcccatccatcctgccacctcacaaactatctatatttgttcttttttctccagctttggagacagaggatgtgttccagctcacagactttcaggaataatactggaaattgacatctaatcagcattttatgcactataattgtgtaaacttttaggcctgctgtacaataatccttccctgctgtgtggtgagcactttggggccctctggatgctagatgtgatatgaatgggaagcattattattatttatgccttataatatgtcaactctatgtcctctgccacaacagacacttatttcaaatgtgcagtaacagcccccaagtgatgtattgtcaaaatatttttgaaatgaaaaagcaaaattaaccataaactgcccccttgtctccatgaaaatggcactgtaacactaccaaggaaaagcaatgttaaataataaaagctacaacaaaataaaagtcaaaaaaaattggaagagctctgtgtttggaagaagtatgctttggtaaatcacaacaatgacaatttcgctttccaattaaagtgtaatagtgaaagagcaaaccatcaccccagggtatcctcaagaacagctcaatgaattctggcttacttaaaaagaagttttcagtggagctgtttttcttgcaaaagattttagaaaaaaacacagcctttttttttttttttttggatttacattacgcgaaccctgatattatcagatatcatctaatgactcatcaattcatacagacctttaaggttggaaagcacatatttaaatatatagtagacagcaagtaacaaatgataggaactacattttagtgggtaaaatccttctgcaccatcaaagactttctaagagctatgggtttattactcaggtgattcagtttccattttgggacaggtcatattaattttcaggatcttttcccagaatgttatttaattagtgtgactaaatatctgaatcaggatgctacggtatttttaaaaaggaagatgtcgatttaaatgtgatagatacttaacagtttgataaacttttaacagactgtaaccttgatgctttccctggtgtagggaggcatccaagggaccctggtgaactgaaaaagttaatgcacttctctaaacattttgagtctggcagaatctggaactataaaataacatttcttcattaacatacaagtcacaatgctattcccataaagcacctctagcatataaggctggacgtttttcagaccatcatttatagggcgggtttatttttctttgtcttgacattaatgagctatgtattcagggaaatagaagatttcaatgcctgtcaaattacctttcaaattaccaaagcttgcttttctcctactcaaagagcaagcagggacttcttttagaatgggggaccaatggaatattcagtaaaaagggtcatgaaaataaatgtgaaggcagtaatggatccattccaaccatgacttcatgacaaaatgctgtgacttcagcatttcattacttgccatgttctcatcctttgtattattatcacacctcccctctctcccacgttattacatctttttgggaaaagaagatatgtgaaaatttctgtagttgtatgataccttgttctaaaatttagactgctgatttgatatgaaacacataatgtttttatagatcaaggctgccagttatttgtaaccattctgttacaaaaatctttcctgagcaatcttggtatatcatcttctgccacatccttagcaattaactgaagctaactgtttcactaacatttccttttccatttatgtagaatgggctgaatgtgttaatgcaatataacaagagaaataggcacagaaaaatcctctttcatatcgatctcagaatcctgtctgtgtctcatttgggatgaagagaaaaaataatcaagaaaatatgtgttggcagggttaagaatacaaaggaaatattactggaaaatatttaataggtaaatatagatgagggaataggcacaaggttaggtaacaagcagattgaatttcaaatttcctaatgactctccctgttttgcaaatccttccaaaacattacctcatctgtgctttcatcatccctagggtatagggttcgattactcatcctatccctttgcacaatggagaaatttacatgtattcagccctagccgtccttctagtcattctctcagtttagtacttacttgttttcttatttgggttttggcctgttctccataagtttgaaagctgtttgaggacagggatatgtttattctgtacttttctggtatcctcgcttggaaatttagtacttaagagctaggtcgggctgggcgcggtggctcacgcctgtaatcctagcactttgggaggccgaggtgggtggatcacaaggtcaggagttcaagaccagcctgcccaagatggtgaaaccccgtctctactaaaaatacaaaaattagccaggcatagtggcgggtgcctgtaatcccagccactcgggaggctgaggcagagaattgcttgaacccgggaggctgaggttgcagtgaaccgagatgctgccattgcactccagcctgtaagaaggagcaagattccgtctcaaaaaaaaaaaaaaaaaaaaggaggctgggcgcggtggctcaagcctgtaatcccagcactttgggaggcctaggcgggcggatcacgacgtcaggagatcgagaccattctggctaacacggtgaaaccccgtctctactaaaaaaatacaaaaaattagctgggcatggtggcgggcgcctatagtcccagctactccggaggctgaggcaggagaatggcgagaacccgggaggcggagcttgcagtgagccgagatcgcgccactgcactccggcctgggtgacaaagcaagactccgtctcaaaaaaaaaaaaaaaaaaaaaaaaaagagagagagagagacctagggagctacgtcctcattaactattataaggtggtttcagaggagcatgtagtgcactattgaagctcaggtttatcttaataggtgtatttgtatacattcattaagtatacgcagactaggcactcctcattttacactcaaaactcaagtagctgtaggactaaattacttatgattttgatttataaacagcagaagaacaatgggtaatccatattaaaaatgattgtgtatcatctcctaaagaaagcattttgaatacgtgtttatcctgttcttaaatggttttactctttgttatattcattctaattaaactgttctagtgcaaaaatgctaaagcaatttctgtagtttcattttttattctaaaattcttaactgtatactgaaagtgagcttatgaaacattcttgatatgaaaactcacaagttttcaaacataattctttatctttaaacacaatacctacctgaaattttgccagacaggcttatcctcagagtatgctttagtaggttaatactctgaagaattaaatgtaattcacatattaactactggtagaaatccatgtgcaatcatattgtttacttgataattccatatacatctttaaaatcaaaatgctctgtttcacttctcaggagcagttctgacacattttatactttttgcagattcaggattagccaggtagagctagcctgtgttggcttcccagttaaaaatcaataaattttaaacataaataaaaagaaattctctctttaaaaagtattttgaatttctatatgtgtgtgtatgtatgtataattacagtagtaaaaattttattaaatctctaccaaaatctctcctgacacattcctttctctttctacttttgagtaactataataatccttctcaatttttctagaaaaagaaacatgcattcaaactgatctcagaaaagaatttttctcatgccaagtcaaacaagttagcaatggtaaaatatatttcattaaaattttaatctagtcattaggtagggaaggttaaataacttaagccttttcttaactattaatagataatgtcaactcttgcctagcagcttcaataagcttttgcaaagtgttgaattccagtaagcactttcagaaggggtaagatgtatacgtgatcatctacttaggtcataatactgcacaaatagtgctaatgtgaaatatctgctgggatttttagtacaggttgtttttatagtttaaggatcaagttgcttagagagtgttcacttctctaagacatacggaaaatatctatgaaactttactatctgaatgtgtactacctgggcacactatatatagctagtatagcaggatggaaacttcttttggttggaaaatgcgtagacacaaatgacaaaatcaagtgtaagcaaagacagtaagcatattggaaattatcttggacaaagagaattttgcatttcttttgaatatctcctatggaatatatcacatagttactaaatgcttcccgttgagaaatagtgaagaagtatttttctaagaaataaattattagagactcaaatattaacccttattagccatacttacaagagacaaggatgttagttaaagccaggagaattctttagtgctgtctttctagacgttagaatttctcaaatgtattcagtaattaaaaacattttgaaaaatttttaaaaatgtaatatacaatcattttaacacatattttgctaaatcatctattcagaagtcctctagtttctttatgaccctatacagaagataattcaaaaccatggctacaacatatatgttaatggtaatatttatttatttatttagagatggagtctcgttctgtaacccacactggactgcagtggcacgatctcggctcactgcaacctccacttccagggttcaagagattctcctgtctcagactcccgagtagctgggactacaggtgtgtgccaccatgcctggctaattttggtatttttagtagagacgagatttcaccgtgttagccaggatgatctcaatctcctgacctcatgatctgcccacctcagcctcccaaagtgctgggactacaggtgtgtgccaccatgcctggctaatttttgtatttttagtagagacgagatttcaccgtgttagccaggatgatctcaatctcctgacctcatgatctgcccgcctcagcctcccaaagtgctgggattacaggcatgagccactgcgcccggctacaggcaattttttaaaacctgataaatatttattccttattgttccagtcctggatattaacttctagaatttaaaaaaggtgataccttagtactttctgatttaaaaattttattagctcttgtacttaatgattagatacatagaatgacagatcttctaatacaattaactctgtaaatcaagaatcttttcttccccaaaataatataaaaagatataaataatttacaaaagcaggggattacatttagcaccaattcaaagttcttgtgaaaacaattaaagaatgtgtgcaaaatttcaaaactgggatacaaatctgaaattttatagaatcattgtcaaacaattgcagatgcaagaatagtatgtttgatttatttcttcatactttggaacagaatcaagtttgtataaaaaaatcaaattctcaatttttacaaaaagagatgttttgtatttagttatactccataatttcctttcactctttctatgaaatctgtgatgagtagtcactgaaatatcaagacacaacaatgttagactttcattcagtggcctgtaaatttactggttgccagaatatcttatatagtaggtaaaaatagagcttctaggaagactgaattctatccttagttaatgctgaggttcaggctacatatattcccaattgttgctgaaattaagtagtactacatcattctgtcacctgccaagggagtatgtgtccttccttcctcactgatacccagggaagaaacaagaatgcactgaagatagtgatttgcagcaggtgctgaggctcccttgatatatgtacatatacatgtctgactccataatatactggaacccataagaaaggcataaattactaccaagtgtttctctcattcttcctggaaagaaagtcctactactttaccttgcttagtaaatctaggtgctgctctttcctaaatgaaattttgattaagaattattatatctgaaactcctttaacctccatcacttctctttttcaatgccatttgcaaatatgtgctgtaagatataaagaaacactgataagattacagttcccctggtactgtccaactaaaaaggaacccaagaacatttaagagcctggtgtcattttttttttctgggaaaatacatcccattttttctcctgtaaatgctttcaacctggtgacctatgacagctttgcagtgaaaatcttgaactggtttttacttactttgaataaaaggttaatacaaggcttcatggaggtttaatcagcaccacattcaaaaatgagggaagcaaaggcaaagctaatgaattgaccttttaaagagcaattcaatgggataattgccatagcacaattcacttcggggccgaatatgtgtatatggctggtcttccttggatccaatccaaggacatttaagtatgtaagtaccaaaatcatggtgggttggatgaggtggacaacaacatcacatacaacctagtggacctcaaatacatttttcataaaagtaaagctgtgctttcacgcataattttaacctaatcaaccagttcatgtatgccaccaagaaaaattaaaacattattaacattatctgccatctgtgctaaacactttatatttgttattttgtacaattttcatagcaccccaggcattaggtgtttttattcctattttacagatgaagttggatgtctgtctagatacattgccagttcttcctgaaatcaagtagttattcatccttctgttcttccaaggaattgtgtgtcctacctttctcactgatacctagggaagaaacaaggatacactgagaacagtgatttgtagtaggtgctgaggctggcttaatataggtacatatgcatatcagaggggtttaaataatatgcctgatagaccacggtggatgacattaggaactgagactgaactttatctaacaagaccttagaccgtgactactcacctactcttaacaaaaaggacaggtttttgccctgagtgtttttctaaaacatcttacatgtagaagtacccccaaggttaaactcaagataataaaaaggtttccccttggtcttatgccctacttttcctacctttatatttatgagaaacattacaatatatgtgctatcttataggagaaagctaacagtttcctttaaaggggggaagattgggcttttttctttaaatcaattatggctgtggctaaagaattaaagtttgagtgcagagaatcaggttttagtcccatttctgcaactagctttgtcaccagagtaattctttttttttttggagacgaagtctggctcttttgcccaggctggagtgcaatggtccgatctcggctcgctgcaacctttgcctccaggattcaagcgatgctcctgcctcagcctcctgagtagctgatattacaggtgcacaccaccactcttgactacttcttgaattttttttagtagagatggggtttcatcacgttggccaggttggtctcgaactcctgacctcatgatctgcccacctcagcctcccagaatgctgggattacaggcgtgagctactgtgcccagacaccagagtaattctttaggttactcacctataaagtgaaggttctgggctagctgatgaatgagattcacagtagttttcagatggtgtgatttcagtactgttcactcagcctatatatctacaaacactgcactagatactgtgaagagatacgcaatagctgacaagacacaggttaaattctgaatgggtttataatttggcaaattgggggtcggcagtgagtgaggtagagagtggaggtgcagcaacaaaaaatgttcttttatgaaagataatctttactaacccactacacctgcgatgttccttttaactgcatattcctacaatacatatatacaactctatccaaccacggctttacaatcagtcccaggagatgatttgtaaacaagatttggggaacagtagcaaatatgagtaggtagagaaatgaaattttaaagtaagaagactggcttatacggcgacaaggagttagagatgaggagtcagacatgttgaaatgaatggaacttatatttagataggcacataaatgacatgtgcaatgtcatatgaaacaaagctgctataggtcatggaagccacaatcttcaggaaagtagctaaagaaattgaggtggcagtgggaagagtaaatcaggaccagagcgtatgtaagaaaaatatgacaatgtcaagtagcagaaaatttgaaaatgctttggggtatctacattttaaaacacatttctggaagtaatattagtttcttaagcatctatagtgccaggaatgttgcatgcatcatctgtcataatttttacaatcatcttgcaaactcagatatactttcctattttatgcatgcttaagcaggttaagtggcttgataaaggtctctagctagtaaatgagaaagccaggaagagatcacaagtgtgccctgcagctagtaccacgtcaagtcttactccccaattaattttgcaaatatgaaaagtaatgactttagcctatgtggcccaacttcaggccagtcccaactgggaagattttataataacttcttagaaactgctactggctctttctcactggcttagtagtggatattaatctctttattttccatatacaggcatatggcttgcagacatggcatactgtgtgcataaaaaacttccttagaaaatacatcatccaagaagcaggaattgctgattatttcattactgcagcaaactcatgtttctaccatcccaagtccggactctgtctacaagagtagaaaaaatccactagatttttaattcaacatctattcaagttttgaggcacatgctatctgaaacaccgtaatttttgagtttgaaacagagaatttttctttagcaactttggccctgaaatgtcctccaatctcaatgtcaggaggtttgctacaatggtctggagagtgtagtttttcataaaaatatgttctatttttcaacaccaaatgaatatctctttcctgcatattgctcaaaatagccatttccttcacatggttatgttttattactcatgtcatcagatctggcaatgtgagatttatttagggggaacatttcatcaattacaaaacataaagcatgtgctgtctctcaatgagttcagttacatcttaaataagttctgagctgttgggagaattacaaagaacacacttttcctgaaaaccattaaaattgcatactcatagaattttaaaaaaattctatgcctgaagttttaatatttttatcccagggaagtggattttttcacttcctttttagattatggccctgagaatatatcacccgaaaatgaagcatgaaaaacaagacaacttgagagcaactcacagaaattagctgatttcatgatatttatgtgctactcacttgcattgtttaagtcttttcttttctttttttttttttttttttttttttttttttttttttttgagacggagtctcgttctgtcacccaggctggagtgccagtggcgtgatcttgattcactgaaacctccggctcccaggttcaagcgattcttctgcttcagcctcccaagtagctgagactacaggtgtgtgccaccacacccagctaatttttttgcatttttagtagagacggggtttcaccatgttagtcaggatggtctcgatctcctgacctcatgatccacccaactcgggttcccaaagtgttgggattacaggcgtgagccactgcacctggccctgtttacttttttcattgactctccctgccttaagagtaaagctcaagtttctaccctgtcctgatttatttccttctttccttccttccttccttcctccctcgctccctcccttccttccttctccttccttttctcttttccctttccttcctttgttcgttcccttccttccttcgttgcttccttccttccttcctccctcccttccttccttcctccctccctccctctctcccttcctccgttctttcctttgctccttctctccttttttgagacagtgtctcactttgtctccaaggctggagtgcagtggcactctcatgactcactggagacttgacctccgtggctcaagcaatcctcccaactcagctcctgagtagctgggactacaggtgcatgccaccatgtcctcctaatttttatattttttgtagagacagggtttcccagcttggccttgaactcctgggctcaagttatcctcccgccttggcctctcaaagagtgggaatatagatgggagccatggcaactgcctgagccctaccctgtttttgcagggccctgcatattgtagtctctgtctcctaaacaggggaaacttctatcctaacacctttgctcaaactgtgcttgccacctagaatatcttcccacatgcacagttatgggaagcctccttataccttaagggccttgctccagttgtaaataagccccgattcctattatgttgtgttagttttctctgggctaacattctgtcttcaagatctttgtgtttagatcctttgtatgtttcaatgtgtcttgggcataagtactgagagcacaggttaaatgcaaaggtgagagaggctgtggagaaaaaattaaaaaaaaaaaaacttttggcatatttagaagtcactttgcttctcttactgtcaatgctcttatttctgccctagccataactgtaagaaaatacttaccagttgttcaaagataggttgttcaaagtaaaacattaaaatgttgctctttaaaattctttttgtggatatactgagggagcttttataatcctataaatatagagaattgggtgcacatttcttctttaaagacaggtttttacccactcttcctaggtatctaacaaggagacatcaaggcattttaaaacaaaagacccagattctaaaataataatgtctttttttacactcaagattccaaacacaatttgactgaccttcaacagtcttgtaaatagccatatctagtctcactccctatagagagaaaatcaacagcatagtgtgtcctactgaatattatataagttgttagtatcagcattaaaacaagggagtcttactccttaggtgctgctacacatcatctggataggcaatctctcagcacaccacctaggccttatcttctgcacattgctcaggctaaggccatgcctggcaggtagtcagtatgcaacaaatgagccatcaaatataacaatataatgaaaggccattaggtagtctctagaaatatctgtccttaatcttacatttgttttttctcactgtatgtctaaacattgctagtttatcccagaaacctagttgcttcttttctgacagtggttgtattaggtaagatgggattgataaaataatcttggaatcttaacatgtaattaggtgaacaataaaactatataaccaaggaaatgtgctgggttcaagcataatcaagatacaaaatttgtcttcatggagcttgcaatgctgttagtgagtttgatggtctgaatgtttgtgttttccccaaattcatatgttgaaacctaatcctcaatctgatgttattaggaggtgaagtctttgagcagtgattaggtgttgaggatggaggcttcatgaatggaattagtgcctttataagaggctgaacaaaccagagttcttccttttcaccatgtgagagacaacacagctaaaagacagctatctgtgaagcaggaagcaggccctcaccagataccgaatcagctgccaccttgatcatggacttctagcctccagcattgtgagaaataaatgtatgttgtttagaagtcacccagtttataccattttgttatagcagccctattggactaacacagtgaagcagtcactacggactgaattaggtccctgcccaaatccatatatatcaaagccctaactcccagtgagtttgtatttgaagatagcatctttaggaggtagttaagattagatgaggtcttaagcatgggatcctaatccaacaggactggtggccttataagaagaggaagaggatgcacacacacatgctctccatcctacacgcaggaactaaggaaaggccatgtggacacacagcaagatagtggtttcctgcaagtcaagcaaagaggtctcgaaatgaaacctactttactggcatcttgatcttggacttcttagcctctggaaccgtaagaataaatttctgttctttaaatgcccagtctgtggtggcccaagcagactaagtcagcagtagggcacattgggctctgaatttaatatgaataggtttcaccacttgtcaactatttgactagagggactttcttagccttatccttaataagcccaaaggtcttttgaatgaaccttataagaatatctatctacctcaaaatattattgtgacatttaaaggagaaaaataaaatataaaatgccagctccatgccaaaatataaaataaaataaaatacccagctccatgccaaaaatgctcaaagatgcaaatgcaagcaggcatttaaaatgtctgggtaactatgtgtcaagtgggtagcagagacaaaaggactgtagaattttggaggagaaagagggtctctttggttggaagaatcaaagaacattcaagatagacttaatatttatctcagcttgactaaaggttagacaggttgcttcctgactataggcccatgaccttcttttccttagagcctttactttagaaaacttgcaattataaattctttctctgccccttttgaaatgtatctaaacctccttaaaagcctctggccagttctatgatctagggagtatctctctcaaggacctgcatgccatacttttcagatctaattatcaagaaagatagtgcccccatctcccagtctctgtggacacataggagtctatcataagtgaacaattagaaactataaaacactttatgtcatgcatatgtgagaaagtttactttctcctcctgtaaggataacaggcaaacacaggtggcctatgattctcctacatctgctcttaaaaactgtccaacactttgtttcttcagagttgagttcagtttctctcccctattgcaatagccttgattaaagtcttccttgcctgtgaaactttgtctagcacatttttctttactttgacaggaaacattcatagagaatatacaacttgaaatatgttgtaaggtatggcttagatattggtttggcaatgtataacttaaaatgaaaagctgcatgcattttcatgttagcagtaactagttatggcatgtctcaatgctttactcaagagttttcttgagatctttttaatatatattatttcaacagttactcagcacaaagtaagtattttttcaggctcaaaatcctgcactaacattgtaagctccctatggcactagagtttgtatatatactttcaggcagctgaagacataggtaaatctttgcaaatggggagagagggggacaaaaaagggttcctggctcataattttaaagcactacccacagtgggactgttttctaaagaactcttaagtatgcagcatatatactaacatgtaaagcacaccttttgcactaatcaaatgtgaagttatataaatttaatatccaatgacttaagaaagtgggatgccaacactcatctttatgactaaagtatacaattttatgaatcaatgtaaagaagccagcatgcttggaaggaatcttttgctcaaactcagattatgttattacactgctaatcttggtgtgtttttttaaaaacgtaacatccttctaatcaagcatgattagttacaaatagaatccaaagaaatatctcaaatgactatatatctaaattatcttgcttattacttatgggatatttttcttatccatatccaggttaattacaatttcagaaattatctgtacaaatgaataaaattcaattctcttagccaatgagttactttttccagtgtaaagtacagtcatttaggcattcacaatatatggaatttagaaatcttttaacatgatgaagttgaaaaaagtaaacaaatattactttgccaattctccaccagtcagaagcttgtctatatactaactgtgtatttagaaaatatcaatgcataaggaagagaaatgcaatttgtctcatccaaacgcatcatataaaatgaccaagtgctgttaagtgctagagatgtgtctcaaaagactctcaatgtctgtatcattttggggttgtttggaagttaaacccttttagtaagaagtattggaagataaatctagttctcagcccttaattcgccattcactggtgaggtgttcttattagagagcatgtctcctggtctcactagttcctaatgaatgtgtctggcctttcctagcaatatataaattctgagaaattggaagacatgattgctccctacccaattctgaaaagagtgaatatatcattctttgtaacagatggaatgtattaaaaatatatcaatatgtgttttcataaaaaagaaaatatctaccattcaattagaaaagtattttggagaataataaaaatgatagatatgctattttactgttactagccagccattattgttagaaagaatatgattctaaatatactgaaagtctggtgacatgtacaagacaggaaaagcacctttattcactcgtaataaatattttcctgttcattccctacataaactagaacaattaatattttcctcagctttcctggagaatgagatatttgacctgaaactttctctattgtgatactgctagcattaattaagtggcagtattcaagattaattggagacaagaagactagttgggaaattgttttgtcataaagtagaaaatagtgccatgatggaaggaatggaaaggaaattcaatttcagaaatttcacaaaggaaatatggttagatcattgaggttgaatttgcagaatttagtaatatacaccaagattgcaatttgagagctaaaagctgtttcaagttcagtgttctatggactaaactgtgttcccggaaaattcataggttgaaaccctaacccccaatgtgacttatttgaagagaggaactttaggaggtaaagttcaatggaattataaaggtggggccctaatccaataacactggtgtccttatgagaataaaaagagacaccagagctctttttccctgtacacagaggaaaggccactcagagagggtggctgtctgcaagccggtaagagagctgtcatccaaaattgaatggatggacactttaatattggactttccaggctcccaaactgtagcataataaatttctgttgtttaagctactcagtctgcagtgttttcttttatacacacacataatacacacatacacacacacacacgcccccatatttatatactgtgtatacacattatatatatattttgttatatatacatgtatgtatacacacatatatatataatcttattaaaatcttatatatgttatatttgtctctattaactaaaatttaagtaccatgagggcaggaattttaatctattgtgttcaccactgtttctacactgtctaaaacagtgcctttcccagtcctaagcaaaaagaacaaagctggaggcatcatgctacctgatttcaaagaatactacagggctacaataaccaaagcaccatggtactggtacaaaaacagacacatggaccaacagaacagaacagagagcccagaaataaggctgcacacctacaaccatctgatctttaacaaagctaacaaaaataagcaaagaggaaaggactccctattcaataaatggtgctgagataactgactagccatatgaagaagattggaactggaccccttcctcacaccatatacaaaaattaactcaggacagattaacaacttaaatgtaaaaccccaaactacaaaaaccctggaagacaacctatgcaataccattctcgacataggaacaggcaaagatttcatgataaagacaccaaaagcaattgcaacaaatgccaaatttgacaaacaggatctagttaaaccaaagagcttctgcacagcaaaagaaattatcaacagagtatacagacaacctacagaatgagagaaaatttttgcaaactacgcagctgacaaaggtctaatgtccaccatctataaggaatttaaacacatttacacacacacacacaaacccaattaaaaagtgggcaaaaggacatgaacagacaattttcaaaagcagacatacatgcagccaacaagcatattttaaaacgctcagcatcattgatcgttaaagaaatgtaaatcaaaaccacaatgagataccatctcacaccagccagaatggctattattaaaaagtggaaaaaaaaaaaaaaaacaaacagcaggtgctggtgaggttgcaaacagaagagaatgcttatacactgttggggggagtgtaaattagttcaaccattgtggaaaaaagtgtggcaattcctcaaagacctaaaaacataactaccattttacccagcaatcccattactgagtatatacccaaaggaatataaatcattctattacaaagacacatgcacacatatgttcattgcagcaccatcctcaatagcaaagacatggaatcaacctaagtgcccattattggtagactggataaagaaattgtggtatatgtacaccatggaatactatgcagccataaaaaagaatgagatcatgtcctctgcaggaacatggatggagctggaggccattatccttagcaaaccaacacaggaacagaaaaacaaatatcacatgttctcacttataagtgggggctaaataatgagaacaaatggacacatacagggaaacagctgacaccgggacctagtggagggtggaggttgggaagaggtagagtatcaggaaaaataactaatgggtattaggcttaatacctgggtgacaaaatagtctgtataaccaacccccatgacacaagtttacctatataacaaacctgcacatgtacccctgaacttaaaataaaagttaagggaaagaatagtgcctttttcatagtaggtgttttacaaatatatacttagtaaaggaatgaaataatgccaatatttgaatgtggttttgtatatgactcaaacccatatagatctgtaccctatttctatcatatttccattcctttctaaaaatgtattttctatgttgacttacctgaatactgttattctaaggtccacttggataatttatatatagtttcataaatgagtagattttagcagaggtgattggcccatattagaatgtaattcaaaacttgaatttattattttaaattgaatataacagcttggttctatgtgtcataagtagagttaaagtcatatacctttcttatatttcattcttccgtgtcatcacacaacaatgaagggtacataatgctaaaatgagcacattcattgactgcacatctcaggaagaaataaaagaatataacctgattatttgaagttacagaggctagatatggggacatctaataaaaagtttgaataatttcaaaacatatctttttatctttgtgagattttctctggtatttacattttcgtatcagcatttctcatgatctaggagttcctactacttgaattaaactatcatgttttctaattcttacaagctagatttttccttcccttacagagtctcatttctctacccacttactgaaaaggtagtattttctgtgtgtgtcttaaaatgtttttagattgcaaaacaaacaaaaaaactctcaaaaacatgctgttaacttctgccagctgtttaattaagcagattttataggaatgtgaacaataaaaagcaaaattctggagctatattgcaatccagataatattcttatcctcagaggaaaaaacaatgaccttcacttaagttctgctatattattggctatgatttgaataagaaagcttagtatgacaactgcaaaacatatacttggagaaaaatagcctaaaatataaaactaaggacaatgtaggagcatgtgtgttaatgcataacagacccacagacacagtgggtatcacaagcccttttaatcaagacagaaatatgcacatatatatcatgaacattaatgaaacttgtggaactcctccatggttccaaattatgtcctgtctcaaaatacatttatgtaccttatggtaaagtgatctttgaataatgggatcactgaccattacagttcaccgatgaatacttctaaggaggaaaggagagaaagctaactataagacttaaacagcacctgctgtcagctaaacaaattagctgccctgaaatcacatgtacccacaaggaatgaatagcacaacctttacctaggagactgccttcggaggaaaatgcgcagaatagaaatagccagtatgatatggcttggttgtgtccctacccaaaatctcatcttaaattataatcccggtaatcctcataatccccatgtgtcaaggaagagaccaggcggaggtaactgaatcatgggggaggtctcccccatcttgttctcatgatattgcgtgagttctcacaagatatgatggttttatgtgtgtggtagtttctcctgcattcattctccttcctgctgccttgtgaagaaggtgccttgcttcccctttgcctttcaccatgattgtaagtttcctgaggcctctccagctatgttgagttgtgggtcaattaaacctatttcctttataaattaccctgtctcaagcagtgctttatagcactatgaaaatggactactacaaggcttctaattgttatcccaaatttgttcagcttttgacaaatctgtatacacatttgtctttgatttttagctgtttgtttgactttttaactttttagctattaaattttatcatttactaggctagagcagaaatgataatacaggtttttcctcatttcttaaggtgtgattaattacaaacatggccaaaattcttgcaattcctctccttgaatttgggctgaccatgtgacttgcttaatcggtgtggcaaaagcaatgtaacgtgagttctgtacctgagcctcaagaggctttgcaaaattccattttcactcatgggattctgtgattaaaccggccttttggaggatggggcataagctgttctaactaattcatcttagatagccagtctctagctagcatggcaagctgatcaccaacatatgaactagtccagttgagatcagctaaacctagcccagatcagaaaaaccacctactgaagcccagtccaaatggcagaaccacagaattatgagctaaataaaaggctgccattttaagcaactaagttttagaggagcttggaacacatcaaaaactaaatgacacaaaaggttagctgagaaacattttttaaagacaaaatgtattttaatccagcttaaacagaatatctttattttggttaactttaaattaatagatgaaataggtaatgataactatacagggctaaaacattttatatatggttaggtttgagtgtaaaatttttatctcctttgttcttttttttaagtcagtttctgggcttctttttagcaaagcaaacagttatttggctctaattacaatcaaaatttataaaaaaaatttttgaagtcaaagtaaaaaatccagaatattggaatatggctaataaccaaaatcttcctctccttctaacactactttaatatctcactaatatttctattccttactccctggaataaattgaaataggataacaagataaaattatacctggtttttcattctgggttttcttcattgataaatagagggttatgaagtcagaaatataagactattttctcctgagatttcattaaagatacgatattaggaagactgaaggctattgtgctggcttaccacatcatatacttccaaccatcagaagtgaatgacaatgcaataatgcaaaagaactcagctcttatcaaccacagaagcatttagaatttctgtgactgctctttgagtacaaacgattattactaaactttgtcaaactgggaagattaaaagatttttcagggttgtgtaagtgcaataccataaatactcaaccaagtagaaactgcttcagcaggttaaactaatgtggggaagacactagaaatatcagaattcagaaacactgactccaatgcattgtttttttcatatttcagaatctgctaaaagttgaaaaccagattaattgcggccatagaaaagccttctcatctgtcatttgaatgtgaaaagaaattacttgaaatgtagtgggcattctacatttcaagaaagaaagagggtcgatgaatgaaataagcagaaaaaggaacagcttagaatatgatatgtagagatacctgaggataaagaaacagtgagagcgaatctgtagatagtctggaaggagattagcagaaaatatacataaaaaatcacatcagttgacatccctctactctgtgacattgtggtggcgtctaagaaggtcatcagtgtttctcagtatctggcattcctgcccctatgtaatgtccttcgcttgcatgtgggctagacttacagcagccaggaggaagtgtcacttccaagattaggttataaaaagcctgtggctcctatcctgggctttctctctctctctctcatctgtcctggaagaaaagtaaattgccagctgttgtgaggatccctgcacccacatgtaagataataaggcatgctaacaaccatgtaagtgagcttgaaagtgaatggcatcctacacacacagctgaaccttccagtgagactgcaggaatgatcaccagtttaactccagcctcacaagagatactgagccacaggcacccagctaagtttttctgggattcctgacccataaaaactgaaataacatgtttcttattcatagctgcctaatttggggataatttgttatacaggaacagatagctaaataaccacctaaaatatagaaaagaatagttttctccgtccttccctccctctcttcctccctccctccctccctcctttccttccttccttccttcccaccctccctccctccctccctcctccctttctttctttttgccaaaaaagcaaaaccaacaaacaaactaaaatctagacagtctttcttttaaaagcaaagaaaggctgggagcggtggatcatgcctgtaatcccagcacttttggaggcagaggtgggtgaatcacaaggtcaggaattggagaccagcctggccagtgtggtgaaacctcgtctctactaaaaatacaaaaattagccagtgtggtggcgggtgcctgtagtcccagccactcaggagcctgaggcaggagaattgcttgaacccaggaggcagaggtggcggtgagctgagattgccccactgtactccagcctgagcaacaaagcaagactccatctcaaacaaacaaacagacaaacaaaaacaaagaaacttcccagcactttgggaggctgaggagggtagatcacctgaggtcaggagttcaagaccagcctggtcaacatggtgaaatcctgtctctactaaaaatacaaaaatcagctgggcatggtggtgcacgcctatggtcccagctactcaggaggctgaagcaggataatcgcttgaacctgggaggcagaggttgcagtgagccgagatcatgccactgcactgcagcttggacaacagagtgagacttggtctcataagtaactaaataaataagcaaagaaactgtgcaaagagaggtaaggctctttctgtggatgttctctatttgggcattagtttgtctgctatatgcctgctacttccaaagaaaagcctgtagctctccatactctgtttattctcaacctgacaagcagtccagactggtgctaaagaacagaagatacacatcgagatccctttggaggtaggttgttgagggaaagagataaggtttgatagaattaaaactgtgactgggaatttaaaatgatgatataataaaggcaagagattcaatacaagaaaaaataagtatgttgagtagctcatggaaaaacaaaactatagaaaacaaatatgattcaaatataacgcaaaataaaatgtcctgatttctgagcaactgataagtgcaagggaatccacttgaccttgatcctagaggtggaaaaattctcctttgagtagtccaggtaatatgatatttaactcataaaaaaagaaaggtaatcttaacatataactgagattagtattggataatatttacacagtaatggtaatctaaatggtcttcattgttttccactttagaatcctcataatccaaataaaatatgggagatttagttgtggttggttgtcagacagaatgttaaagttaacatccctggaaataaaatgagatcatgagatgaggaaaagaagagggaagctagaggaatggggaggagcataaaaaatatctttagcttactaatgtggatacttaagagataagagatattcttgtaaattaatggaacaagaaattagatgcaactatattacttaaagcaacaaaatttatatataatttacatatagttttatctaatatatatcaagtattatatatataatattttatacacatacagacataattcacaggagagaaaaaagcaaaagaaaggattaaagcctgagctaatcctcaattttcatatccaggattgtataagtattgtataaaaggaataaataaacaaatggaacataagcatattatttggagatatggagctaattaccaaaaagaattattaaaagacatttactctggggaataagactgggagtgatgaggggataaatgtggtatcgttgcttttttatataccatcttctaaactatattgatttgtttttatgtgcttgctttatattaatgaaaacaatgtatcaattattcccacttacatatgtacaacaaagcaaaaaagtgaattctgggagtaatctgttactagtttcaggaatagttttaaaaaggaaggtataactggtatttgcaatttgagttatcatccatttaaatatattgtattttctttttttttctatttccttttgctttttttaaattacactttaagttttagggtacatgtgcacaatgtgcaggtttgttacatatgtaaacatgtgccatgttggtgtgctgcacccattaactcgtcatttacattaggtatatctcctaatgctatccctcctccctcctgtattgataggacgtatctcaaaataataacagctatctatgacaaacccacagccaatattaatatattttattttcaaataagccacatagcaagaataaattcctttgacatttcctaggctttatcaagatctgtctgttgtgaggaattcattccactacccaaacttcatttaagtctttgcatccaattagtgttatcccaacatgtccctctaatctcttcttttgcttctctagttctttgtacttcattcccatttttatttgcctataaaaaaatcatagtttttacatgcttaaactctgcaatgagtgtcttttaaaaatgttatacattttccctatttcgatctggttttctagatgtctaaatatcaaccttatgcacagcttgtcttgtagccctgtcaagagtcactggtgcaaactggttctgtaatcattaggcttcctagagattttcgcctgtttcttccactccccctaactggctgaagacatcaaaaaatcagacaaactgaaaatgtgaattctcgactctttgaaatgggcaagctacttgcaaaattgtgaagtaagttttagctatttgtctgtggctcaccacagacagcaaggaaaaggtaaactcctatgaagacaataagagatgatttcctgtagagaatttaaaaacaataacaaaggtgactgaaagtcagactgctttttattattagagtgtgtcaacaagtctaaacaatgtcagtgataaaatattcctcttgagaggggaccattaacaatgcccctcctccaccttggtacggcactataacccaaaatgatgagactctagtaaacctctggaacagggttttacacatgttaatctgtaacctggtaggcaaaattatgccactttgggcccgtctcttttccttttagggacaactactggtgcctccttcctagtcttatgagaagaatgtcagtagcataaattgaaatgggaattttgcttcctgcatatcgcatccacccctttttcttaaataaatatgcacatgctttttaaaaaaccaaacaactgtaatttcaaaatgtctttatactgcataagaaggaagttaattcttttaacatcttgttatatataccatctttattctctgcaaatattgattaatctaggaaaattcaggactgatacggtttggctgtgtccccacccaaatctcatcttgaattgtagttcccataatccccatgtgccacgggagggacccagtgggaggtaactgaatcagggaggtggtttcccccatgctattctcatgatggtaagttctcatgagataaggggcttcccccttctctcattattctcctttctgccaccatgtgaagaagcatgtgtttgcttcctcttctgccatgattgtaagtttcctgaggcctccccagccctgcagaactgtgagccaattaaacctctttccttataaattatccagtcttgggcctgtccttatagcagcgtgggaatggactaatacaaggactgagcaatacacaacatttatcttagcatcattttatgcattctgtgttcattatttattcaaaaaccacttactaagtgtcctttttgtatcaaacactgcattaggtgctgagcatacacacattaagacaaaggtcttgactttaagatgcttgtcaaaaaaaaaacttaaggttataatctctaacaggtagatcattatctatctatctatttaaatgaatctctattcatctatcttttccaaagtgctatgaaaacaggaaacaggttctgcttggggttgttcaggaaatcataaagtgaaatgcaaagtctaaaatcttcctgtgccattaacactaacaaagctttagtatttttcaaatggagaagtgtatcattaactagatcacaggtacagtcgcaaaacaagaaaaggaggaaataggaacactgctggcagatgagtcagtatatcagaaagtgggaagttgcattttgagtttaggcaatgtgaacagtttactaatagcataccaaatacaaatttcagactagattctttatacatgtgtttttttacttttctgaatcaaattcccaaacaatgtagaatgcaaagttatataagataattgacaaagttacataagataattgagccattaaataaaaatggaaaactccagtcacaaaaatgtctgaaactacagtgaaaattctctctttggacagtggaaagccctcagttcagaacagaacaagttgggcacttaactttcctgcagtgtcttatcttctatcttgtattagattgccatgtagaccctgtcaagaaacattaccaactgctagttaatgctgtgcacggaaaagtcagacttggtaatgtcaccacagaatttgaaaggatattaatgggtccttttcatttctgaaaaaatagagattagaaccagagaacttcccttcaaggacaatttcttttggaagaaacttatattccctttggatccatgaacacaagtacctacatcattttctagctgtggactcactctttcaaaacatactcagggacagctgatgcaaaggtaagcttggaggtgtagaaaatataaaaatcagtttttctcaagtgtgttccagggccaaatttttactgctgaattttaaatgctggtctatgtttaaggaagatcttataacagctagcatagcatggcacaacacatagagactcctcacttggttcattctccaatattttggggaatctatagttgaatatatttgttacttggtcctggagtaatgtgggccaaatggagaatcatttctcttatttgagatttgggtcatcatgtgtgaatctgtagtgtctagaataaggcctagcatatggaaggaagaatgaaaaaaaagggagaaagaagagaagaaaaaaggcaatagcacagtggggatgaggatactaaggaagaacaaatgagcacctgctatgtgccagatgctatgccatgagctttatttgtgcaagtttatttgatactctcaaagaatgtggcaaaacaaacatgattttaaagttctcattgttattgcttcatactttactccatgtcgcagttaaacattgaggttcacaattataacagtcttggagttttctcaatagcatataatttattccatgtaaagatgaagataaaaaaatgtagcttcccccatatgcctctagggtactctgtatgtcctgctgaagtagaaaagtcctagaagggagctaagggggccgaggctaccaactactctattaaatctacagacttgatggtaatgtctattttagaagaagctttccgcaaatgcaacttagattttaaagacatcagcaagagaatgtggataattccagagtgagggtagtgtctagcacattgccaacacttaagacgtgaaacacttaagaagcatgtttccccaatatgcttgttattaaaaagagtctaaaatatcttttctcctttaaatttgtctctgagattcaactgtgttagtgatgctgttaataatatactctaaatctgtcatgtacaaaagctttgctattgttgatgtagggcactttataatttatgtatagattcactagtaatctaaggtgtgagaaatggttcttcaaaaaaatcctgaattgctaggtatttatcctcaagaatagcataataatacctagcaaagtgtgctacatatattagttgcacataagattttgcaaatttgtaattctaaatgaaaattttgtggatttacaggcaacatatagcatggtaaaaaaaatacacacgtacatacactgcctattttgttttgttttgttaattaccatttggaatgcttactggataaaccattggttaacacaagtgctatttgtctgcttgagatttcatataaagagaatagtgataacaagaatacagtgaaagctgtttggtaaatgctgaataaaggcagagaaattacctgagccttctcctgaggtcccagcctaatggtgttaatgtattttttattgctggagaacttttcagtgataccaacaacaacaacaacaacaacaacaacaaaactaacataggctctagatgataaaacatgtaagaaattaacatagagatttaaaactaatattgacttagttttttgaacaagcttaatgtttacatatatcatgaaggagaatagcaagtatggttaacacacacatacacttgtatacacaaaattatcttttttgttttgagacagagtgtcactctgttgcccaagctggagtgcagtggcatgatcttggctcactgcaacctccgcctccgcccaggttaagcaatccttctgcctcagcctcccaagtagctgggactacaggcgcgtgccaccatgcccggctaatttttgtacttttccttcctccttcccctcacagacaatgattattatatgtaagagatgaataaatcaacaggtgtaacacaaacataggtatgtattgaaaatcagaagttcacaaagtattacagaacaatttgtagagctgataaaaactaagacaattaaactaggttatattcttgctacttagacaagaactaattatttaataaaaagatattactttgtcctaccactgagactagacattttagaggaagtgccaacttcaccagtcctgagaaaattcccactgaaatcactgtcatgtatcgactaggtacacagacttcattcaatatctccaatgctgatacagaatatatcaaaagagatatcgagaatcatgagcccaatctagtctaactcacagctggaagtacttgaagtttttcattctcaagttgaaaaattagtatataatgaattcttaagctccttaatcaaaatatgttatccaggatagatacagaaatcatatttgcaagattcagtatcacaccatgaattaccttctgtgtgtgacaactggggaacagacacaagaaacttcctgagtgctcagtcaacaataatttgaagttggtgaggaagtaggggaggttgcataaaacagcgcaagttatgggaatccttggacagctcttcgttgtccaggactgtcccagcattgcagtgtgtgtagtcctcatggacctcacgataactctctctttgtgttattacctgccctccactgccgcttgcttcccatacatacatcccttaggggaatggtgctgcctcattcaacagagaattcagcttggtacatgccacacaattgatgtgctgctgaagaaacataaattcacagctactcttcaagggcagagaaaatagctttaaaggtaagaaagatgctttaatttacagtgtgtacctgaagaatgcttctcagacatgactttcagatgtatggtgctcacctgtgacaggtactttgaacatttctttatattttaagatgaacatatgaaatttctattttttatagttaaaaactggtgaagtggccatcatttcatatggttcctatactcttgactcctataatcctcacaataaacttatgaggtaggaaactgaggtctaagtaactcacagctagtacgtggtaaacacaatgctgggatataggtgggcattttggcttctggagtcaacgcccttgaccactatgcatagtgccccaacatcccacacaagctttcagaccttagactcccagaacgcagggcctcatcatctgatcatgttaggtgtccagcatggaaccatatttataggcaatgcctaaatagatactattagaaggagtaatacatgatacaaaactcaacttcactcatgactcaaacacttactgtgtgaccttcgacaaatggttcccatttctgagggctaaacttttcagtctatcacatagaatgtatatggatgcattaaggaagggaacaatatgactgtatttgcattttcaaaaggatagtctgacagttgggtggagatcacaatggaggtggttaagactatgagaaagcaggaggtgatgagattctgaataaaggcaatacgtaagagcagaatatagatcacctcaatgtatcctgaaaaaaagtgggcagcatagccttgggtaagttagcttttctatgcctcaatttcctcctttttgaggaggaataataatatcaagttgtactttttgagtttccatctcttcctcagacatatatatatatgtctgaggaacacacatatatatatgttctgcaggatatgattacacttctgatttaattagcaaaatatttattagaagccagaggaccacagaggccaggtccttctagaggttaggagcaggtaaagtatatcttggtgttgcttttgatcttttctctggcttccagtttcctaagaaagctaatgctgccagtggcactatccatacagggtgcagtccttctgggtctgaagaaatgcctgaagattaatataccaaagttttatgaaattgatacctacatctcgaatactttacgcacatccattcaaaagagatttccatttcatggttcccttccacacacaggcatccccctcttccttcctctgtttttttttcttttttcctgcagcctttgacatcccacactattcgttttcttgtctattgcccatcttctccaactagaacataagttcggtgcagaaaagtctaattttgatcaatgctgtatttctacagactagaaaggtagtagaaaggtacctgagatatagcaagtgctcatcaaacttggttaagtgaatgaatgaatgggtatatgaatatatttatctcggactagctttgtgagaagacatctcaaaaccaagcttgcatctaccaatagagcattttgtcatctagtaaaacctccagaccccaaagaaaatgcaccacgcagaacttaaaaaaaatcctttaaaatgcattactctagtactttttcttgccagtaatgagaggagaaaaacaaagtctgaataactgttgcttacacgcatttaaaattacaatacattacactcttctcaccaggcaccattaagttcaggagaacatgcctttgtatatattttaaaatacacatcaaagtgtttttctttgaaatatgcactaaaatttgctgtaaaaatgtacattaatttaagtgaattcagaagattgattggactagggaaaataaattaattattcatgtcaccagtattttttaaatgcacagtggttatcaggaacatatataattataagtaatgctattattttttaatagcaaagttacagctaaggttaattaatatttttaataaaaataaaattttgttctttgaagttgcaaaatgtattttgttagctctaaatatttttcaaggaaatgtgtgtgaattctgcttacatttttcaaacaaataatattcatttttcatgagtacctccaaagcctccaagcaagcaacagaagtgtccaatatattcaaacattcttttcttgcataaacattaattgggttctttttcagaaaacccaactgggaatcaaatgctactgactttaataggatgtctcatatgtgaaatgaatgtctcttacaatctaccaatgatatttcttgaactctcaatagttcctttccttgagtaggtttgctaactctaccctgaaaaaatgcctaactgaaaccatggaactgctccaatacatttcactcatatttactgattctgtctcactttataatttaatttcttcccaagagttgcaaactatagtcaaaaaccagaatctctcaaaattttattctctctcttttctcaacattgttgaaataagataaaaagaaaataaaaaaggttatggattctaaaaaccaggcaaggataccacagacaaattttgctctgaatataaagaacaggacataatatgtattattcttatgaagtatgcttttcttgcaaaggtaaattttggatatgctgtaaaagtagagtataatataatttatagaccaaatggcatacttttgagagtcaaaaatatactattaataattacactgaacatcaggtatgcacaggtactatccaggccaactgggctgcatggccacatgatggaagacagaggtgaaatctatgttttggtaaataatcatgagaagacctaattaagagcatcatcactagaatcaaagaaatcttagagctgagtacaacttaagagtttcctagttcaacctacttattttacagaggcagcaaggccaaagtacaatgatgtgacccaagttgtccaagtcacatgacgagataggtggttgtgttgaaagtggaaaccaggtctcctcattcatcatgctctttccattatactacaatctctctacagtatgtatgtattctctatagtatgtatgtagcttgtaaaatattctcgaaggaaagaacaaaaagatcgtaaaatgtgctataaagaacattccagaaacgatgtcacaagcttgatcgtaaaagaaacagcacagttcaattttcctttctttgtggacaggcaaaggaaggaagtgttgtcctcttcatgttggcttacatgtactcatctcataagacattgcaagtttaattagaagagggggaacatttagcagccaaaaaacttgcatgatactcctgccacatgccaagaagctctcagaatctcaaagaactttataccaccaatagtttttgtgaatatttgctttctgagattagccttctggaaagtttcataaaatcaggaggccttatggaaacatttaaaaattaaatattccaagtaaaatgaattttataaattttataaattttatgtaatccacataaaaagtactatcaatattgttatattcacattaaaaaggaacaattcgatcagaagttttggtaaatgtccctattatttcttgatataaatcacatcttcctaaagtaaacattgggctgaaaattgattatcattcaaagcaaaacttcttttttttttttttacttttaaaaggatatttactttaagtaggaatataaacaggactttatggaggatattttgatgaacactactatattctctgagtctgtgaaaactgaaatacatttcttccctattactatccctgcaggatggctgaacaaacctcatctcatctatttgaaatgagtccaatttaattctgcctgaccaaaaatctgtttccatagttttaaaacatgcaatcaccccaaggtacattgccattgtagcttaagtggctcagtgttatcactgagaaaaatgcactttgattgagaaaacagtccagtgtggcttttgaaaaatgaaatgaccctttctgatacacaatttagtaagacagttgataaaagcaggcggatatggccactatagacaacatttaaaggaagatgcttcatccaacctgtaaaaataggtcaaagtttacagtttcgaaattaacattagaaatttatctcatatttaaacttcctggtttaaatattactgtatttagaggacaattgaaaagtcaattacgaattatggaaaattttcaacaaattattctgtcactcaaatataaataaattgctttcttccctaatgttttttccccatacatacatgtgttgttatctgtattcatatatatatctcactacttaagagacttttaaaacctattagcccaactttaaaatactgttgctactactgaatacttgtaacatattaagtcaaattctttaattactgtcactggtttattacaaagctaacaattttaaatatctatttttaaatgaacctaataatcttttatttaagtcaatatctcctcaaatgaaccaagtattcactaattaattagatcatttacatctataaactgctgctgtcttcaaacatgtaatagcttataataaaagaggctcttttcattggcaattaaggagcagttaactctttaccttctgcattttaatattataaaatgcataaatctttatttctgcatttctacgtatttagctttcaaatgaaacagctgttttgtacttaaaaataatatttcttaatatatgttactaattgacaaaatacataaaaccaatgctgataatattttcttcttttgggacacacctggtttatataggagatttggcaactgtaatctcattaatgataaaacaagactactaagaaaaatacctgattatttcaaattatattcataaaagcattcctaactctgaatgtcctcttgtgaattattttagataaaggaaagtctatcaatttatttgtttcatttttcctgtatcagatttactgtaataacttgcttatcagtaagtgaaccataaatctacagcagtaacaaatcattaatgaaacattagcaaagaatgttaaatggagctattgggcaaacataaatctttctaaagtcacaagtctttatccaaggaactaagtgctatgatgttattggcaaccttataaatcctaacgagagaaaatcaacaaaaggatcacattgcaggcaaacagtcctactaaaatgtatattctttgagggcaggggtttcgtttgctgttaccaatatatcctcatgcctagaaaagtatctggcacatgtagacagtgatcaataaatatatatttgtgaacaccctataagacatcccattttattttgtagccacatgcaaataggaaacgaaaagaaaagagagaaaaatgaaaataagtgcacatgtaggtacaatatatccaacactacatttaatttgcattttttgtattttttgcccatccctcttctaggacattttctcttcatctattctgttcctctcacccttttccattcaaagtaaaaatcagagtcaattttcttcattttctgggaaacatgttaattcatatttggggtgctgatacaaacagaatttgccttctattattttccttccaaactggatgcaggtctgtttcaaatgcaagaagtaaaagcaaatttaaatataattatcattcttgcttcttcagaatgcatttttctggaaaagtagggatcgtgtatttggaaaagctttaaatggcacctactgaatatactcactatcagtaaaacagaacaaaacgaaacaattaattttggaccaaggataatacacaattctgaaaaaattaacaactggatacatacaaaggctgcaaataccaacaggaatctaatggcatttgaacagcatctaacagcatttcgaataaggtttttttttccctgtgttcttcactgatggaacaccaatattcaaaccagtgcctgaaatgtagtaggcaatcaataattatgtcctgattgaattaacatacttccaagttgtgcaaatgccacatttaaaaatcatattcttcaaaaattttaggcacaagattgaaataagctaattagagttaattgtaggtgagggcaattaatcacatacacaaaatacctcatattttgggtttgtgtgctcagataaaccaatagaatgtttttttatttttaaataaatagtgaaagagtatacccatcattcaccaagaaagccacatggctggctatcaattcaaaactttaaacttcaaaatactatagaagtattgtactattaaaatatctcttttaagattaaatttgccttgattttattttgaagtgctgagcttaaacagacaaggttttcaaatatttcattaacttgttcatttaaactaaaaagtgaaaatcctatgtaattagcagacgatctactcagcttgggccagaggagggttatggaatcaagactatcatttagcatctaacaaaccaaaacaaaatcttttgtaaaagtccacaaacctctaatgaacaacatacacacatttcatattcaaacggaatgcattatgttaagctagtttcaaaggaagctgtagtgcctaagatcagaaaaatgttccaatttagaaaagacgcatatgcagaaaagcccactatcataaataatataggatgaaaatgaaggaataaaatccacaggctcacctggctaatgggttcttttgtcgggggctttcctcttctggctgtgctagtagccagggtcgtggtagtctccataattgatgtggacatctctgattgcatggcagtggctgttgactcagttgtcatagaggaaggcacttcaccaaccagtctcacatttcccactatggcgatgttggcatcgttttcggctgccatattcagaactttcaagccattgtagtacagcccagagagctggccctggaagggctggccctgctctttcccgccaattattatggttgcttggctattgaagattgtgagctgacgccctgtaaaaataatattacatacatgcaaaaatgttgattgtgaactctatatctacaatggatgataaaacagatcttttatggggtgaataatgagagcaataaactataagagaggcatttgactcataattcattgcttataaatgaggtgtccatgaaatgcataattattggcaaatacttgtaaattctcaacttattataaatgtagtgcttttgctaaaagaccaatcaaagatatgtattacaaatcagtttttagtggatcccttttcccttttacatcaagatcttatattgttggtgtctaaagtctaaattgttaaattttaaaaatgtaagacaacatttcaagtatttgtcattctgaaattaccactgacagaaactaatacatagcagctgaaatctaatttaaattttatggtaaaaatttcataattcacataatgtccacatatatctatatgttattctttagtgctgtttattttttgaaggcaattattcattgttatttgaattattctatttttccggcaatcacactgaaaagaaattcatggtttacactgagcatgtcagagacaaaaaaattccaaaaatatttttctgattggctttcagcaagtctatcaaaacaaaacaaaatgaaaaaaaaaaatagcttcagatgtaaaaagcggcttcaggaatgatacacaaaccgatggagaaattatggcacatttccatcaaacagcaatccttaataacagtaccattatcatcaaattgagtatccagttttagcagattgctctctgctcataaaagcatgcacacaactttaagttcagttttaatatgggcttgttcccaaatcctcttagaaggttgcaaatgttaaagggacttcattatgactggcaattcatattgcccactatttaagattcctagagtttaaacaaagagtttttgtttttttcaggaccataataaagatatcagaactacatatattttagttaataatttagaggctggaacatgtaatatagtctatgaatgatttatcattttgggttaatgcttgctgtgagtaccctcatagattgagttagtggattatatttaacagtccctttaaccttaagttaactgggtaagattattaaacagctggtacgtctaaaaatgtatagaaattattatacaaggtatgcaaatattactatctacattttactgttttaaagttgtttttaatttagttttacggaaaatttattttttatgtttattagtgttacaatgaagtactacttggttatgttcaaattatttttttatttgaagttttaatcaatgttttttacctttgtcgagtagccattcatcaactactcgaccaagtcgatatggaattcgctgtctagcaatcgccaggcgctcgttatcattgtttcctttaaagtttaaagagacatttcattggttaaaatctgtaaggtcaaaggttaaaagttaatacttaaagattgagctatacagttgccacatgattttttgaaatttggaattttaaaaagttctacctagaacatttcatgtttcagacttgtcattcattcatttattttattttagcaaacaaaattattcctatgttaattgaaaattagaaatctgcatttgagctaggttattaaacttatgttatagacagacccgaacaaccaatttaaacagcatataatagctttacaaaaaatgaccaatgacctcagggttttgtctttttgatgtttcttattaactagttaaacatgttcaggtgaaacaggtttaagttttcaaaatacattcaacctcttattccagattaataatttatgatcaccaaacttaataccatatttggcacactgaagcatctacaataggcctagcatactttatttcctagtcagaaaacagaaattcttattcacctcatttaagaaaacaacaaagtccaaatagttcttgtgtatttcacacaaattgatttatcaatcacttggacatcacaagagaatgcatcttgcatcatccagatacgttattacaggaaaaggctttgacaaaagtcactttatttgagtgtccttgagtttcatttaaagcttaacatgttgaagcaaataacatttgaaaaaataattatatgtatgtttttatatagtcaaatatctgctttttattaagttattctttaaaagcatgacagcttaaggaacgaatataagccacaaacagtggcccctattcatagatctaacctaagtgagagccctgcttctttgcataaaaaattatctgctagaaacactgtttaaattgaccttgaatattgcttgcaaatagatgagtgttttcttgatctgtagagcacttacgaagaatctgagacaccatctcggtgttgagttgtgtataatgcaagaagagattttctattccattagagttaactaacatggaaatttaagccaagacattttggcattagctcagatgaggactcagaggtgaaagaaatgttgaatggtagcactatctgcataaaaagactggagtgttttgttagagaagataaatgaatagatttacattttattcctctgatttacaataatttataagtgctttcttttgctactcttataatacattatacttaccactaataagcccagcataatactgattacacacttttggagagatagaaaagaactatcttttagacctcatcaatttgtcatctgaatgtctatatgactgaaaatatttcacacattaatatttaatttaaaatgtaaatatcaaagtcaaggcaaatataaagtttaatgaaaacattaatatgtatttctctgtattctgtgatcactaaaacattgtaaaataatattttataatgtgggaatatagttttgttaaactaataatttttttaaaaggacacaaatggtacaaaattccaaccctgtcttcattttttaaaagtgtacaaaatttgtgttctctgttgtgtgtttgcatatatgcatatttggaatttttttttaatgtaatattagttactttaggacagtgtgattattgatcaattacatgtttttggcttataagtgattttatataataagcatgtttgacatgtgtaatttgaaaagcaatcacaaaatattttcaaaaatacataccctttgctctatagtcttatttgtcactcaatactcataccaactcacattggcataacacttctgacaactttatgattaggtggttcctcatgtttttcatgctagagtcttccaatcatcaggcatgacccacattctctcagacaccatccgaatctaggtcgcaaatccctcttgcccaattactactacagtctattgacagacctctctacatcttctctgtgattaatcacacccattttccatataagccaatatctaatcatgtcacttgtctagtataacccttcccatttctcttaggataaaatctcagacccttagtgaaatttgtaagtacttccacaatctggtcccttcctacctccctgtcccctctcacggccatcactgcctcactctgctctttttatccttatgagacttctttcaattcttccaaatcttttctttcttctctctgggactttgcacatgtagcttcctttatggaaaatactctcccttgttcccacctcatctctatctttcattagctaaccattactaattaatggaatcttcttggtaggaacattgcttccccagaaggtattccctgatgtcatcaggttacattaggacacttgactatattatttgtagctcctgaaacatgccctttagaaagaagcattgaacctgtaatggcaaatttgatagtttgccttcaaactctgaatatccctccatgaggccaagtactatgctactatgtgcagtatttattatttcttcagtgcttacttgcacaatatctatcacatacaatcctattaatatctgtagaatgaggtagtcaagaaaaccttgtttttagttctggtagcttctgttgcactattaacacattcttacaacctaacaacattaaaaagaaaaagaaagcaaatactagtgtccagagaataaaccacttgtagctaagcctccctttgcactttccaaaggaaacaccataaacctcacttataattttattttttgatgaattgtcactgatttgaacatctctacaatcagttcattatttgtttaataataaattccccatgtcacaaaattggtaaacatagttattattagtagggaaaggttggggaaaaaaaggtctaaacaagacaggtagagaaaaatcaaagctttatagattattttaatgacttttaaaaagatcacataaacacataaatacattcacacatacatacatagaatttgtcctcaaacatttgactagtactaataaaataattgtgtgattgatatagtatgacagtatgatgtaagtcaacagaagctttggagatccttgctgagactcagctaaagcaagaacataaacactgaattcccaatgattaacagaggtcacctaacaacaacaataaaacaatttagaaaatcgaataggcagtagacacaagttatgaaaatatgtgataatatataagaaaggtagccacacaagggggtcatatcttcctactaccccagaatatcagatgcctactaattcagtgagcactgttttaaactgaagaactttttaattacaggacagactttattcttgtatgggtaatgaatggaaaatcagatggtgcttattcaattcaatatatacctactttattctctaaattctttgttctcctactagaataaaaaactaatgactttgttctcctattagaataaaaaactaatgacttttctgctgcaaaattatatgcagatacattgtgatatggtttagctgtgtctccacccaaatctcatcttggattgtcgctcccataatccctacaagtggcaggagggacccagtgggatgtaattgaattatgggggtgggtttttcccatgctgttctcatgagagtaaataagtctcacaagacctgatggttttataaatggcagttcccctgcagatggtctcttgcctgtcaccaagtaagacatgactttgctcctccttcaccttctgccatgattgtgaggcctcccaaccatgtggaattgtgagtccattaaacctgtttttctttataaattacccagtcttgggtatttcttcacagcagtatgaaaatagactaatatagtaaattagtactggtaaagtggagtactgttattaagatacctgaaaatgtggaattgactttggaactgggtaacaggcagaggatgtaacagtttggagagctcagacaaagacaggaagatgtgggataatttggagcttcctagagacttgttgaatgatgttgaccaaaaagtctaggctgaggtggtctcagatggagatgaggaacttattgggaactggagcaaaggaaattattgctatgttttagcaaagagactggcagcattttatgcctgctctacagatctgtggaacattgaacttgagagagatgatttagagtatctggtgaaagaaacttctaagcagcaaagtgttcaagacgtgacttgtgtgctcttaaaagcattcagttttattcatttataaagatacagtttggaattggaacttatgtttaaaatggaagcagagcataaaagttcagaaaattttcagcctgacaatgcaatagaaaagaaaaacccttgtcctgaggagaaattcaagccagctgaagaaatttgcataggtaatgaggacccaaaggttaactgccaggacaacgaggaaaatgtctccagagcatgtcagacatcttcacaacagcacttcctatcacaagccaggaggcctaggaggaaaaaatgtttttgtgggctgagccctgggtcttgctgtttgtgcagtctcaggactcaggtgtcttgcatcctagctgtggctaaaaggggcaaatgtacagctcaggtcgttgcttcagagggtgcaagccccaaaccttggtggcttacatgtagtgttgagcccgtgggtgcaaagaagtcaagtattgaggtttggaaacctctacctagatttcagaggatgtatgaaaacacctgaatgtccaggcagaggtgtgctgcagggacagaaccctcatggagaacttctgctagggcagtgcagaaagaaaatgtgagtgggagcccccacacagagtctccactggggcactacctagtggagctgtgagaagagggccactgtcctccagacaccagaatggtagatccactgacagcttccaccatgcacctggaaaagccacagacacttaacatcagcccatgaaagcagccaggagggaagcggctgtaccctgcaaagccacagaggcagagctgcccaagaccatgggaaccttcctcttacatcagcatgacctggatgtaaaacatggagtcaaaggagatcattttggagctttaagatttgactgccccactgtatttcagatttgcatggggcctgtagacccttcgttttggccaatttctcccatttggaacagatatatttacccaatgcctgcacccccacggaatctaggaagtacccaccttgcttttgattttataggctcataggcagaaaggatttgccttgtctcagatgagactttggactgtggacttttgagttaatgctgaaatgagttaagactttggggaactgctgggaaggcataattgattttgaaatgtgagggcatgagatttgggaggggccagggatatggtttggctgtgtccccacccaaatctcatcttgaattctagctcccataatccccatgtgtcatgggagacacccagtgggaggtaattgaatcatggggacaggtttttctcatggtgttctcatatagtgaataagtgtcatgagacctcatggttttataaaggcagttcccctgcacatgctctcttgcctgccaccatgtaagacatgcctttgctcctccttcgtctttctgacatgaatgtgaggcctccccagccatatgtaactgtgaatgcattaaacctctttttctttataaatcacccagtctctagtatttcttcaaagcagtatgaaaatggaaacattgtgaagacacatctaaataaagtacagcgacaatgtctttttaatagatgattccccaaatccttccaccattaggtataaaatagttcagaatgtttaggttctccagcgactaggcctatatttttcctttacctcatgattttcataaaaatgttgcatactaaaaggggtaatggaagtatattattttaaataatttctcaagatgtattttatttctttacaaattcatggtgatatttacttgtaaaatatcattcagtagctttgcatgattttgctgattatatttaatactgtccattgttcaatatacatctagaccttacatgcaatataaaggatataaaccatttgattgggaaaggtcaaaggcaaaaataatttccaatgaccttttcttttctttggaaaggttcaggatctaatatcaaatatgctgggatatagaagctttacatacagcatttgtgaatggtcagtgtaagcaggcttaagctggtaggtgagatgaaaaacaagtggaatgtccctgaaaattcaaatcaaaacaaagttgaatctttcgaagaagacatttttaccttcaagtattctaaatcagaggtaaggataaagcaataaatgacccacttttcaaagatctatacattccgggctataaaaagggtccaaaaggaatttcatctctttctaaaagcataaaactctactatagcaacatgctgagcaaataggcttgatttataaaagcagagccttctcattgaatagttaaaagataacaatttagtctcacacttttcccatgataaaagcaagataggattttcctttgatttctttttcctccagttaattttgtgtggtttgatctgttggtaccttcactgaaaatgtcagtgacaacatacatgcctctgccgaagtaattttcaagcaatgaaactgcatgtaaaatttggttttattttcctttgaatttcaaaaagaattaagtatttttgacaggaggaaagactcccttccccccaatccctgtagtaatgccattgcaacaaggtacaatctctaattgtaaggtattaaatgtcattgtaaggtattaaatatcattaatacttcaaacaagtttcctggggtgaagaattcaaaggaaaatctgatggcttatatttggaatgtataccctctattttgattaaatcccagataattttatttgcctatttgtatagactgaatgtttgtatctcccaaaattgatctattgaaaactaattccaaatatgatagtgtcaggaggtaaagcctttgggagctgattaggtcatgaggaaagagctctcattaatgggattagtgcccttataaaagaggctccagaaaactcccttccctccttctgtgatacgaggatacaatgaaaagatggtcacctgtgaagaatgaagcaagccctcactagaaatggaatcttgtacttcctagtcttccgaattgaaagaaataaacttttattgtttttaagccactcagttaataatattttattatcattgcccaaatggacaaaaataccatgtaacaatatttggtcacattttagtctatttattctatatgaacaagcagacttccgggaaatgagagtaattacaaagaatcaaggtaagtagcacaaagcaataaaactcaaatccttgacttggagttaaatttcatggtgtgactcagagaacaaagataaatacaattttaatcatattgttataactatcgatcagtagagacaagctatatgaacatcactgatgtatagtttttctcctttcattttagttcttcactcttgtgtaatttctcctcagaaataaaagtgtcagcatttgatatgacatattaatatctatggggaaaaagtaaagaaaaacaatgctatgaaccaaacatttgtgcagaataatatgaaaataaaaataacaagaacaaaaagagacttgcttctttggaaggcttcttatttcttgagtttttaacattgggaaaagaaacacaaaaggattctgaaagtcatctataccacaagagaagattagtaacctgtgtacagactgatttttaaatgagaacaagacatttggatatatctaggcccagaaggcaaagtaatagttttgtaaacatactctgattttaagtgcagcataatcacataattttcaactgaatgcaatgtgtattgttgtcatatagaccctgcaaataccataatgcctcacttggctgataatgttccaaataaatagattttgaatatcgacaccttttgagaaacaaacttttgaaaaatatagctattctaataaaacatttgtcttatatattactttatttcctatatcattaaaatgtaaaagccgaatacacatatataattggctccagcttactccagtttcatcttgaactacttttctctgactctttaaattagtcactttgtaattttttcaattcctttagctaagccaatccactttgaacccgacattctcctttgcattgcgaatttcttgcatccctgtgtactcaacatctctgcccacctcaacagacacacacacacacacacacacacacacacacacacacacatctaaggctggctaaattttttcttttttaaatatcagcttatacatttctcaaggaagcattccctgtgtcccctactgctccaccaaattattctacttaatgaattcttccactatgcattcttaaaatacttagtagcaatatctataatcatgatcaaagaagttcatgtaattgattctagattctagattccttgtgagcaggaaccatgtctgtcttgttcaatgctgtacgccttatgtataacacaatggtgagcacatggtaattgcttgttaagtaatttctaaatgaaaactgaacccatacagttatgcaaaaaataccacttgaggtaattttttgcatgataacatagtggtatttcttgttcaagatccataaggcagtgagattgttagtgtccacttacatatatgtatatatagtcacaaacaccattggattgtgagaggaatagaactttgcaaaacgttatagtaaattttgcttggacgtcagatttccttttttcttcttgaccatttagtgtccactaattacatatgtgtgcatgtctatttagtttattcagtttaccagacactaaactaaatagagataaaatatgtgtctctatatataatatatataattactgattcattatatatataaaatgactcagtaactctgcttatctttcatcaattttgaatttgccattgtagtacacaataggacaaatcttttaaatcttatttttatgattaattacaagtcaatgatttatagtctgaggtgagctctactgtggtgcatacacattagcagaaaaattaataccacgtgggatcttctttttttttttctaattgtgtagagagctgatcatgacaatctttgatttggtcagggggaaatttctgcaagtgcttcaattctctaatgactgtgtacaagaaacagtcttggacttgatgaaccttcaaaatatgtatcatctccaagactatattttctagatgaattttagtggtgaattctttcaaataaattgaaatgttgatactctggtttctcttcacatcgtattaatcttttactaaattgaatcttttactaaactgaaatgttaaccctccaaggagcatttacttccaaagttcatcaataaatacatcaatgccttgtaaagaaagcaacattcatttaaccaaggcaaaaatgatacaaagttgaagcttataaagtcaggtagtagaagttatggatcttctagcctttgtaacatgagggcagagggcttctagaatttgcctgatttgtggctgataaagagcagcgaggggcttggattgtcttctggacttttaagacctcactgaatgatgaacacacactaccagaatcaaaggatggtttttgtcagacagcaggactagaccagacagtaaagctacaattaagtttcatgcatgctgggaaatccagtttttccgtatgaaagtggtctgtaggtaaagaaactgaagaaaacaaaggaccaccagaaaataagaaaataatgtattgagtagcttcatgttttatgcattgtgttacttgcttatttaggttatcttgtttaatgctgatattgatcccagaccataagtaccttttattttactgatggaaaaactgaggctcaaagagatgacataaaactaatgctgcatcatacatcatagaaagagggaccatttgaatcaagataaagctgactcgaaagttgttccatggaatagttataaagtaatatctcttaataccgtgagtcataagggccaacatcttctccttaatccttatagcactcttttgtataatgtaagatgtcattaaggcttgtctacaaagtttctgtcttctagattctggggtgagatcgcccttatggacacatgaaatcagtaatcttccctaaatcctcaacgatttatcaggaggataattttatcatctccattttatagattaagacagtgaagcagaggtaagtaaagtgatcaaagacctataacagtggagatcccagtgagaagcagtattttgttttttttccttttataatgatgccttgtatgcatagctactggaggcataaaatgttccagacattccttgtctttacctctaacctataagaaaagccacaagcataataatccactaacttcagtgctttttggacgttgaacctctccagaaacacgttggaaatggagagaggatcctagttgtgacacaaaagaccactgtacttcattgacttgtcagagaaaaagaatattgtaacatgttacagtaaattttgcttggacgtcacatttcctcttttccttcttgcctatttcttatctctgcgtttccttttacacagctccagaaacccagtgctttcatgccacctgtcaacaactcaaggcgtatatttacaactgcggttcctacacatatctcatgttccaaaaatacttcaccttccttcttctctagtgccaataattaaaccctggtttctttagtatagctcggctagatgttagaaaagcaatcggactcaataaagtcaatatataagcagtgcccatgtactctgaaattattgtactctgaaaggcacacatcaatacatcacatggattctattgttgaagagcttacacgttgtctagggagtcaaggggacaaatgaggaaagttaaaaaataaaagatttaagtaaaagttcaagataatagataatgagacataagtacgcaattaaccaccatgtgaagtgtagttgccatagaagttcagagagaacaatggattagagcaaagaaggtgtgatggaacacaaacgattgcacctagatcacaatcaaaatgtcattgaaataataatgagctaaaaatttttcataatgtgaatattaatcctcaaaaggttgacaattgatcattatcctgaacttcataatgctattcacccaacatctatttttaaataaatagactctccaataaaacatatttagtctcaaaatataattacaagtatgaccaataatggttaaatattcatgtcacgaaccatgaaaaaaaagaaaaaactctcataaaactactaagtaaaatgcactgaaaatcggcaagaatttgagggcaatgtgtaaaagtgaaatatttgtgttaggatggagaaattaatggtgaccttttttcaaacttcaattttatattattgatactgcatgtatgcacatttcaactttgttcccactgcttccttaaacacatacacacacgctcatttctctaaattaaatgcgatatattaatgtaatgctacaggaagagggggtggtgcaactcaagagttctgtcagtcattctcacagctagaaagagcacgcacagctcaagtagggtgatgcgctgttcgtgactaatgcttcagatgacatcccagctccttatgtgaaacagcaggcttttatatccagttaaacaatatattcatgtgagactgctgtgatgttgggcgtagaaggctgcaggctgtctactgcagagttcaatggtgctttggggaagaaattagaatcttagtgcatgtctaactagcttaagtaatttcttccttcacatccctctcttatgtggatttacattaagatatctaagtgttttacacaaagatttgtacaagcacttgttcccactagctacttacattcaaaaattttggtttggatattgtttcatcagattaatttgaaataaatacaggtaaccttgtgaattttggatctcattgcctgtgtggaatgaacagtgatttaaattttcttccctacacctttaaatgctgtttgtttcccattgcaaaggcactggagtatcatatcaaaaaccagcagcaagaaatgaaaagcagcagggacaagcaggtaacaaaatacagaacttactctgataaattaaaggtcatactctgttatcatgcatactaaagagttattttgtgccagttgtgtagcatttaagacagaagaatggtttaacagctacaaaaacaggcagagccattgatagacatcactaaatactgagaataagaaaaatgaaaagtaagagcagccccacattaccttacaaatggcattttgccattttcccagatatgagaatcttgagtactttctaaatcataatgtcataacatttaaacctatccgctctaataaaaacctaaatatatattttttctaaagtgtcttttcccagttcttgttttttgaaaattggaaaattatgtggttcagctgaaatttctacactccattatcagtcttgacttttaatctagtcttcttaatattcaaattggtccacggaaaaaaagataggtgaatgtttcatacacagtctgatgtggcctataaatggaactgcgaaagttccctattctcaagtggaaaagaaaagtctgattattatgacattctgatcttattttcaatggacttcaatctctctcttccagttgtaactggaatgcaagatttttttttcaattagaaagatgaggtttgtccattgtatgcaaataatttaagattaaatggtctggaattgcaaaggaccaagagttggataaaggtgctggataattgctagccccattcaattttataaaatgtaaaaccactgaagtaaaataaccatttttttctttttgtagataaattgaatactatggatatgaatttaaattcctaaaataactttcccctaatacaagttaattttctctaccaccaattatttcttaaaagtaattatcctgtggtcagaatcactgaggaaagagaacccttgatggttaagataatgagctctaattcctaggttcaaatcttggcttcaatattgactagctggatcagtagcataacatcttttaacctcagttttctcatctgtaaaacagatatttgtaagaatagtatccataatatatgccaatctcttagcacaatgcctggcacatggtaagcactcagtaaatattagcccttatattgtagtcatgtcattgtttattctctagtatgatgtgccttacacaatatatctaagaatgtgtacatcacaaaaaatattttttttacccatctgatcatagaaagttgaagtaaatgtgaagaagagtggaaaataaatctattatctttcccagaatgagtaatggccaaagagtgagccttattatgagtgatatcccgaacgtaggtgctttatcaaaatcactgcactttctcccaagcaatgtcatctttattctcagaggtttatgcatgctacttttaagtcaatgggaacaactgaaaagaggtcattagctggaagaaaccacacaaaaagaaaaagccaacagcccctgccctgagggaaaacagaattcagggtactaccatgtgttctgtgacagcagcatggtgacaaaagctgttcccagaataagaatactttggatagcaatgaagtcttaaaatgacattttaatccatatattaatgcttcaaagggatccacttcaactagaatgccttaactcttctttttgcccaataatgctcctggcaaagaagggccacagaaaccatgaacaggagtggatgctgcttgatccattttctgcaaaatgagatttggggactggatggcttctaagctgaccctcaatgctaatggcccatggtcccaggtatcagatggtgttgttgtaaagacaagcattaggccaccttgttaaaacatggtgattgtggattttcatgaggaaattaattttagagccattaaaaataaaataccataaatgttttttaactcagcaaatatcttttaaaaagcagtgaaatatttggcttgacatgttcttttcttcatctctctctgtttttaaaactaacttatggtgccttgacaattttatgaagaatttcagttggcatctgtggagatctttataattaagccattacatttttctgaaacgtttcatgttttaagcttgtcttctttccactttgtgctatacagacacacccacctcttatcactgagacatttctctgcattctttctacccatttaccacagcatgtcatggttttgacagccatcttaagaggaggaaggcagacataggttagatttcaggagattttgggggtttttttttttttttttttttgagacagagtctcgctctgtcacccaggctggagtgcagtggtgcgatcttggctcactgcaagctccacctcccgagttcatgccattctcctgcctcagcctcccgagtagctggaactacaggcacccgccaccacacccacctaattttttgtatttttagtagagacgggttttcaccgtgttagccagggtgatttcgatctcctgaccttgcgatctgcccgccttggcctcccaaagtgctgagattacaggtgtgagccactgcgcctggccgagatttcagttttatacagagtagttaagacaatgaaggacaaggcattatgatactaggaaatagagaagtttgtctcctcttcatttgaaatttttagcactaaagagattagatcagaaaaatttaagaagaaatctgaggacttcaagtcaatggctgctctttgcaagccctttttgtccaaagtgtatcaaaataaaccttttcttggattgctgaaacacctgtgatcatgggatcagtacttttggagctatttctggttcaagagacattctcatgagagttcctttccaatcaaatctgtcaggggctgacttaaaaacctgtaagtgggccagacacggtggctcacgcctgtaatcccagcactttgggaggccgaggcgggcggatcacaaggtcaggagatcgagaccatcccggctaaaacggtgaaaccccgtctctactaaaaatacaaaaaattatccgggcgtagtggcgggcgcctgtagtcccagctactcgggaggctgaggcaggagaatggcgtgaacccgggaggcggagcttgcagtgagccgagatcccgccactgcactccagcctgggcgacagagcgagactccgtctcaaaaaaaaaaaaaaaaaaaacctgtaattggctcagtgtaactcagactaagtagagatcaccaattaaaacccaggcatcctaaataatgcagtaggtacagaggagaaatagttcattgcataaaatatatcagaataaaactataaatttctctacttccttcagtatttcttcttaaacttaagctacctgttatttctagtgatctctaaatgcagaacagaatgaagacaagataaaaactacaaagatatcctatcaaatttgagctgatgctccattactaaggacaattggaattgatgcacacacatgttcttctccatcttttttatagcccaatagatctacagttaggctgtgtcatatacaagaagaagcctgaactaactaggccgtataactctggcctgattaacactttatctaatactttttctgaagtcttttaatctaagtcttgttttgacttcattgaaaataagcagtttgttggtaatcgccacacaagaaccctacacatacttaaagactgttatgagctcaattgtttatcccccaaattcatatggtgaagccttaacccctaagacctcagaatgtgatggtttctggaaacagagactttaaggaggtgattaagttaaaatgaggctgttacggtggatcctaatgcaatctgactggtgtccttataagaggaagactggacacacaaagagacacaagggatgcacaggcatagaggaaggactatgtgaaaacccagcaagaaggtggacatctgcaagcaaaggaaacaggcctcagaaggaatcaaacctgctgactacttgattttggacttccagcctccagaactgtgagagaataaatttctctcatttaagctaccactctgtggtattttgctatggcagtcctagcaaactaatacagagataatttaaacgtagtttgaaataatatattgttagtttattcacagatctttcatattaagatgtgatagtattttgctgccagttgctaaaatagtctaaaagcgagtactcatggatttgcacacagaataaagctctgtgttaatgtcaaaatcatgtccattttaattattaattttagttaaaatgtattttgtcctgttctggttttgctgcaaattgtaatattctacattacagtcctggtaattagtacagttaccaaataaactctatccatgtacattttttgcatgactaaaactataaaataatattattttcatcatgaaatatacatgattatatgtagttccattaatgtatatagaacaacttttccaaaaggaactacttaacctctcataccattaaatgaattttcttgaagaaaacaaagtattttctactaccattttcttcactttgtggctccttataacttccctccttgtaacacctgctacgcggatgactgcagcactattaaaaatttactgtcagtgttagctttccaagttatggaaaaagtctcagtgcaaaacaaacaataaaagcaactctgcataagacaaatccttacttatgttaatgattacatgcggtgacattgtcttatttaaatatgcttatattttcttcaatttggaaactactgtgagatcccaaaagatacactgtgtccacttcaaaaactctaaaattctaagtaccaaaggacaagcacatatttattcacactaatttttatccttaggaactgcctaagaaatttaaaaaaaaaaaaagaaaaagtgattttgagagattataattagttttgtgaggcttgctaaatagtcatggcaaaaaaaaaaataaaacagcaactttcactgttaatttggaatgtttatcttctactcaaaactgaacgaatgtcttacattgttgtgctttttctttggtgcttatcactgaagaagaatgccaattccaagcccaacttggacatatacctcagtaaagctgccctgcagcagggctgaccacctccactgaaaatgcctaggcacagtgaaggcccagcaagtggatgacggcatcagctggtcctaaaacaaaaagacttgagtactatatggatgtaatgacctcaagatcccctatatttcctaagaaattagacatagcttcatcattttcacctatgaagacaaacttcaaaatatttttggcctgctttttacttaaaaaaatgcttatgaaaagggagtggacaaactttgtctatgcctttgtcttctgctctcttttgatgttcctggagcctatacccttaggaagaacttgatcttgaattacaatatcagtgtccttcaaattccacttcccgtgttatagtaagcaatgcctggactgtcatgtcacctagcttagctccagacatttgcagacatttattctggcccctttagactattccctgcactttagccagaaaaattatttgaaatcatgtgttatctgcaacagactatgtgttccaagggggtagtgaccattcctgcactccatgctgtatccctagcataagtccagacacatagccggtcttaaataaatatttctgaataaattactgaattcactgggattacctctcctcagtctcttctgtcttccactatcctttgttctaacatggcttatcaatcataattaacctctagaatacttatcaggcctcactcatgcttccagtttcttttccatgatccagacttactgaatttgccttctattcctttcaaatcctgctttttgctggcgaaaataggtagtcacagtagtgctcactttttttaatgcagtagaaaaagagaagcaatttgacattaatatttagatatggagttaacttccttcttgaaacttgacataatgactctctgctaatcatttgtagagatagtcaacaattctagtttaggtaggaaaattgagaataaaaaaaaagcataggcctgttaatctctttttaggaagagtttgagcattctgattagaaacagatgtcatataagctcttacacataaatgagtgcactattagtttgatattttatcgagaaagaagcaacatgaagaaaaataggcatattttatagcaacttggtacttaatagagtttatgccaaaggaggtcagtgcaatgcattttcttttttagtttttgtttgcacattttttaaggcctggaaagtatgagggtatgagtaggatcccagctgtgccaattaatgacacatataaccatagatgctttatttggctagtctttaaaataaacaaaaaaattataggttgccagattttttgaggaagaaattttctttgatgactgagctaagggaccccaacacagtatattatcaagagtacatcatttttaaaacattttatattatcactataatttaggtaaaattatagtatattagcactagatgatgtattcttcatcaaaaatgaaaagtttccttttagtagccatagaaggaagagttcccaatttaaatctcacgaaatcttgctttcttaaatatgtaaaatataacacaagatttatggaaaaaggtagtcaagtctatttgatttttatggaggctagaacattccagattcaaatatcatgaataaactcataaacaagttactatatcttctgtaaaatggggataatttatgaggttacttttaagaataatatgtaatgtctgtaaagttgctgggaacagtttctggcacatatatatgatggctactattgtttttatagattacatagaatcacagatccttagaaataaaaacaacttgagctagaatctggtgtaattcccatccaatgcaggatgatttgataatcttgacaaattggtctcttgagctctatagaattagaacagagtctaaaagttaccatagcccaggaagagttgaagtacattatcttataaaactactcttgttcatgctatttcctttctaaagtaaatgtaaaaagtatggaaagagcatcatcacaaattgtgaatacaatggagcttctcattttggtttgttttggtttggctatacatgaaataccttaattccattcagtcattatgcttagtttatcaagttagtggccttctggcatattcaatacatacaacggtaaagttcacagtgtgaaacttaaatgacaatacaatgaaaacacaaacagatctaatcctagatttcctattgcaagggcaagaaattgagaacactgtagtcaggaaaatgtatatcaggaaaatgagatttacaaacaatttatatgtatagaaacaaaacaattaaaatctgaaacagactccaaaatgtaaaatatctgacctcacagaaggactttgaaccctattatacacctttcttcatccatgcaaattctatttattctattagtctactttgacgagtcactgaagaattgagaggcaggaaaatatatgatgaaagcaattttaaaaagataaacatcttggctgcacaccagatggattaaaataatggagactggggaggaatatttattgtttatagctgataacaggaaaagaggcccaattgtgtaaaaagccttagatcattaaaataatgtcagcccaagaataaatgcctcaacaggaataaactgaacaccttatcataatcactaacttagactgagtctagtttctccaggtaaaattcaggcagtagtctcagctctaccagtaggcactgcatattacaggaggtgacaaatgttccagattgcctcaaatatcttggtttgttcctattatataggagtaactatcaatagtgcttctttttttatcagaattgtgtctgtttgaatgataatttttatgatcttctaattatcgaatgccactgtggaaatttaaaaaagaaaactttcctggattgttatagcttaagcaaaaggcttgggcaatcccaacgtgcttggtgacaaaggaaaaaaaaaacagctctactttcaggaaatctggctatgtacatgcacatgacttggagacccaagcacagactgtatttcagcctcgactcatcccctccgctgggactctggggcagcacccgagctgtctaactctacacagtgccctgtccaccagctagcatggtttctctaatgttcatttaccaaatttcaaatgaattccttagcacccagcccacattttactcttctgtgatatcagccttgattactgaacaccattctgttttctaaaattgtacagaacatatattttgtgccactcatttgaactatgtctttcttagtaatgtcttcatagtgttttgcttggagtgggtttggggacagaagcggtactgcacttaatgtctgccagggtcaggaggaacaatcttaagtttttggaaaggtttgtctccatttatgtgaactgaagtctgacagccaagagaaaataaatttgttcccagaaagaaatacaaactaatacggggaggttagtgactattgcagttgcaggattgcaaaactaaactattttgactaataatatagtggaattaacttttactcagcacttactacttaccaggtttttaccaatttctaactgttttgaaattaataactcatttaaacatcaaacaaccttatgaggtaagtactgtcattgtccccactttttagattaggaaaatgagattaaagaacttggcaaaaaatttcacatctcatcaatgtttgaactaggatttgaacccatgcagtctggcttttgaatgttccctctgaaccttcatgctaacctgcacacttaacttgcattaagtttgtagcatatgtctggtttgatcatttgatgtgtggtatatattcctacagcaattttagtcattaagaggagtattcaagttagacttggcactcacttctccatctagacaaagaataaccagcagacaggaagaacactattatgagaatgcttctaatcacaaaggacccctaaacagcccttacagatctgaatagaagaagtaataaccagtggtatcacaaccttagcacaacaaaggtctgagcatcatctgacctggtgaggaccaacaataacattttatgaattattttttaggggaattaagaattatttattaggcagcattgcataatcctacaaagcactggagtaggctttagaacctatggtgttggcaagtaaatgaatctccctgtgtttgctcatttatcacaaggagatactgtaagctgtcttataaagattctgtgagtgttaatgcaataatgtttgtaaataaggtatgtaaaataattagcatattgccccatatagagtgcccactacagactgcatgtctaacttattgtttcggatactagctcttacaaataggcaggaatttcaaaaggttctatgaatgtttggaattttggatgagttctgttacctcttcaccccaatgctggcgcaacatgaatttcctttattgaatcaatttgacagatttaacattctatttgaactccatttccataaagcacaggcctcatctaattatccccaggtctgccttctactgtgattgtgctcattctgcctttctttttttactaaagcaaatcttttcatttaaaaaagcttccttttgcttgtttcgcctctaaccacaaaatgcactctcgtccaagtcctctgccaacctgagcaataaaaataataaatgagacaactgaagactctacttggacctttaaaatgctccagcgaaggtgaccctgaaaaattattatggcatgttatcaattaggtgacactatcaagaaaaatgaaaccaaaatattcctttattctgcctgattttatatctcataaatcctgctaaaatacttcattggaaatgcatatggtaatatctagacaggcttatgttagatatattctttttggattctcagtggacattttacatattagggccaccaatatagataatatgcccaagatgacaaattacttcaataatacttaacatgaggaaagtctgtctcaactttgcggggaggggtaaacacagctgctttttaacacagttaaattcataaagctaaaaacaaaacagactttaaaatgtttaaaagtctgtctttgagaaatattctacccatgaggctaaatttgacacaaaatattcatcatcataatttaaattttaatatatggcctatttaaaggcttcatacttcaaaaggtttttacatttattttgtcattctgtcttaattaagaaccaactccagtattagattaagttacacctttggattgttagaaaaattaggttgctattcttctggaataaatctacttttccaataaacacatgaacatgtcaaaattttttttaacaacaaatgcatttgacttacaattacacaaaggcattatgtttaattatttttttctgaaatgttatatagaattgagtaaaaggtatttttaggtggaaaccatttctaaactcttatttcaaaaaaaaaaatcttatagaatgagagttccaaatacctttcattcagctttcctcctgttaataattaaataaccattaggcagttatcaaaaccaagaaagtaacactgataataaactgttgactaaagtatacactttattttgttttaccagttttcaactaatgtcctttttctattgcaggatctaacccagctcccacattgcattaaactgccatgtttcctttgtcccttcagatgtgtctttttttgtaattcgtgtagttaacacttttgaagaatactggccattttgtaaaatgtccctcaattttggtttgtcgtagttagatggaacttatggatttttgttgagaatatgaataccaaagaagtgaagagcctttcttagcatgaaggttcatgaagtcaatattttttattactggtgacatttaacttgatcacttaaggtgatctgctgagtttttctgaagaaagttactacttttacttggaggaaatatttttagactacataaattactaatttctactgaaaactttttcgcacttattttggtatctattagggaatcccgacttcaacaatttttacattgggattctaacgatgaattcctatttccatcatccttctacattattaattgtaatttttctgtatgggtgagctgtctctgcttccctatttatctatctgtatatctttctttctatctgttcagttacttgtttatatctctatgggttcatagatgtttattttactcttttggttataatcaaatgacatatctattagttttgttgctcaatttgatctagttctggcccttggaagttttttcggattagctcttacgctcctttgtcatgcttctctctcaggggtcaataaagtatgccctacaggtaaaatgtgtccactactatctatctaatattgtaaataaagatttattggatcacagccacacccattcattttcctattagctattgttgcttttgagctataatggcagaattgagtaattgtgaccatgtggttctcaaagccaaagatatttaatatttggccttctatgatgaaaatttcttgatctttgctctaggcgaattttctttttttaaattatgaactttgaatagtgcccaaaatgtatttaattgttatatctgaggtactttagaattcagactcttgaatgtatatttttcctatattctcctaacttcattagttgtaataattttgatgctagacatttattattttgtttgaagaaaacaaaatggattatcagtattctattgagtttaaaatactaaatcatacagaataagaaaataatggtgagacaaagttgaaaaattatctagtaagaggagcgaaagagaaaaattgtcctcttgcatgatatgttttaaagtttcctaaatacatgcaaaggcctttattaacttcttcccataataatgaacggtaatatggtagtctcctcttattctacagtttcagttacccacagtcgaatgcagtctgaaaatattaaatggaaaattttagaaataagcaattcatgccatttcagtaaatggcatgcaatttaaataataaagttttaaattgcatgccattctgagtagcaagataaaatctctggccatcccactctgtccctcatgacacatgaatcatcccgttttctagtgtatccacgttatatagtcggttagtcacttataagtagccacctgggttatcaaatcaacagatcacaagaagaagggtgagtatagtacaataagaaattttgggacaaggagagagagaggaagaggccacattcgcagaacttttattatggcatattgttacgattgttctattttattactagttattgtcactaatctcttatcatgtctaatttatacattaaattttatcatagggatatatgtatagggaaacacatagtatatataggttttggtactatctgtgatttctggcatccaatgagagtcttggaatgtattcctcaatggatacagggggattattgtactttccagagatgttatattgatagcaatttttatctttatgatattggacacagttatttcaccatcccacttcacaatcatgagatgattcactgagagacctttccaaatgaaactctgaaaccatgcattttggttttaaggatattcattatgtaatgccccaatgttataattatatcaagcatagtatcagtgcttaaaataaatttattagaaggataatggcattcttatgatcctattttggagaacaattgttttaaactggaagtacaaaagttggtcctattctgtgaaaaaaaaattatctgagctagtaaaggctacacccagagggctatgtcagtggttagaaggttattagcaggttagtaaagggcagccacatttcattggaagcatgtttaattaggggaggaggaggtttctcctcatatgttcattacacagactttattttttcctctaatatctcaatatcctcaaagatcacctagagcagaggttctgaattctaggtaaatgggcctaaggatgcaacccttaaacataacatacataattttgtatacaaatgtagatagatgtgtatttttctaaagatagaatgttctactttattggattcctatggaggcagagattcaaaggaagttaagaaaaactgatctagattaatgtctaaaactaaatacagttacctaagctttatactctacataggaccttgacaccagtgtatgatattttatcctttttgatactctgcctcctcttgacggcactttcatttgtttattagaagttaagtgacattaaaaccaacttattcctggccaggcgcagtggctcatgcctgtaatcccagcactttggggggctgaggcgggtggatcacgaggtcaagagatcgcgaccatcctggtcaacgtggtgaaaccccatccctactaaaatacaaaaattagctgggcatggtgttgtgaggctgaggcatgagaattgtttgaacccaggaagtggaggttgcagtgagccaaattcgggccactgcactccagcccggtgatagagcaagactctgcctcaaaaaacaaaacaaaacaacttattcttgagcttacaagatacgaaaagtgggtagacagtggacaaatataaatagcatgaaaatcatgagacttgttcatagttgacattcaaataatgacattaaagctgagaaggaacaaatcacatagtacagttttaaaaattgttcatcatacaccaaaatactagctattatgtattatcattataaaaatatataaataaatatgtctgtgctatttaataaaagctcctgaagatataagaactcagagtgtttgagaaagtattacgagaaaggcttgtcattgagttgggaatgtgacttcttcttccattaaagtcagctatttataaactataaactatatgataaaacaaagatacttttaggtaatagtcaaattataaaagcgactgttataaaatataaatattaaaatcaaccaaatacttgtaaataccatctgaagtttcctaaaaacctaatactctttaatatgtcattttttccggccttcagtgcttagctattcctataacttgtttccacctcatttcctaaaagctagatttctgcattgtagtgacaattaattttttatatctgacatgattaattcattttttgtaaccagtagttagattcattaacctgattacccgtatctttggtgaaaagtccttcaagacaatctcagccaatatctttagccacacttatttaaaatcatgataatgctattctctgtttaacgtgactacttttcaggagtgagaccagtataacccttcattatgataagaacttaaattgctaaacaaattgtatgttggaaacaataatggcagacaagaagttaaagggggaaattttatgaaattttatgaagggctgctatttgtatattacaacataagatatacttggcaaaagttcttaaacacagtaatgattaataaacatttctcaatttgatttgatgggttggtttctaagtaatttgttttcagaatctgagaacttttaaaagtaaaaagttcattaaaaactcgcaaaacagaataaatttttattgattaaatgtttcaaaatatatttaactcatttttaaataagcttaagtttagcttcaaatacgtaggaaactcatgagttgctatcctactttattgagctcttgttttctgatagtgataataaaggcacctatcctccccacacagttgcaaaaaggattaacttaagtgagagacaaaaaagtactaggagaaatcgggaaagaagaggtttgacttacatgtctctatgtcattcccaatagtatccaaatagcagatacccaacacgtatctgaagaaattaatttctcagattatttcaattttgtcagcaataaacatttaataatgcatttgttttgggggcaaaaaatcagcatattctgaaagcagaaaaaaagggcctgtttgggtttcactgagctttcagaattgcctggacaattatcaaattggccctgtgatactctgtatgttagcttctactacaagagaactttatgaaagtcactgataggtctcattgacaagtttcctgggatggaacaaagaacatttccataactacatagcaataatggaacaaaaatggcaacttacagacaaactacaagatttcaatttaaggaatgaagcagttaagcctagttgatataatatcctttacttctgttttaccacaactcttagaaaacatctgcattatctgtttgccaacctgtgtagtttaaatgatgccaaaacccatcaaaccatcagagaatcttgctctctcttttaacagaaaataaaaaaatgctaacatggttgtgtgtccagaattggtgggttcttggtctcactgacttcaagaatgaagcctcggaccctagcgctgagtgttatagttcttaaaggcagtgtggacccaaagagtgagcagcagcaagatttattgcaaacagcaaaagaacaaggcttccacaacacgcaagaggaccccagcaggtggccagggctggctcgggcagcctgcttttattctcttatctggccccacccacatcctgctgatcggtccattttacagagagccgattggtctgtttttcagagagctgactggtccgttttgagagggtgctgattggtacgtttacaatccctgagctagacacaaacgttctccacctccccactagataagctagatacagagtgctgattggtgtatttacaaaccctgagctagatacagagtgctgattggtgtattcacaatcccttaggtagacataaaggttctccaagtccgcaccagatcagctagacacagagcgcagattggtgcatttacaaaccttgagctagatagagtgccgattggtgtattcacaatcccttagctagacataaagattctccaagtccccaccagattagttagatacagagtgcagattggtgcatccacaaaccctgagctagacacaaggtgctgattgctgtgtttacaatcccttggctagacataaaggttctccaagtccccaccaaactcaggagcccagctggcttcacccagcgtatcccacacggggcggcagatggagctgcctgccagtccggcgccatgcccttgcgcggtggatgagactgggtgccgcggagcagggggccgcacaggagcccgtggcggggggacactggggaggggaggctcaggcatggcggactgcaggttccgagccctgccccgcagggaggcagctaaagcccagtgagaaatcgagcgcagtgccggtgggccggcactgatgggggaccctgcgcactctctgcatctgctggccctggtgctaagcccatcactgccggggcccacagggccggccggccgctgcaagtgcagggcccaccaagcccacgctcaccaggaactctaggtggcctgcaagcgccgcacgcagccccggttcccgcccgtgcctctccctccacaccccccgcaggctgagggaaccggctctggccttggccatcccaggaaggggctcccacagtgcagtggcaggctgaagggctcctcaagcgtggctgaatgggcgccgaggccgaggaggcaccgagagcgagggagggctgctagcacgctgtcaccttttagttgccttacagtaactgtaaaaattctgatatttaaaaaatccaagtcattgataaagtaagaacaagtgagaagtctgataatatatcatttctttccatctccttggacacaatttctcagaagctaagcttagaattttaggaagacacattcaatatactacttaataaaaaagttcattatgtttcatcatttggaataacctcaaattcccagcaaaattgaacactgtgaaaaaagataattaaacaggaaaagtcagagttttagacacttgtttaatttactcagctactgtatttgtggcttcagatttctcagagtaagatttattacagaaagttagtattagtaaacatttaatgatttccaatggaaaccaaacatttatatattgaaataaatattcatctatgcatgtaagtatattttggctaaaaaccaccagaaaaaaaatgctttgacctagaagtttaaggagggatgttgatttattcaacaactatttattaagcaccttctgtgtgtcacaccctgattattacgtcttttgttagactctactcaaaattggttatttaaacaataattcagatattccatatggtttatcagtttccacaagacttatattttcactattttacttttagaggaaggaaaaaaattagtcaaacatttcccatatctatacatttaatgagaacatgggcaagtcttcttttaacaaactttttctcccaaatgattcttaagtattctaatgttctaatggtccataataatttacttaatttgctaataaagtttctctagtaaagttagaaaataattagtgcttactaacgagtattattgattcaaaactttagtgaaaacaaaatatggttattataagataaattataatttatcatataaattataaattctatggttattataagaaaattttttttatgtgttactatgtttaaatacccataagatagtcttgtgtgtatatgtgtttgtgtgggtcagcagaaatagcagactgtgacatcgactgatacagttaggatcaatcatgtaagtaataacatttagttatgaagaataggctatgctatgtttaaagatgcatctaatgatctttgtatattttactttatgtttcccagactttataaaggaaggtgcatagcttgtagacagcagtccccaagtgtagtttttactctgccactaacgagcattgtgatcttgagcaaaccagttggtctcttcaaggttccattttgttgtttgataaatgaaggacgtggaatagaagaacgttgaagttccttccctccttcaaatgtaatgatcatgtaaggtagattgctttaattacatgatactttgaaaaattaaattaaacaaatattaaaaaatcattaaattaaccaacacttcagtaccaaccctgcaatctctaaataatagagtgacttaaataaataataaattactgatgacttgaattaaaaataaactaatcttagattaagctacactaaaggtttggaatttagggtaataatatgacttcctgagccctgaaatattttaccagatttcatggatgaaaacagagttaaggtttagatctaatactcataagctcttccagacaaattgcatgatcacgagaaaagatttacaccatctctatggagtcttagagcatttctctctttctctcagatcctcttatccctaaaggatctctttatcttaccactccagaccaccattttctattttccttaaacttaacagtaatcaaactcggcattttgaaagttaatacattttatctgacatgttcaggttttctggatcctccttatctcccaatcagactaatctgttggcaaacatgaataataatgtctttgacttctttgttccttcctacaactggtttccatttcattggtacctaatgctgtctggtgacacacagcagcattagaacattgaataattgctggttaaaagagagagagggggagaggcagagaagaatgagagagagagagagagagagagagagagcgagccgaaaatgcgggcatgtctctccttctattaagttgttcattagcttttacagtgtattttgcattcatcttgtttattttctcacattctactttagtactttatcttttgatacctggattggttagtagtttcctaaatagtttgtctgtctctatcatttcctgctaatccttcctaaatgaatgcatgcttgaaaagacctaaatctaatttgctactgatttcacaatcttactgcaccactcacttcaaaatggtctcttcttccttggaacgagttttccttttatatcttattcagaaattagccaaatatgatatgataactctagcactttctcacattttatatttctaatcttgaacttttttttgcctatctctgtaaccagactgtaaatttagtatgttacttttatgtagtatatatcctttaaatatttgttgatttaatatgttaacttgagtataaaacgaacatttgaccttgtgtagagtgtaaaagaaatcttttgacacactgtgataggaaaacaaattcaaaagtttattatcaaagataactgtgatttatctgaagcaatctttagtcagggtaagcaagatgatgttaggctttgtgaattaatgttatgagaaagaaagtctatttttgtggagagagaaaattttcccgcataactgtaattagggacaaatcagagattaatgatgcattatattctagagctttaactgataagcaccaagaaatggctttctcaactttaaatggtttgtaaaatattatctctgtactttgctctctatatagaaaataatggatactaggtcttctattcagaaaattcaatatttattctaaaatgtaaactgttgagttacaggaagatttcatatactcaaaaagagcataaaatctacctctactaattagtttctctatgaaagccttccaggcaattacagagcagtaccattggtcaatgctttggttgcttttcattaaaggtatagtgttgctaccagatgaattgcttcatataaaagcacttaccacaaagacctataatggaggttaagtgctatactaattactaatttcaatccttattacctatattttgcagtacaggcactttaaaggaaccatatatagtctgctggttcccgcttctctgagtataagacttggtggtaaaagctctaatttagctgttcttctaataaaaataaccccaaaaattaataaaaagagccataccacaaactgacataaaatacatatactagactttgctactgaactcgtatttacaatcaccgtgtcacaaaaactttaatcaaggtgacacactcttcaaaatttgtattcagccattatggcaccgttgcagatgaagttccaagagaaaaaggtatttgaaattttcatggcttatttcctacctcagcatcacactgaaatgaacacagagcagatgattaataaaacatctgatgacaatggtgactcccctgagttctttatatattgatcattaactttttatatgtatatattgaaattcttcatatgtgctttattttcttgagggccgactctgtgttttaccttgcgtatatccttcagaataattgcaactttgcccactcttggtttatttatattttctaaaatacatcttggtaaaagggcatttaaaatctctgattaaatgttgaaagttgtatctgaaataactatatgtaaagatttgcttcttattacgatactgctcatttctatttttaaacatcttttacattgtgtttcttattctgaacaattatttaattggcaaataaggtactatatgtgttaaacaaatattaatctagaaaaatatgtacaaatatttttttcaaataattaataagtactgcctcaatctcagctaccagattcaaattggacattagtctgctacaagaacacaggaaccatatcttttttgaactatattcagtacatggcatctggtatgtgcacagtcaaataaaatatagtaaaattggggcatatagacatttttgaaaacataaaatatttactaaaatgcaatgatgtttggctaatatatcctatatttattttctatcatctatgcttgggtaaagcatcctgtatttctcttttacagatacattatgcatattaataaagtccaagtatagatattttaacttagcttaacccagaatttcccaaactaatgggactttccctttctcaccataagtagtaataagctctaggtaaagataccagtttggaaattgctgattaagtgttaaaagttactaaataaagacattttcaagaattaactatgaacacaaaaccatgcctcaagaggcaaatgccacactgcaatagtaacaggatttatcattttgcacgttcaggtccactgttcacagctgacaacatcccatgagcaaagcctagaccttaccctactatatattttcatggcatccagtgtgatgactttctctcagcaaataggcagtgattaatccatattttaggaaaattaccaatacacctttctgttattttattaaggttttagctattacttttaaaagcacattttttaggctgggcatggtggctcatgcctgtaatcccagcactttgggaggccgaggcaggaagatcacttaaggtcaggtgttcaagaccagcctgagcaacatagcgagacccccatctctacaaaaaaattttaaaaattagccaggcatggtggtgtgcacctgtagtcctagctactagagaggccaaggaaggaggatcctgtgagcccaggagtttgaggttacagtgagctatgactgccactacatccagtctgggcaaaagagtgagaccttgcttcaaaaaaaaaaaaaaagttaaattgataaagaataaaaattgaaattgcacatttatactaggatttcagataatgcaataatctgggattagcaggggctatgtaacattgcatgcatattaagttacttggctttcaaatcttccattacttcaccttattgtatatggttcacataattgtagtgtaaaattgtggtaattcccaagacatcgattcagcaaatatttactgaatgcctactatttgccagtattataacaggcactggacatattaatttccttgcttcctaactttgtcatagagcagtttttttattacatttaattcagcaaatattggcagagtactaggcttgtggaataggtttgaactagggcttgaagatttagaattctataaaccagaaaaggtccagaagggtattatagacatttcattccacaattgtgagtcagtacttgggatatttgatatcaattgaatacattggttatgtcattaaattacttctttcaagaaccaaataagtgtgatagaagaatttaaatataaattttgattattatttttattgggtaaaatagaaatgtatttttatactttttctttatactgtgttataaattgtgtgctttgcaaaaaacatagttatatctaaaaggggaagagagaaatgagactgatgcttttagtaatagagacgataatgattgcagtaaaatatctttatacttttaatttatatattacttaaaaagcatatttgttttaaaattgaggatatatacaaccacaagtaacattgtttaaaatttctaatctaccacctttgtttcaataacataatattgataaaactcattcacaataaacaagataatttttattttatcaataacggcttgacatttattttatagacttaaaatgagtagtgctagtgtcaaagaatcctcatgaaactctatggttatatgaaagtgaaaacaaacttcttttatgtacatgttcttataactgctgatttatgctactattgttttctcactagttctctacttatctcacgggatccctacactttaatgtgtttcagctgtgcactaccatctgaggaagcgttaggtcttattttctctcagaaaaaaaaagtgttataatattctttcccttagttttaaattttaacttttttacttttgacaaagcctttcctttgtttaaatgcaaggatccagtaaaaagagctttgatatgttgtgctttttatgtgtgcatttttctgatttcattgatgtcctgaattttgaaaacgataatgtacaccttcacgttctcctataaaatggcatttgtacactgtagcaagaacagtttaggacagcattacattcacatgactctaaagtccaataaatagttgatggtttctcagaaaaccacaatttggtgaaacggatgcaaaacagtgctttttcttccagtttgtttttcataaaatcttcccccgatacatattcacttgcttacctgcagggtagcgctcgatcactggccagctgtccacctgcaacgtggcattgccaccactcctcgtgaaacgaactacatggtatttcccatcattaatgattgcattggattcttcaatggcgatgtcatctgtcccaacattaaacttaactccaatttttccctggtgctgtaagagaggaggggaaaaaagagttgaattaagttgactagtcaccatttaataaagattacatacaaggtattgttttaaaatgtgctttggacaacagctgctttcctccaattttacttctgaaaaactacatgtagtagaagcaagattcttgacatctgggtaaatttaagacatctctttcatggataattgatattccaaaaggcacactttcaagggaattgagccgccttcttcccagaggttgtcacagagaaggcgcacagctgcctgcacaaaggacatccttttgtgtactttaacacaacccctttaatccactctccccatttcacaagaaaaacggggctccaaattcttacttttaataactggtgaaatcagagcaatgatgtctgtttagagcccattgacaaatactcacaataggggaaatcattctaaagggtatggggcatttaatgagtgcagtcccttagtcagtattcacaaaaccatcaaatactaacagcttgaaagttattcaatgtttttattttattgatgatgaaacatcaacattttattgatgataacacaggaaggtacaagacttgttcaaggacacataatagagacgtacgaaaactaaaattcatttcccttattcttagattatatctaagctaagttgaagcaaagataccgttatccaaaatgaacgccctcttcacttcttcatatgcaaagcctcattatgaatcattctaactataaagttgttgctgttaactttagaatttcataatataaggtggcaaagagaaacatgtgctatgtcctctgcctctgagaagcattctttaacaggactgtcaactctaccatgaaatcagttgatttctaaagcatgtggatttgtccttaatcagttgcacagaatacctgtgctgtaggcccttgtcagaacacataacctcaaactgtctgtggttcacccttcttcaaacctcagttgagagaaatcacacggaggaagaagggtttaaagtacacacagtccatcctttcctgtagaagttttaaatcagaatgttagaaacctgaagatttgggccacattctcttgactctttgtggggttctcatcattatttgaactaggcagcaggagtatggaatcagcttacactaagaatccttacggaaaatctttttcaaaattgtattaatcaaaggaaaatatttgaggatgttattttgcagtattgctcattatctccttcatgtagagatcctaaaggtttctgttggttttcttccccctgggttcttattgtacataaagatctctttcttataagttagcatgcttacaattttttttggtttgattagctttaggcttgacggatggtttaacttttttaaaaaatcacattttaacactatatacatgtttgttaaataaagataacttattatgtctcttaaatgagattctttaaaatttttctgtagagttatatcacatgtgttaaaaatgtatgtactaaattaattactgaaaatgagcaaaaagtaattctgttaaaataagaaaataatgcatgcttacaaaaaggtctgagctaaaaaaaaatctttaaaaaaatctccataagtctttgaataacgtttgaattttcattggacttttgctgtttgtttattagctgagtcagtctacacaatactaaaatgccttacaatgacatgtatttaaaagtaagggtcatgagaaatatggtggaaaataataagtccaggggaaaatatatactaaagtctctgcagctattaaaattacccagccagaagtgatggcacacatgtataatcccagcagtttgggaggccaaggtgaagaggattgttcaagcccaggagttggagaccagcctgggaaacatagcaagatctcgtctttactattaaaaaaaaagaaaaagaaaaaaaaaagaaaatctgggcatggtggcacacacctgtattcccaactactcaggaggctgaggtgggaagatcacttgagccccggaggctgaggctgcagtgagccatgactgtgcactgaactcctgcctggttgacagcgtaagaccctgtctcaaaataaataaatattttaaaaattaccctatctacatggaccctgagtttcctaacaaccaaacacatacgtagggctctatacattttataaatactaactctggtattcttcataacagttccatgagggagatgctattttatcttcattttacagatgagaaaattaaggcacagggtgattaagcaatttggctaaggtcgcacagctggaaagagaaaagctatggttcagatccacacagttaggctccagagtctggtccttaatcattacaccaggctgagtttaggactgttgtgccatcctatagctgtagctagcagatttggtaaatctagctgtttttactacctgttttatctctcctgctagaatagcatcactaaggggccttgtattgttctttgaagttagtagacatgtatcaatcaatgtatgtttaaaataattttggaataaattgtaagcaactgatatgtggatataatagaatattaaaatgattctttttgtttcagtttcagctgagatgttaacatgataacataataagtcaaaaacacattactgtttccatcttacaaaatgaagcataaagttacttaagccagtcttgcaaaggagaacactgagaactgcttttagggtcctgaattaattacctacttctagtccatcaaaatgcagaaaaaggcaagaggagactgacaattagaagaggatttttggagacagttgagatgtgatgtgatttccacatactgcagggtggaagtctgcttttccctatctcaagtgcaggagaaagggacattagtggaacatctaagaaaatttgatatgtgtcttctgggacttggtgggtggcagcggtcaaggtagtgagcaaactagtatttgactataactgagaaatcttcaagggaagagactgtggcttgctgatgcccagtggccaagcaaagagatattgatgtaccaggagccacttgtgcattagggtttgttaggacaaaggacacttgtggaccctaggttagagtctgtgtagaattgtattgtatcctgtttagcagggttactaaagggattgggctgagtggtgaagaaaactgagaaaagaaaagaaaaaaaaaaaaagaacttggaattgcagtgatagatgaccagatggtgaggtgggaatcctaaatgaccatctgaaggaagtgcatttactacctcaatggaattgcaggtaaattctaataatggggttaaggtctgtaaagaaccaaatgcttccgaaaagtgcctccttaagaactttaagtataggctaagctcaactagatggctacaataatactagccaagtaaggtcatttctgccctttatgtcttctttcttctgcttcatccctggaggaataagagagggagaggaatagtgaaagccatggaaacaatcgtgctcctcccagtgcaagtgggggctccactgtggctgaagcagggataatgaagaggctttaactgacttctgctattacagaggagtaagctgattttactttttatgtctaaaagtgaacggatgacctttttactatccaagagggagcaaagcactgttgagactccctgtggacttccctggtggttagaaagaaatatttttacagaacaagtttaattcctgttacaccttgggaagtactttcaacacaacaagtacaggaagatatctgttactctagggttgcccattgttttagggtctcgtctattatagacctggttcttatccaggatacactggaaaaaattcttgcagtttcctacttattatgaaacttattatggaagtaggccataagagcctattttcatcagagtattaattattaagaaggtctagattcagtgaatagaagcattgcaatgttaaaggtgaaaaatgcactaaactctgaaataagtccctttaacttaaccttaaaactttctgcaatatgaaatgcaaaatgctcattttctaggtgcagaaatctccagatttcataggatttggtttttttgcaacacaataaaataaacaatttagaaacaatgagcatccgtgatgcttggagaacatccgactttttttttttttaattttatatatatatttttttattatactttaatttctagggtacatgtgcacaacgtgcaggtttgttacatatgtatacatgtgccatgttggtgtgctgcacccattaactcgtcattgacattaggtgtatctcctaacgctatccctcccccctccccccaccccacaacaggccccggtgtgtgatgttccccttcctgtgtccaagtgttctcatatcatttgacttttaaatgacgcccatctcttcttggagatgttcagttgttgcctcaacttcaaatgtctttgacatctcatggatttaaactctagagttagctagaatggaactgaaggctatcaaaataagggttcaaacaacaggcccgaccctaattcagacattatctacttcaccccaagttgcatcaggctttgaaaaacagtttaattataaatgatcgccaaagagttttccctgaaaacaataaatttaaaatacacataaagcacaaaatactaataacaagcatatttataagaccggtatttactatttaattcagaaactatagatattcttacaacacaaccatctcatgtttataggatagcaagtcatttaaattatataagcaataaaacgtgctaaactttcttgccaatgcgtaattacaatttaaaagaattcatttcaaactcttattctctgggattaaatatgattgtcttggcaaattctcatgaatattgcattagcaaaaccagaagtcatttcactggacatgtctttatctccctgtacatgtcttgatctccctgtactgtatattccttgaaatagataactggctcaaatcataatttcaaaaatctcttataagaatatcagtaacgaggcatttataatttaatgaagactttccatggattcattaaataaacagtgacaatggtaattattgatttttttacaaaagctcatttctgaataaagattatattattaaaccaagttaaagggaaacatcatgaaatatgacactgggaaggtccctgaaatttctagcaagtggcaccatagtttaatgcactgtctaattccatatgaaataacatatgcacttgtaagttttatgttttaactaagattaagatttaatggtgtaatcaatatcttgggtatacttcaagcaagatgtctgcatgttacagatgcatatataatatgtgcctatgaaatggataaagcagaatacacgtaagtaaagatttcggtctacatgtggcatacagacatgttacataagattttagtgcactgtttcccctcaccccattcttggattgttatatagaaatgtttggctcaactatgctcaggaacagagaccagtaacaaataaaaatgtctctctctgtgtctgtttactatactcctagagagaaggaccaaacattgtgagcaagtgtgcaactcaggagggcatgtagattagcagggagccctgtttacgttctgtaaacttctgtcatgcaccatagtacagtccagtactccagggccccactttggacagaactcaacaatgtctttaaatgctctctctatgcttgtactcatttcagaatacagaaagactcccatagtccaaatctacattgttgattgaaaccagagttgggtgaatggaatgttttgcttctccagagactaatcctcaccagggagcaaaggttttaaggcatgaaggggagtctggagcctatagtcacagttgttggactatgcaacactgcagacagtatcagagagccatctgttatctcacctaaaaacaaacacactcagataattgctaatttagcccaaacacttttttttttttttgagatggagtttcactcttattgcccaggctggagtgcaatggcacgatctcagctctctgcaacctttgcttcctttgttcaagtgattctcctgcctcagcctccgaagtagctgggattacaggtgcatgccaccacgcccagctaataatgtatttttggtagaggcagggtttttccatgttggtcaggctggtctcgaaatcctgacctcaggtgatctgcccaccttggcctctcagactgctgggattacacgtgtgagccactgcccccagccacccaaatacatttctaagtgaattacttagaggccctcttggctggtagagactctgtttaccaatttagatggcctataatggtaagaagtggttttaatctagttgttttaacctggcactgagatatacatgccatcctctaacccccaaaaagcaacaccaccacatcaaaaacaagaagttcctgctgccctgtctcctattttctccattaaatagcgtctgtttaaaattcattcaggtaactaataaaaagtatgtaatatgcacccagcattttcctactactgggaggagaataaaaacaggtaaagtctgttttctgctcctgggaaaactttcaatcaaattgggaaggtaaatcgtgcatgcaaatactcatacccacaaaagagttgagggagtggtggggaaaagcacaggtgcattgggggaagcatctgaaggatctctggaagcctcaaactgccatgggagcaaaccagcatttggacagctctaacactaccagcaggttctaatgcaactcccagggacatagaagttatgttctgtctaccttctatctctcctttcaggccccacataccagactactcactatgtgccaggtattgagctctatacaatgtatctcatctaaaactcccagcagacctgaaaggtaagtgccattgtctctatctccttggaaactttaatcttgctgaaatcacacagccaataattatgggtactgaaatatgaccaatttggtggggcattctaaaactgaataatgtcagttgtgtcagtgttccaggaaaatgtcttgaaactaaggcacccttagaggatgagtcaagaggagggttactacagggtgcatggttttgtttttggttttagttttttttttttttttttttttttttttttttttttttttttttttttttttggctagttacattttgtagcactacacaataaggaatcagaagtgggcaagatatgtgggcaataccacctcagaaacatctcatttaggagtaatacatttttaaaaaacagccttttcatttccccatcaaatcttcattaaggatagtgtatcttttctaatatgtctccatcctacaggatgctgtagctccttcaatgagactatattctggcagcgatattaacttcctggaggcttaaattcatctcttggtcctaagaatgtctaataaaattttctaagcctgtgccagtcctcctccacacactgccttaggtgttagtttttatatgcccatttcaacccctcaaacctattaaaaacaactttagggtaggaaaaaagcctggtgtattcctcattgtatccttcaccacacttcccagaatacctttctttacttttgcaaatttccaatattctttcacatcaattttcttttttttaattgagatataattcacatatcataacatttgcccttttaaagtatatggttcagtggttttagtatattcacaaggttgtgcaaccatcaccattatttaatttcagaacatttgcatcatgctccaattttcttttgatgagataatgcatacaaaattcttagcacatttaatggctacatagttcctgttagctattagcattattattattattgctacaattattgttgttattcatcactttgaaaaacaatgtttagcttcaccgtagtttgatggaagttaattaaaatattgcttcaattatatagacatttcggttttgctagaggatacatttttaatgattacaacttgtgaagcagggtatctattttgtaaatgggaaagctaaagctcagaaaggctgagacttggccaaagtcagagcatctatctatgacttggatcaagagaggatattctaaaatctacctgtgctcaactgtaagataagtggttctcccgttgattatgctgaggcagagcatgcttgattagacaacatccatgtcccctcccatctcaatattatggttctagggaaatcctaaatgtaaggcaaagcagttctcacggaaaaaatttagatattactagttgagttttttgaaacacattgaaggtgcctaagtttgaatttgagtctctcttagatttccttcaaaatttaaaaaaatagaaaaactctaagattttattgtgtttttaaatcagagattctccaatttaggaggagaaagaggactttgcattaggttgaagtatcagtaatctgtgaagccttttgtgaaccatgtatgtttcttcccaagaaagtataatctctgatggaagcgcttgccattattgggaagagcccctgccttgtcaggtatgtaggatttagtggtcgtaaagtgagaaaaaggatggacagatcttgagctccagtgataacatcaaaacacttcagtgcttctatttcctcattgtctctccttagatgaaattaaataaaaaatcaaaacaatgtcaagatgaatttagtccactaagtgactggctgctggatctttgaatggggtaataatcttgatatcggtattttaagatattctcaattttgtttcactaataaagccaatactggattattctttacacagtatttgagaagacattctcaaaccattatgaagttctccagtgtggccatgggtacagacatatcatcaagccttttcgtgatacttcccccttccaaatagcatacgtttgcagatatcacgatagctgtagaataaaataaagctaccttagcctcttgtgaatcagagtcatctcattgagataattaattctgtatctccatccactgagacaacaactactatgaagttgaaatagttgcctttaaatgtgtccttatgtgtaaagaatgtcttttattatttttctccctgaataatcaatgagcagaaatcaaatagaacaagaaagaggcattgacttggtggcctatggaaccttcttaatttttcacaggtaatactttccatttggatagttagcctagtggtctggcatcataacaaatactttaggttgctgtatgaaaatctcagcgtcacactgaattaagttaagccttttccaaagtgtaatgagctgatcagatgtgtattacttgtttttgttcatttttttatatttaaaaattattgttgctttaaagacccttgttggaatgttaaattactttttcttgtacagtcacattgtacagtaattcaggaaactatgggcaatacattgtgtttcaggtgctgattaaaaccacaatctttgtttattctgcatctgcctgaatccttgtctttggaccattgcactctttgatattacctccaccaggaactgaacaggaaaggggcattctatcaattctgctaattgttgacattttttatgtaaaaaggttttcctataaaagagctttgggattatttgtggatttcatttacttgttatatcccaggatcatcattttccaggagacctgactatataattacaatctaactctaatgttccaaatttccatagcacaaagcccaacatttttcagacaaatagacagaacatccttggattgtaattttagtcctctgcatggcaaatgtaaccttagtaactcggttataggtaaaacaaaatgaaccttcgtattttagaaaatccttaaaagacgtgaaaacatatcaagagattaatgtaattattttcagtgcttccattgatataagccataagctacatacagtaaactgggaatggaaagatcagtttggaaggagcactatttttttaaattctatttgtgaatcatgacttgcaacctaaaaacaagagtgaggaaatgttttcaagtgtgtttgatggactgacttcctaatgatgctatgttagttttcacaagcctcaagaagagccctaccttgaaatgcatcccaagagaaaagctgacagtgctaacttttttcttttcgttttctctttcttattgacttctagtccaggactagctgtccgacatccttaggaaaaaaatgtgtgtatatgggcatagaaatgcatttaccaatgaatattttctaaagaatcagcaaaactctgttatccctgaagtggtaagtaataattcctacagccatcaaaaataaatctatgttcatgtgtgtgattgtggcacaacagaggagaatatggaatctctaaggcagaaattcctaatgattataacttttttcatcttcacaaaacagtaatacctccacaaaaatgaagtaatgcagaaaaatatttatcaagtgccttttagctgcagtgaattttgtaaaacaccataccactcatcccatgactcaaaactgataaaatgtgtgttgctggttatatttatatacatttattttcctcaattgcatggttttctggcataaatgacactaaaattttggaactaccataacacatgaagttcagtattcaccaatatttatgtacttattcaaaaaccacagactttttactatactcctggcactctgttaagttctggataaatatggttaacaaaccagatggtgctgctgtcattatgaagcttaagtctcacattattcgttacacattaaaacttactgtagcatatacagcatgctaagtttcaagaaggcaaagagtaaggatagcatgagaggaactgaataatttaagcaaagtctccttgagaagctgaagatgagaagaaatcaataatgaacatttagcattttccaggcagagaaaacagcatgtgcacatagcccagggagggattgtacaaagacagatccttttatgaacaaatgcagacacagatataaatatgtggactctttatagctattaagatgtgcaaattatatgtgaacatgtacaggtattcaaaatatttgtataagatataaaactaggttatggaataatgcgtaacaaaagtaaaatatattatttgcacaaatagagcaattgaaaaatagatggtgaagcacatttaaaaaattttccaatcagagaacagaaaattgttgaatatatgtagaacctaacagtatgcaacctgacattcatctaattgtttattcctaagtgtcattcatcaatgtgcattatgaaatgcaatttataaaagacttcctgaatcaacagggactcacatctttttcaaaagtcacttacttctacaatgtcaaaaaagattcatcattctacgctcatatttctaaactaatgtaacatgtttagtttctttgtgtggtggaatgtcttgttaacttatttatccagagagcccttttatctcaagatgtagtaaagagttatccataaaatttctgccttaagatttatgtctgaaatcacttgactggtttttcaagtaccctccttaaattggtagaagaatgcaaagttttcacccttgaccctttcaccttcctgttcactcagaagagcagatgaacagggtttaatgcctgtgtcccaaaatgcagtcttccaggcagtcaaccaatcacttcaaatgagacgaaggattctctatccaattctacttccagaaaaattttaaataaatgaagttaaatgagcatttgccctgaaatttggccaggaatcgtgaagccaaaaacacgcgaagtgctcaaattcaagtaactcatggacgttttgaacttgagataaaagttcacttgtaacttctccagagcagtaaccactggaggctctttgaggtcatcccttcccattgtttgcctggaaaagcaagagaatattttgaagacagttgtggacgtttagctcagtaaagacagccgaaggaataaatacctggagcaatgtcaacttagcagccattgaccaaacaaacaaacaaacaaacacactttctctcttactgctccatcacactagcttttcatttccataaatgtctcatgttctgacccatctcaggcccattgctcttccttctgcctggttagctgtttccttgccttccccatcccaaaataattgataccctatattgtttggagataattttgagaacttaaggatagatttgggcattgaatctgctgaataagggatagtgtttgtgaaatatcatttcgtgaagcaaaaactcattagtggtcatctactggagtacaaaagacatctacttaaaagtctgggctgacaatagttgaaaagcaagagacatactgggaggccatttctcttctgattagcagaattatttggtggactctgactatttctgataaatctttaagtactaaatatcatagcaagaaatatactgttgtgatcttgcattccatttatacacttcccctgccaaacatgtccactgttttaaaataaacatgaacaaaacctaatagagaaggtaaaaatgcactgagagattaatcagaaacatcattctaaggccaagtggaaaccatatgtaacttattcagtgtttggtaataccagtgtcagagctctgaaatgagtgtggatattccagaagggcaggatttggcagcagatgcgtgatgatgataatgatgatgatagccatccttcttgccatgtgtcagacactccttctaagcactttacaggcaataatacgtatgaatatatatgattattttcatttaaatgatgaggaagctgagcctcaaaagcttgtcctaaatcacatggctaataagtatcagagctgtgatttttcaagcagtccaattccagattttgtgtgctaaactataccattgctcctctgaggaagtccaacatgcttacaagaggttgcagcttgtttagctgtggtattaataaggctctttgaaaaagagagacactaacatcctcattattgtatatatcaagtaaaacatcaagtacttttcagacctccactcctttaattctcacaataactcattttgccagcctaccaatctccatgttgaggatgtttaaaactcaaagcaaggaggtacttttctgaagtcacgcagctaaaacatcaatctagttacattcaatccaggtctatctggttccaaactaagagctttcaaccacatcatgctactccttctgcagagtcttcatgatcccctagaagtagtaggggccagatgagagtatcctagagctctagacgcttaccattttaggaggtttgtatactgataagttttccaagatgggggtggacagacgcagcaattcctctttcatgagcattaaattagtccagttgtttagaactgctagtaagtgaaatattaatctccattagggccagagcagactttgtcatacttcaagagccagaaatggaagtactatcttttaggtttaattgagattctggagtgtcagcctattttcagagtctgtaagagaggaacactcagagaaatagccagtgtctttcctctacccaaccccttcccacctagtttacatccagtttttctctagtatgttttttgtttatagccaacagatttatttaaatcatatttatcattgcttgctattttgaaagatgtgcctcaagcttccaatcaaatccaaaagaatacataatcatcaaaacaaggttagtcatggagttttctactaaataacatttgtgactgaaataggcaaggaaatgagagatttagttgtagtttcccaaaggtaataaacctaatatttaaaaagaaatagtaataacttaccagcagctcaggtgttccatgtgtcatgatcaataaccaagtaaatatagatctgaattttgtagccactttggttgtatcaaaaaagccactgcatggtactattacatacatagtttatatggtttagaagaaccatataaaccaccattaactattccttttatcataataataaaaataataggtggagttgctgatatataaaatatgaattgatccattagaagtaattttctattataatttttcaactttcttagtcaatttcagattatgattagaaatgttaatgttaatcttgtttctctaccatttaacccctctcttaaaaacataatgaccacttcttagacccttttctactctccttccatgtatatttcaagttttctacttataatttgtaattatttaaattgttttatttttatcttagttgtttgaaatcaacctctacattattaccatcttttctttctccccaagcttataagcattggtctagcatttaatgataacttttaatttgggatgattatatccaagatgctgccccagaatgagagttttatgaatgcttaatgcaaggaatcataaagcttataccagtgctgccctgaaaaattaaccaaagaaaaccccaaaactctttctccttaatcaaagaatatgctttgatgtgaacaaaagagagaagaatatttaatatcagctttggttgcactgcaattagcaattaacaagtaataacctatgattagttcacaaactccaacaaatacacttaatgacaggtgactaagagatgtgggaaacatttaagttagggccaagatgaacaaatgtgaacctagcacaatttggtttggtaacattaagcttttgataaactttcctagtcaaaattaaattattccatattactttgaagtaattataatacaattttctactttaatcagctgtctcaaactttgtgatcacaagttattttatgcaaaaaaaaccctaaaagaaattatgaaagatttttcaagaaagatttataaacttaatctttcaaagtatctcataaatgtaaatgcatgcttagcatttttaatggattatttactcatcatttagcttaaacatcataatgtttccaatctatgttacaagagctaagccatttcaatgctttttgaacaagttactctgttgacattggcacagaccaccaaaatgcactgattatggaagatatacggttaatgcatacagtatctgagcattgatagagcatcaaggcaaaagcaggcaatacttaagttctccaaataaatacacaaaaaagagagcttgatgaccacctaaaataacttttcaacatggaaaggtgagccttgcggcattccacatacagattagctgagcctttcaaaggtattgttgaatttatctatttctgagcatatcttacttttaacccaacttaattctttggaaggacatgcattacttctgatacattaaaaaaaaaaaaaaaaagacccttttcatgctcttgcttgctaaaactctactagaactttcaatgacaccatattgcctctcagactattcaactggaaattgtatcaggtaaactctcattcattattgcactacccatcttttaaatttttaaagagattattaggggctgtttaaaattattactattcttccacttcttactttttttaggtttactctcccatcacaattattgtcacatgctacattccagactacatatatatatatatatatattttttttttttacccaagtactacaatagaaatgtgatacatcaatggattgtaagaaaaaaaaactacccagctatgtacctggttatattcacacattgttacagagctgaaacggattaattaggcagttaataaaactattacaacaataattgcagaaattactaacgtaaaagtatcttggcctagatagtttatgtctcagttaataataatgttgatagtaatactaataagttctaattatcaatgaccatttgctatgttcccaatttagtcttttaaatatacctctgaacagtatttggctcataatggtcacaaaacaagtgtttgctaaatattgactaaattcttatattaactctgtgtgagacagatgccattattaccttcacttaataggtaaggaaactgagtcataaaaatgtcacttgctcacagtcactccactaacatttgaaggatcaggatttgaatccagatctgtctatctccaaagtaggtgttcttaaccactactgttttatgttgcctttggaaaaatatccaagaactagataattaccagtgatgaaatctgtttcagaatatagaaaagtataactcccctctaactccataaaattaaaacaaaattacaatccctcctaaatgtataaaattagaacttccttatacaaaagccaattaaatgtagcacacacacacaaatccattgaccaatgtatattttaatcataactcactataataaagatggctgctgcatatattgccatttaccatgagtcagtccttttgtggtgcttatataataaccgattttagctttacaactctgaggtaaccattattaagatcattttacagagaaaaagaagtggcacaaatttgcacagtcactgtgttaacctaaggactcaaacttggtccttttttacttcaaatgctacataaagccagataaagtgtatgtcaaaaactctgagatatttcaaaattgagaaatctattaacatgcatcattaggacaaatgagaaaaaagcaaaatactaagataaattctataaaggtatttgttaagttcactatgcatttttgagatatttttaaaaatcacttggtaaactagaacaatccgttgcatgataaaactatttctacctcaaaccaactgccaacatcatgcttaacactaaaagcgttcccaatgaagtaaaacagttttacattgtcaccaataggtcttagcgttggtttaaacatgtcaatcaatgcaatatgacaggaaataaaaataacagtttaaattattgatagagaagaaaacaaaaacacactacttgctgtaaaccgaaaccacactgttggatgcaaatatagccatttaaaataaaatgagagagctagccttcagaaaaccattctaaaaataagataaacataaatgcatacattctcataaggagtggcaaagatattgagcaaaatgttttggaataaagaattaaaatgtgagtttaatgaaactatataattttttggcaagtgtttctaaatatagactctgtgtgatggatacattaaaaattattatgttattttctttgtgttagaaaatgtccataatggaaagaatgaacaatggcagtctgcgaaacaagagtactgcaatttttgtctctaactatatttgtaatcttgaacaaattacataactcctctctcttgctttactttcctcatttagttcatctttttctagatcatcctttctggttctgtaattctattttattttcagttgccttctcaattttctatattgcaatatattttaattcataatggttcaatttgtgataatcactgctcagccacaaattgaaaatttagccaaaaaaaccccacagaaatggcattgctttgactttaaaatagcatactcttcctgtcttttttgagatctaaaattgtttatcagtttgcggggttctcttgggtttattgtactattagacactgacacgttttaaaggatccttaaaaaaaaaaagaaacaaatgaaaagaaaaagaaaacaaccaaatctggcttgttctgggatgctgagatgtcttgacagcaattactgcagtagagactggtgaataccctattttcacagctgatgttttccttcaaaattgcagctaccttcactttggttgaggccagggtactatatttagatagtataaatgtatccagagagcaatctttcacgtttatttgtagagtgggtttatttttatttattgatgtcacacaaaatgatgtttcctcggtttctgctgtatataacataccaaaaaataaagacggtctagaacacaaagtaagaatatattctgtgtgattatattgacaatggtttcgatttttatgcaattatactcccataatgttgaaattgttaacacaagtctatgtttactatgtaagaggaaactttattatgcataatgaagatggcatgggaataagggagtctcttatccttcctgtcaacctaaggccaatgtgtaatgcaagaaacaagtaggacacagggaaaagcaatagccataaccaagagaacatcagctatccctccctcctcacttagaaataaagaatgttggccgggcgcggtggctcaggcctgtaatcccagcactttgggaggctgaggtgggcagatcacgaggtcaggaaatcgagaccatcctgtctaacacggtgaaaccgcgtctctactaaaaatacaaaaaaaaatagccgggtgtcgtggcaggtgcctgtagtcccagctgctcgggaggctgaggcaagagaatggcgtgaagccgggaggcggagcttgcagtgagctgagatcgcgccaccgcactccagcctgggcgacagagtgagactctgtctcaaaaaaaaaaaaaaaaaaaaagaaagaaagaatgttgagaaagcaaagcattagtttatacaaccttcaaaataaaaaataatttcaagtcaaattctttttccaactttatatgtggggtgtgtgtgcgtatgtgcgtgcaaattaataagtcctagacaataaaaaattgatagcacataaatggaggggccaattctagcacttctttttgtcttttttctccattattggataatagtggttaccaaatagaattcaacaacagaactgattaaatattttccccctaggttttaatttagactacacaacatgtatttcagtacttcacattattagttataaaatttttctattgttcccctattgaaagtttaagagaatgcccataaactgagtttccttttagaaaaaaatcaaataatgtcaacatcctttgcatctcatttcttctctttcagacttatgacttaatcctcattagttataatactttattttcatcttttttatttgattatttaaaactttaaggtgcaaatgggttcattttggagacgataaacaggaaattttaagatttctcttggcccgttattttagattgtcccgtgatacactgggggcaactagcgaaagaaatgataatttgccaatgactcttaaaatactgaatagtaaaataacaaaattcttagaattgggaagtgatcttaggcccaaactctcatgtgataacagaagcccttctaaaaatatctctgacaaagggtcacttaagttcaacttgaaacatgccagtgatgttattagttctcaaagcagcctattcattattaaaatccttttgaattgaaagttactctcatgcggcatggtggtcactcccgtaatcccagcacttttggaggttgaggcgggcagatcacttgaggtcaggagtgagaccgcctggccaacacggtgaaaccccttctctactaaaaatacaaaaattagcagggcctggtggtatgcacctgtaattccagctactctggggactgaagcaggagaatagctatagcctgtgaggcagaggttgcagtgagccaagatcgccccactgaattccagcctgggtgacagagtgacactctgtctcaaaaaaaagaaaaaaaaaagttactctcatgggtctgcactatggatcattttagtgtaatctgcaccctcttgccaaatcacagccctttgaatatttaaaaacagttattaggccacattttccccacagtcagcccaggttttctgctggaaaaatcaccttccattctttaactatcaatccttaaagtttttataaccattcacctttcagctatctagtttgttaataagcttagatgctaatggaccttagcacaatacactaacttcaatgcaacgtgtaagatgggtaccaaaccgtaagatataaaatgggtactcaacagtgtaatatgtttcttaattagggcaccacttttccatcaaaattgtctgagtttttttttttcctttaatagctgcactcactagttgatgatctcagcttttagcaaactaaaattctcagacctttgcacattatgtattagctagatatctccctgtacttattcttgtggatttgaaaatgcaattataggactttaaccaccccctccagatctcccatctgtgttgcctttgcttaaacctttttcttcatccaaaatactcctacctctgctgtgcaaaacactttatcttgggcttaaactcccttgggtccttattacccctgctactgtatcactatgcttaatggagaagatgaaatttacataggaggcaaacaatccaggtttctctcttcatctgtcattacaccatcttactgaagctggtcccttcgttgttcagccttctccggtagacagagacaaatccgtgttacacaagtctgcttattccgactttagtcttgatgagtccacatttactggctcagtgcattctcgctctctctcactcaaattatttttggttttgcaggcatcctttgaaatacacttttaaaatattttgagttgtgaacttttagatggagataggattccatgagggtgcaagggctgtttcatggctttggtatgcagtgtaagactcagagtcaaatgtgtctgggggtgtgtcccaggcccatgtggggcaagccactgtttcctttactaaaatgcagcataaaattcatacctgcctcagaggtcaaggaagaattacataagattaaaaaaataaaatgtttaaaataatatctttatcaaattaagtactcaataaatataatctattaatatattaattatactattctagatataaaatgatcatcaaaagaaatcagaaaatgacaaactctttgctttttggaacacaagacatctggtgcctatgccatttctgttgccaacatttggaatgtgcctcccctctcattgctcattatctccaaatatccaaaccctaccttccctttgatgccaagtcaaaatgtgacctcttcttctgaagccctcattacccctagatttgattcctgctcagtgacgatcttgaaggtatggcatttttgcaacacatccttcaatccctatcatctggcataaacctggatcacagtaggtacttaataaatgtctgttatatgaatcaatgactacctttcccgcagccatcattaatttcttcctctcctgattttgtatatccttattgcacataaatatttaccatgcatcataattatttgtgcatgtgtctcttctgccttgcaggactataaagctttttgagcactccatgtcaaattgacctctggctaccttgcaattccttaatacatactagacactgaaaaatacttttgaatgaattaatatctgcttttctctattgctacagtattttttgtccatggaagttctgtaatctgtaccaggaaaataattaaccataactcacctttgtaggaaaaggattaaccataaactgcctttttctgagacatctgttccataatctaatgaccaacgctatttatacagttgatctatctacaaccccttcaactgtaaaaagcatatggaaaatgtatgttcaattctagaggaggaatattttggctatccttttgtgactccctttatctttgatgctcacgtataatccaccttaaaaggctgtgagtgaggcagaaggaggatcacatcacttagatgagatcttgcctgacaccactagatttgggccttcctatgaaactcccaagtttcagttattattatatcgaaatgacttctattgaacactaatcattcaatggtcagttaatttttattgagtatctctatgtacacaggagactatgtgggatgctatagaagatacaaaacaaactaagggtctgttccctgtttggaaggtaagatctatatatacaagtatatacacaccagtgaaaagtaatatacaaactgaaccctaaaattacagatgtaaaaaaatatataccacagactgggagaaactatttgcaaaagatatatctgataaagggctgtgatccagaatagttgtgagatccacacaaagaactcttgaaactcaacaaaaagaaaacaagatagatttaaaaatgggcaaaatatctgaaattaccaaaatgagatatacaaatggcaaatacatacatgaaagatacatagcatcatatatcattaaggaattgcaagttaaaactacagtgatacaccactataaacctagtagaatggccaaaacctgggacactgacaacaccaaaggctggtgagaatgtagagcaacaggaactcattcattgtcagtggaaatgcaaagcaatacagttactttggaagacattgtagtagtttcttactaaatcaaacatactcttactacatgattcagcaactgaactccttggtatttaaccagaagagctgagaatttatgtccacacaataatctgtacatggatgtttatagcagctttattcaaaattgccaaaacttataggcaaccaagatgtccttcagtaggtgaatgaataaataaactgtggtacatccaagcaatggaatatcattcagtgctaaaagaaatgggctatcaagccatgaaaaaacatggggaagtcttaaatgcatattattatactaagctaaagaaactaatctgagaagcctacacactgtatgatttcaactgtgtgacattctggaaaaggataaactatagagacataaaagaacacattggttgccaggatctagtggggagagagggatgaataggtagagtacagaggatttttagggcaatgaatgtactccgtgtgatattataatggttagtactagtcattatacatttgccaaaacccacagaatgaacaccaggagtaaaccctaacgtaaactatggactttgtgtgataatgatgcaccaatgtaggttcatcgattataacaaattaccactctagtgagggatgttgatggtggggagactgtgcatgtgtaggagcagagagtatttggaaaatctttgtaatttcgctcaattttttttttttgtgaacctaaaactactctaaagaataaaacttacaaaaaaacatatatatgttatgtgtatatatatatatatatatatatacacacacacacatatatataataatacatattttatataccaaagaaagctgattaaaactttgtttagaagtacagtaggaccacagaagaaacaaatttctgggggtactcaggagtttacccgagattacgtaataccaacaggaatcaatgtttcttcagcacaaactgattttggaatgatcgaaacaatgtatatgtactttctcatttaatatccacaacaaactaataaaggaaatactattattatctctattttgtaaatggcttgaaacttattatggtgaataacttcctcaaggtcacagaaccagtgaggggtataagtgagatacgaacccagtcctgtccaactgcacagctgaggttcaccaatatcctatacttccagtcttgggaaaagaaaaaaaataaaaattcagttggacaaaagcaacagaaagagaagtccaggtgggagaagtctgattaacttctggaaactttgcaatctatgacagttttatgattcacttatttttatttaatatttcttcaacactactagtctatctccaatgtgaacagaggcaacagtctttctgttacataagaatcatgtacatatgtatgtttatattcaatttataagcagtctgtctttttaagaagacttattaaggagaagtaatttttcataggatcagtcttggggctaagcaattatatttgctatctttttaatactagtagtcatatttcttccctaattgattattgaacctttctaaatatgtctgaagacatagattgaaattatcctaaggctcgacctctttttttaattgtgactaacaaattttaatacaaggcaaacagcaaaacatggcaggctgaaggagtaatttcttgcacctatagccggagtttttttaaagagctacgcaatttttgttgatcttccactggcttatctacagcaattgaagtttatcagaaagatttatgacatggtattgcaggccctaataaatgactttgggaagctgggaaaactcactaaagttaaagttattatctgaacctcatagggctaattagagatacaacctgaagtgttgagtcagcagtaagaaacacaacacgttatcaattaaagcctccatctaggcttggagaagaggtggggaaaagaaaagatttgcaatgaaaatgaatcatatgtttaaacaccagagccaaaaattagtcctcaaaagcatttcctgaactctctggaaatgtcgatggggtcagctctctgcttaaaaagggacccttccaaggcattctcaaagtaagttaccaaagttgctttgcatatgtataacaggaagatctgaacatatacagatgtgggggttccagaaagcaagaaaaaactctacctcttccccacatctcttcttctgaggaataggcaaaatcttccttccccaacacagctctgtgacactgtcaatttaaaacattttcatgcaaatcaagttaacatttaaaaaacaaacaaacaaaacttgcactatgaatgacgtaaccccttctcaaatactggactttaactactgccattgaaaacagggtggtttttcttaagcatttctgacttgatgctgctgttttcctgagatgcgaccaactaaaaatgacttaaaaatccctgcaccttcctggtattaatggaaagaggtagtggggtgttacagggagctaacttttttcatggttttcttaactgagttacaaaaataacagaaaattgcctctgtgcacatgtgtttaatgtgtctatgcatgaaaagccttggggataaagggagaagtagatattttcagaatgtttgattatgattgtttgtatcagaatctgtttagacaagaaaatcagaactgaaagtagacatatgttaaaacattttcagcccatatccttctgctttcatgttgaaaattgagggccataaaataataaacatgtattagatttattgagttcctttaagtcggcaagatccccagagtgttgtgcaaaataacagcaacttttgaattacaaaattattacatgttcccatgaagattatttaacccagagatgaataaggagaatgggtaataaagagacctgagagggattttccacacccttctcctcaatccataatttaaatacagtcataaactgtgagtaagcaatataagcatttgtgtgcagcatatatttgagcctgaaaggtagaaggcagtgtttaaaaatatgtttttaataaagcctataatacagaatagacaaacaccaaggtaaagatggattagaagaacaagtattaaatgaatacaccttctagcaaaaatcatttcttgttatgtgcctcaaaaaagaacaatcttctttagatagtattttaagcaactgactagtgtgtatgtctttacacagccatagaagagtttcaatgagtacttctcaccgattcagtgagccaaatcataaagcctcaggctgtcagaaaaaaaaaaaaacaaccaactgtaaattttgacaagaatgtgacaaaaatatataagatagattcactagcatttctagagtgaaaaattactagaattggcccacggcctctattgctgaaaaatttaatgtaattactttttttatgatattgtctagactctccagcattggcagaatttttgttctatgtctatgctggaaataaattaaataaagacctaggttttcttccttctattgtaagaactatgtcctcttcaagatgaatgtgattatggtttagcaaatgaatgtgaaggtaaaggtgtttaggagaaaatacaaaagtaagatcttaacgttgtacttaacagaatgtgtccgttagtaagaatactaaaaagcaggattgtaaggaagaaattctccaatgtaaaacagcttgcatgtcttctgggaatcttgtaaaaatatagaatctgattcagtagatctggagtgggcctaagagtctgcattcctcacaagctcccaggtgatgctgatgccgccagtctgcaggttaacaccttaagtagcaaggttataatgtatggggaagattcgtggatagggtcagtcttttaaaaatctttaaataatttgaatgtaaattatatgaaatttctctgtctcctggtttcataagtgttttcttttttttttctttagacaaaattggaatagcagtttgactatgacattctaattggtgtgtgtttcagctagaggaagattataacaaaagagtatttctccaaaataaagttttcctttattttgcttttgtaagtagctcaacaaaaaagagagtgtggctctgtgtttgattttacttcctttaaattcaaaagcaggcactaaaaatacctttgaaaactatagtaatgaactactgtggtactaggctcaagaaatctggggcgttcctatggacttagtggcaattgaagcagtcagattttcagatttagctgccatcagctgtggattggacagtgacatagtctaggacagatgtcaattttagccttcttctaacataagtctggaatacattttaattcaccagcaggaaggattttgttgcatgtaagttagagtttaaagccaggtttatttttgtttgggaaaaattctgtgcatctcaaaaggcacaatacctgtgtgttaacctgtctttttttttttttcggttggtattacagaattgctgataaagctttacatttacattggccagtagactagaacagattcctcacgtctctgtaagagctttgtgctgctcacttgatccaagttaaaatctctccacatcttaagttgaaaattaacatacgggaatttaatcctgacatagccactgcatcaacttttgtctagtttacgctttgccagaatgtcttaccattatgtgtctttatcttttggaaggctaggtatattgaaaatcttttaaaaataattttaagaaaagaatgtaaacaatagaaatttattcactttcttatgggacacatttcctgccaaatgctccccacaaagtaaacaccttagggtcttttttatttggaaaatgtaaggagatacgtaagtgtggatatagattcttctaaaatgtcctaaaagaaataaaattgcaagttttcctttgtctttcatcagagctttctttgtcatgtctaaagccccgcggcagggattagggagatgcaaaaccttactgtaaacagggaagggttgaaagaaaaggttcattaaaaaagaaaaaaaaaaaaactatcatttgaatgtaatatgtgaaaaatgtttcttccaggttgagtgaaaaatatactaaaaaagtgtaatcctagcttaagagattttgttttaaaatcctaattctgctaacaaggcaaaaggaacttaagatacggatgtatataaagcctcccggttcacccatcagtctttgaaactgccacacctaaactatctgttttagtgccattctcctatatttactccagtcatttttatatttcagttttgctcttaattttttttcccaacagtattcaagaagaaggataccaaaaaaagcattcccataagtattgtaaaaagtctctctcatgggtttgtttttagaaaaatgttaagccatgtttttggttcagtggaagaaggagcctgtgatagttttaacacgtgtacccaattagttgttctggacttcagcaaatgttctgcttggagcagctgttaacagattcttgctctattgttaatcaaaaagccaataataaaaaggcaaattaaaaggcaatttaatattatacttgtaattattcactttgtttctcatataagtgcaatctcatttcaatgcaatgctttcaaagaaaacatatataaggtagaggaaaatatcaatataaaattaaaattttaaaaaatggtactatatacacctttataaaatatgactagggaactccaaaaaaatgttcaaggactaagttccaaatacatacgtatgcacacacaccaacatgcacacatgcacacacacataaatgaatgcatatattctcaggcaaaaagtagaccttaggcccagaaacaagatatttgcaaagtattgatcagaatactatttatagtttatttttagggataaacacattaatgtaacttcatcttcaaaactttttaaaaataattacttttcaaaataggcaatgtgctatgcaatggagacgcatctatctacaacaggaaatgaaagtacaaacatccattcccacagtcttagattgttgtttaaatatagatatatatttcattaaagtataaaaattaagtcattgacctttactgatttgataatagtacttagtctctatttattaaatattgtcatctttctggaatttactataatacataccggttaagttattaaaatttaatcttttcacatattattaaacaaaacctctcacttattctgtccttactgtggcaacaactgatgccacaaaagttatatttccactaaagcattttaagggaattttgagtaagttacttactgatcatttgatgagatctgttgactaaatgtggctttaattgctgatacttgaacttagagtgcgatactaacaggatttattattcactaagcacttacaatatgccagacaatgttttaagcactttagttatctcgtctgtttttttgtttattttttgagaccgactcctactctgtcactgaggctggagtgcagtggcacgatgtcagctgactgcaacctctgcctccgggttcaagcgattctcctgcctcagcctcccaagtagctgggattagaggtgtgccaccaaacctagctaattttttgtatttttagtggagaccgggtttcgccatgttggccaggctggtctcgaactcctgaccttaagatccgcctgcctcagcctcccaaagtgctgggattataggcatgagccactgcccactgcgcccagccttatttcacctcatttaatccttacaattactttaaaaagtaggtagaataataaactccattttacatatgatgaaactaaggcacaaagaacaatgatcacacagctagtcagtggtagaactctgtaatctgtgggttccacatctgccagaggatgtatgtaagtgatgtgcaaacactactccattttatataagggacttaaatatcaacactatggattttgttgtgtgtctgtgtgcaggggaatgtttctggaaccaatccttggaggaacaactgtaccttatacactacattgaaggctcacaataaaagtctttcaaccaggagaacatagagtaagatacaaaactgtgggatatagactatgactcttttgattagtatggaagaaaacatcctagtattttgttattggaagaaaacatcctagtactttgttattaaggattagcgagattgaatcattgatgtacttacagcaaatctaaagtaaaccatacaaaatagaactttcctcaagatgactagaggtcaataaagctatgggttatttacagtgtaatatgaaacagcatacaaccgcaagggagaaggacatactaaataaacaaaacctgcaaaggcaattttcttcagagaatctcctcatgtacaaaaatatatttcaagagaaagtagtatagttactgcgttttcataaaaagtctgtttggtgataacatatgctgaatacaactaaaggcagttcttcaagtctaggcagacaagctgcagtacagcagatacacttgctgtttaaatatcccttcaaaaaaaaaattccatttgtttaccaaaatctattcacacttgttgaaaagcatctttcttcacttatctgaatgtgacaatgaatcaaaagtaccttctcttctgttaccagaggtgataagggagaaactgagatcctcaccagaggctgaaagatgtcttttcagtgctcttgaaagcaaaggctaatttttccaaacaaaaatttctccctaaggagctgtattaatgaggtccaaagtaatgcttaacccttgactactctaattaactcaagctgactggccagaagccctctttcctgtggcctatatgggagagatcacaaaagtgcatggtaaccctatccccacttgctgttttcacaaaacatggggctttgttctttgtttggcggttgtgaagacatttcagtctcatctgacatcacctcctcacatggaagaagtgtgcatagaaacacctagcagcaggctgcttgtctcagtgtgttccataacccttgctagcacaaagactcatttccagctcccagaggtagcatccattaacacatgttccttgagaaatctgacttttcttttcaaaaatgggaacgagtgtattcttgctatacttttttccaaatgctccaaatacacaataaattatcaagtaatcaggcctagttatgcgattcccagctttcaatacaggtatattagaggaattcatttattcactcatttgtctagcacatctattgaaaaccttctacatggtagatacaaggctaatttggtttcattgaatctttcctaagcaattaagcccagaaaaatttgtcttctctctgtttgctagagcgatagatactaaagtatctataatactcaatttattagtagtaaatttaaaatgtaattacatttatttcaacttacatttaccaatgagtacctttgatatgccaggcacttttctaaatgccagggatacagtagtgaaacaaacagacaaaaacctctgccctcctgtagctttaattctacaatggaggaacagaaaataacttcaataagtgaatgaaatatataatgtgagagagaggtaaaagaagtgagcaggtggcactgaaagagtggacagagaaagcctcactagaaaggtgaacttgtaaagatgaaaggaggtaacgaaccatgttaatgtctgggaaaaaagcattcagggcaaggaaagactacatagaaaggcttggaggtgaaagcaaacatggtatttggttggagcaaatgggtcatgtggttggaggaaagtaaataagggttaaagtgtgtgaggggtgcagtcaatggtaaacttttggattttactctggggaagataggtactcattagaaggttttgaacagataattgacacagtctgatttagggttttaaaaagctcattctcagagtctttgggaataggttgaaaagcatctaaaacacaagttcagagaacaattagcagactattgaaatactatgaagtgattaaactttattgaattttaattataatcaagcacattatggtagaggcaatgagatttactgatagattggatgtgagatgcaggatgaaggaactgcaccttgaactcaagatgatttcaaggtttttggaaaaggcaacaggcagtatgaattgctatcccttcagatggatattgtggaaggagtaaattttgaaaggaatatcagattaattgttgacaaccaaaatttgtataaaatcaggtaataaaaaggggatgtgagtttagaatataaaagtaaaatgtggacgtatcacatacagatggtattaaaagccgtgagagagaatgggatatccaggggagtggctataaatagaaaaaggaagaggcccagacctgagctctcagggtattgaggaagaaccagagaaggagaccaaggagaaagaacaggaaaaacagaagaaaacccaggaaagtgtatagctctagaagtcaagtgaacaagtgttttgctgaggagggaatgatcaacgatataaaatgctgcttgtagtccatgaatatgaagactgagaattgacattgatggttactgttcaccttaataagaatattgaatacattatttacctaattaaattctagactcctggtagtcaggacttgtcttaagcagggaattgagactgagtcaaatttgaaagttattttatacttaagttgtctagaactctgaacatcatttttcatatcacatacgatatttcattatagattctagtgacttctcaagaaagcctactttttcccattgttaatacgtagaaccagaccaaaataatagaaccataaaatgttaaagtatccagtttggtgattattacaaatgcatacagttgtattcaccatagcagcaacatataaaatatttccatcacccccaaaacttccattgtgccctgctgtgctcagttcccttcctccaccccaacccctgacaatcattcatcagacttacctccctgcaattttgacttttctagaatgccttagaagtaaaatcatttaagaatttaacttttacactattatttaaaaataatttcatcagtaaatatataccaaccataacttaaatgtttaaaatatatcttttcttctcactaccacatctttagtcttaaaatggtcctcagagatcccagttcctcctgctgtgaccttagcttctagaagttctttagcccctttgagtttataaatacattgatttataattcatcatacatttattaataattatttcaaggaatagtcagaactcatttgcatatatatacaaacatagatatgtatgtaagtaatatgtatacaaacatatacatgtacgtacatgagtaacaacagaaaatgagttctgactactccttgaaatagtaaattattaatttattgttttggaactgtctctaatcctttatattctgaacactgagcacaataacagtaactgtaatggtcctataatcaattattgatatgtagaaaatgttgcagctacattacctatgaaatcacaatgttacttctcagtagtcctaaatttcagaagtagcatttgaatgtaaaaattggcacatttgaatacaatctatataatctttgtcgttgttgctgttgttgttgttttaattcagtctcttagtaacacagaaatgtatttccagagttttccctcttatgtgcctttaagcatataagattacacatctggctttgtaccaaaaacagggcccaacaggatatgaaatcctggggataacagcaacctagctatttctttttcaagaatttttttcaaactgagccagaaactgaaaagacagatgaaaatggcacaacccggtgacaagagagcaaagataaatcacgtttccttccataaaaacattaagatcttggctttaatattaatatttttggttacagttaagctttaaagttaatgaaattctcatttgtatgctgatcttgggacatgaataccaagttgtagatgggatagagattagcaataaagaaaattaaggaaaagaaaatgaaaaattcccatagagtttaacatgcatacacatatgcccacactcatatgtgggtaatatgagagaacctgcatattttttggaggttgcctttttgcaggagttgaaactattcatcattttgctgcactttcctgtggtataacctaactaagatttttgagcaaaagatagtttttgtttttggaaaattatgagtaacttatacgtgacctgtttactccattaggaaatatgctgttttattcaatggatcataggaacagaacgaagcagaacaatagcaggaaagaaaaaattacagtcttagaaataaaaacgtatttcatccattttggcaccaggactgaattaaaatgctgccactaggcaggattttaaacatacacccttttcggcatacaattttaatacagaaattgagatattaggcatgcagcgcatattagaacattgctctttctgctgcaggtgtgtttgactgaccctgaataaatgtcaagaaaaacacctttcctatcttttttttctggctataattcaccttctcttaatatttaactattgctccatcattataacaggcactctgtttaagtcgtgggtacaggtaaaattcagcagataaaaaataatcatattggaacatactaaatgtaatggagatttttggttgagaaaaataattggtactgctaatataactgatatagtcatcatatttcctatggatttacaaaaaaaaatttaaaaaagcaagtaagatataatagaagcaaaaataggaggtgaataattttctgtctttggaatcagtgtactttattattacacattcattctaagcctacgtcagaaaatacttgaagcaaataaatagagaacagttttcttttcttttttcgtcccttttcttcaagagaacatctcattaacattaacagaaactgtgcccagaaaaagccattaacattaatggaaactatgcatagaaaaacccctagattagtttttggtcttttaaggagcttatgcattgctgcctgtcccaaaaagacaggatgggaagatagtaatcacatttttgccccatctttttaaattatatatttcattaaattatatttaataaatcctgagttggaaacagcacaaggaaactcaagctgcaataatatttactctcccaataaacctggagctttcacaaaccatgtgtcttactgagagtcactgaacaagttatacgaccatgattctcatgaacatcctctttgtgcttgcaattaggctgcctgccaggagttgaaatgattagcagtaaatataaatttaatagctttgctttgcagttccccagtcactcttggtgcctccattcactagggagataatgtgaatcagaccctatcaactaaacatacgacaatagttgaatctgaattaaatatgagggaatcttaaaagggcaaggtaaaataaaaagaaaaattaaaatatgttctctatttaatagccactttacatttacaccaaaacactgcgctattttttataaatatcagccaaactcaaagtattagtacataaatcatatataatctaaaatttttaaaaacctgataaaaagaatgcttgaaaaagtataggttttcttttttttgtcacttgaaatagaattgtgaaaaatatttacatttcaaatatcattttgcttagctgttagagttccttagagttcggttttctgaaatttaccaatactttctcatcctctttcacatcatcatcagggctccacaggaaactgtcaataggtatcaatttaatgtgccttctttactaggtgccttactatatgtcttatcacttatctctcaatttaggagacacaaaactagaagacagcaatgaccaggaagtcttgtggctatgctgtagaatgatgatgacgtatataaaatatggaaagtctttatgctttgcttttgttctcatcagaaatagtccctaagtcttaaattgtgataaaatactccttcacattttctttcaggtacaataaaggtcagataaataagaagcaaaagaaaaagagtcagggaagagaagaacagttttcggcttagcctgatggcaaagggcttttaaacactcctcaaggaacattaagcaaaaatgagcctactgaaaacaactttccttgattttactccccagttactttcgttcttctctataacttcccttatcctttcatcatagatgtcttccttcatcactattcaatatttaaaacagctgaaagattggttactgggtaagaaaaaaagatacgatagctaccaggttgagcagagatatctttgagctctaccatgatagctgagatgtttgtcctgctcagcactgcctggcacatggtaggagctataggtgaaaagatatctctgagaagatatgagtttgttggtactagggcaaagcatggaggaaaaaagaaaaaagagatagagaaagaccatgagtcataatgacatctttcgtcccttcgaaccaacttttcttgagtccatagtattatatgctccgatgctttagccaattaagttaaatccatccttatgcattttaaagtattcgaactaaaataatatcatcaggaaacatgtgagtaaaagaagggccacctcattaccttttggcaataaaaggcagagtttaaattataaatatttacagaaatatatacaccaatggatttccaagaaaatgtgaatgatatgccacttaggaaaataaaacgatctcccagtataaaattaatctcactggaattgctgaatacacatctgatgctcaaaaagaatactccaagaaaatataaattgtttaaatataagtcttaataagcaggatgttaaaaactaaataaagtgacaggggatgcggtggctcaagcctgcaattccagctctttgggggagctgaggggggtggatcgcctgagatcaggagtttgagaccagcctggccaacatggcgaaaccacatctctattaaaactacaaaaattaaccgggcatggtggcgggcgcctgtaatcccagctactcagagggccaaggcaggagaatcacttgaacctgggaggtgcaggttgcagtgagccgagatcacaccactgcactccatcatgagcgacaagagtgagactccatctcaataaataaataaataaataaataaataaataaataaagttatgatgaataacaaatcaaacggaagcaaactgatcctcaaggtggtaaaactcaagaaaaaccctatgattttgctgatctcttagctgatgccacagaaagccaaacacaaacaaacaagagaaattatcctatctgaatacatcagttttatgatatttatgtaactactaaagcatttttttttaagtataactgatgcaaaactggaggaacgcaaagtcagctttctttgatcaaagctcctataacttctgattaaaataataattggatatagttcggactactccacatacattctttcactgaaattggacataatttagtgaagcaagatgctgagaagtctactgccttggcagatttccactgaaatatgtttaaaagcatagtttttctccacatggaaaataaattgtagaaaattaaatgtgagtttatataggattactttttttaataaaataattatcagatatccaaaaagggaagagaattagcaagttaaagaaattttattttgcttgaacaacaactaagtttcataaaccatgctccatgtgtcctaatataaaaacaaaactattaattttaatgtacagggctatgaaatggaatttggaaattatgttgctagaccaatttggttcctttaaaaaaggcaatctttatagatgcccagcaaaaagaaaggagggcctatttagagccatgttagaatcatgtactgtccaggtattaagaaagccactttggccactccaaaaaacaacaataaaattatttactttaaggcaaggcagaaagtctccacattaaatttttgaatttttacttgaattgactccaaaacaaatcaaactgaattacagttgaaagttaagtgaagctaaatataatttatattttctatatcctattccaaaacaaatattttctatgtaatactccaaactataaacgccagacactatgatcagcacatgttatctcattttttcttccataactaatatataagcaggttattattcccgttttacagataagaaaacctagagactgtaattaagttttcaaaggcctctcacagttttgtcgcttctttccactgatgtcctccctagtcttgttctgatgtgtgcaggagtaaagatttctatttttccatctggaggaatttcttagtggcacactccctttaatctgtgtagagagctcaaaatttccctcaattctcttgatccactccaaaataaggatgttctgaagatggtcacagacaaacaagcagggggcagcttttggtagaaggagcaataatgtccttcttaggcatcctcttctcagaaggaatcaacatgtagcccataaaaaacagaacccccatctccatggctgcttcccagagctcagagaaccaatccacctcctcaagtacaagagcagcaaaagaattggggttaaaatcttaactagaaattaaggaggtatcttctacttaagcagatttcaaaccgtgctccaaggaatgctgttacataatatattctatattctgcctctattggaaagaaaaacatgcaaacaaacaaacaacatcccaagtatccaaaaccaaaacaaagtactctgcatgtgagcaagtttggaaactctagattaaataaagttcagcttttatactgttttcattattaaccatttatatgttaatcagcattatgacctccgaaaaggctttaagttcatttatcatctgctgaagtagttcggaaatcctgcttcatatatcctccaggtgaagacttgaaaagagcagctgcagcccaaggcatttggttgaggattcagggacttggaaggccaattcttttccggatgtaacgactaataatatttaatatacaattttgaccaaaaatatttttgcatgaacatggcctaatgtattttacttaagtatatctttattggtaccatattaagaaaagcttattccttcttgaaaccatgtttaggcatcagttgagcacctctgaaactcattttaattttgcaggactctcagattattaggaagcaaatattcaatggggtcaacttagacaagatttccaaaaatgtgttcctcagcttgggttgaaagctgtaaacatgttcattattaatcttcaagagaataatatttatgcggcccttttccacttaattaatcattaacacctttgtcccagagcatcttaaaaggctagtgtttcaaggactatccatctgtttgaataccattgataaaaccttactgtttaagtttattcaattatcatgaataatgaattagagttttctttggtcagtttatctcttcaagatatcactaagctcagtcttgtaaaccctaacaaggtccagttttgaactagttacaatttaggaggtttaactgtcattaagatgcgaatgactcttccagaggacatggaccttgtcttgtacatctctgtgatctccaaagagctgtgcacagaattgacactaagttcaataaatgtttcttcaatatacgaagaaatgctctgttgccacttaaagtgcagagcagttttcatcttcaaagcactttattcacattaattcagctatttacattttgctgatgggtaaacggctggagaggctaaatgggctgttttaaaggctagagagagaaaatcctgcctgtcaggaataaaaatttgcaattactgattaccagtcatatgtccctggacttttgtaggaaaaaaacagagggacaaacaaaggccacctaggtagtggttatcctactgtcaggacaagtcaatagcaggtaaagaaacaagtacactagacggtccaacagctctattgaacaagtatgggggaaaaaaagttatttttgttgtggttttcagtgagtgtgtgcgtgtgtatgtgtgtgtgagcagtgttgatacacactgtgatgcagaattacctttttccatttgcaattctaaaacaacttccaggtgccatgtgctgtttacaaaggaattgaaatacatttgacctcaagcgtattttgctctggcaaagtgtgctaattgtatagatctaaaggcagcagcaacatcatcatttcaaaatagacattaagacaattaaaaaccccatgtaactctactgcaaagtaaagttctcatggagactgtgaggtgtgtacagatatgctgtgtcatacgtttctttatgcgatagtttatgtcccaaaactctttttttttttttttttaagatggagtcttgctctgtcgcccaggctggagtgcagtggcacaatcttggctcactgcaacctccgcctcctgtgttcacgccattctcctgcctcagccttccgagtatctgggactacaagggcccgccaccacacctggctaattttttatatttttagtagagacagggtttcatcgtgttagccaggatggtcttgatctcttgactttgtgatcttcccgcctcggcctcccaaagcgctgagattacaggcatgagccaccgcgaccggcccagctcttatctttttaaaatgacttttttgatgtgaattgggggaggacagagacaagacttcttggccatgtattgcttcagttctcagttgtgtttctctctattccttggaaaccttgactttcttccagtagcttcctggaaggaaaatttgaggaaacgtctaatgtacatagatactgtgtgtatagagaatagtccagttaggaaagtactctatgtaagttctgaaagtctggatttagggtcttttttttttttttttaccttgccatctacttctttccaccctgctaaaatcttagtaattaagtcataagagacatcttccttttatacccaaaaaaacacttgatgagatagaaaggagctgcgtaacattatacttcgtttgggtgtatcttaggaagagatcctgttcccttaggaagtgcaagggaggtggtgaggacataggcaatcaggaccaaaagtgtaggtgctattctaaaagcagtaatttagtagtcaggtgtcagatgaagacagcaaaaaatgcagttttgagtaactggagatggcaaatccccatgtagctggcttaggcttgaactggcaggtacctgacattcaatgcttgaagatgtagggaaagtggctgaggcagagtgctgggtaagggcaggactgagttggttggaaatgggcgtaagtacagcctccagtgtggaggttgctgacaactcagcaatctggtttcagaggaggtctgaagaaaacttaatgcaagatagtttgttagatcagaacaaccactgaaaattctccagaggaaataattgtgcttataacataggtggagtagatatgccacacccatttgacacccaaatcttcatcagcttggatagtaccagacagactcttctttaggtccacagggatttttttaatttctgacaatttctagattctaatccaaggtgacaactcaagaaaaaaattagtaaactagttgtgttctggaaaagaaaaataaattaaagccacagacaagggagaagaaaaacttctatgcttggccaggtaaaggcaagctttctctaggaagtacttatagtcacataaatactcaagaaatcatagacttctggagcaagaagggtcttggttatcatctggactaacagttgctattaacagattaaaaaactaaagccatgaggaattattttatgaaatcatacatctaactgacaaaatgaagactaggatacatttatttgcttgtgtctaatactcctcttcaatttggaaacctccagtgaagcagaacacctaataaaagttaattaggaacaggtactgctgagaccttctctaaaccccaggagcagatgcatctctttcactcgcctggttacctgaatgtaactaaacatgccatctgattgaacaaacaaacctattcttgtatttcctgggaagatgagcccctggatatgaaaatctcacacttttaaggcaaaggacttcaaagtagtccaagggtaagtcaatcagtaaaggaatataactatagacatgcactgtgtgatctggtgttaatctagaactatgacattttttgaaaagcaacaaaaagggtgttgaggtatagctgccaaaaccaattaaaagtaaccagaaaaaaaaaaaaaaaaaaagagaacactaagcaaacaggttttccctcaccatatttctaacagaaatgcatggccatcattaaggatattctgcagaacctattcaagaaagactgcacgtggtggataaccaaataaaatttccttgtacagtcaatgtcttggcatgcaatgggtcccgaggcataaatgcaaaccattaacaaagctttattaagaaagccttcaccatgctttgggaagatgtttgatacaattcaggttaagtgctgatcaataacctggaaatcaaaagaaccgatcacagaagcaaaaaaagcagatttaggcagattcccagccccatcccaaatgtgagatactgacaccaagcataagaaatcatcgctttttctctcccctccttcccccatcacacataccaatgccttttcctcttaagtcccctagctgcaaatatttcttagtgaagtctattttaccccttttacactcacaaactgagtcgcaggttgtacattttgtgataccatcattgatgaaattgatgaaagcctctaatggcattagaaaatcctgaaatagcacggctgatatatacctggcaggtaattgcttaaaactccagcagagatggatgtctaatctattcttaaaaatatgagcagacagatagcagttcacccctccactgcctctttcttgttctcccccaacaattctgctagttcatttgagtgtttcagacaagaaagcaagaatattatgcaccagaatataatgtggcctttcttgcacagcttctctttgcaatcccaaagctgccatttgcagcttcaagcaacagaaaagcatgcttactgttacttaagattaaattcttgataataagcagatttattgactcatgttttgaatacatatttattgaggcactctactagatgctgggcaaagtgataaccagaaatagccagccagaaacactttccacaagtcattaccagagatttaagccacagtaaaaaggtggaggagaatagacgaaaggttttagggggaaccccatactcaaactctccctcagaaaaacaattattaagtcttttcttacaaactgtagagtaaaagaagctgcccaatcgcggtggctcacgcctgtaatcccagcactttgggaggctgaggtaggtggatcacgaggtcaggagatccagaccatcctggctaacacagtgaaacccatctctactaaaaatacaaaaaattagccaggcatggtggcgggcgcctgtagacccagctactcaggaggctgaggcgggagactggcgtgaacctgggagtcagagcttgcagtgagctgagattgcaccattgcactccagcctgggcgacagagcaagactccatctcaaaaaacaaaaaacgaaaaacaaaacaaaacaaaacaaaaaaagaagctgcccaataatgtctgagcaaaatggaggccatgattattttggctgtagtgttttagactttcatgtaggagagaaggattcgctaattggttttcagtcaaataattctactgaggaaaaagaagtattcctgaaagaaaattgagacataacatggataatgtaaagcctatatttaatcttggtcaattccattgtctcattttcatgtagatgtcaaacataccagcaaggagaaaatggttcaaaaatgcaacccagggaattgccctacttttcctacttgcccagtcttcaatacaatagatctttattctgttctcattttctctaacaaaatctccttgttcggaagagtcaaaggaataaatggttggaaggttaatctcctaattactttctcccttcataaaataatttatttaattgtggaaattattatgcagctgtagagggagagcatattcattttttttcaggaagtagttgagcaagcctgacttacgccaagagaaaaaataaaaattcctgagaaaaataacaaattgttcaaaatgagctgggttaagtatccaaaccaaggaacaagttcatttaaatggttactcaggaaatcttgacggtgatctaaattcaaagttgcttttgtttttctaggaggcctggcttacagaaagaacatgataggttcctaggatatatcttaattttgtacttcatttaatattgttaaaataattttgtctctaatatcacagcttgtaatatctcaaacaacactgattactgattggtaatgcaccatactctaacagatatttaatctctatcctctccttccctagaaaaggtgtcatggaccccgggatgtattatacattgcttatagcattttgctgcaactttaaggcaaaaagaaaaaaaggtctctgtcctaatcaggcataacagccatgaaatcctatgtgcaaattgaatatcaaactaatactgtttttactaaccaaaatccattatctaaaagtttgaacaagtgaaaaataatttatttatttgttatggtcccaattaataagatgagaaacttaacagaataaacatatgactatccatttgtacacatctaggaatggaaaaatgacccactttaagtacaaaaaaatgagaataatctataaaaactaatgaatcagtccctttaactttgtttattggaattacaatatcaaagcatttctaatttgggttaagtaaaacatacaccaaagaatctatagacagtacttacaacactgtcagttgagtatttggctttgatatagctttgaaaggtaaaagacaaaccaagtagatttttttttacttggggaagaatgtgagaatgtgttaagtagctcagagtaatcattccataatgtgaacagataccaaaacatcacaatctaccccataaacatataatatataaaaatattatttgtcaattataaaaagcctatgttaattaaactcagctgaaccctgatatatacaaaccagtgatgcaaatggtgttcaccaagcgcatactcttagttggtgagcatctgtaaacatgctcgttctcagcctacagctactaccgtttggagatcacggtcagtaatgatgaccagtctagggaaagttcatggatagattaagtcactgggctagtatggatttgcactgaaattccaagcaaagcctctttcatttagtccaaatcttgttctacttgactgcaactagatttcccaatagggtctgtcaatcaaaattaaaaagaagaaatgtaataactttaatttctttctaaatctagagtcaggacaaaacttctaagtcattattaactggtactctaccaagaatatagctctcaattattcatttcagttcttaattattccctgtttcaaaaaatagcctgcctgccgctcataaaatcattagctggagagaaaagtgggttcaattttgattggaagtaaaagatatggtaggatgtttgtgaaataatgcttgaaaagtaatgttttaaaaagaaaaaaataaaaactttgttttgttgtacttcttgtttatagctttcatgtaaaacaaactatggttgtttcaagatggagcctcacgttcttagatttggtatgtacaaacaatttctcctttgacggaaaatgagacattttactttgccagttactttggtttacttgactggacttgtataattttaatgcaagctaagccaattgttttctaacaaaagctgtcataaaaaaatttatgcagccttggaaatgtaaacgtaaaaaagaaatgtaaaaaagtaaaacgtattcatcattttcctgcaaattgaagctaattacacttagaattacttgcccttccacatatttcatttacaacccatatgatcttctcagagtctcatacttaagttaataaattcagttggaatttttaaacacatttataagtatgtatatattggaaatagcaccacatgtaaggcatctctgaattttgatgagttgggggttaggtggggacattacacaattattctggtttctaagattaaaaaaacaatcttcctacaagaaaataatgcaaactgaagagagagagattctctaccactcttgaagaaaactttgggccttggggctgagaaggaaaagtaactcaatgagccatttgtaacacattaacactaattcttaaatgctatttgtggttaaaaagagatgaaatagacaaataacctggaaaaatctgtgacaatagaattcaaatgtaaattatcatgtctcactgccccgttagctatccaaaggcaaaactccattatttcattccccttctcacatctattacttattttcctttctcaattagttttaattaattgtttcttaaagtgtacttacacatttaacagtggttactgtgggctgtgccgccctctgattattagtcttgaagccatcttatgttattgttccattcctcacactcaaaaggtccccaaagaacaacctcctgaagttaggaccaatggtccctttagtttgtcataaaaccaaagtgatacatgtgtttaataacacagaatgtgtgccataaaaccctgatttgaatagttcttggaaatgtaggccaaagacgtcagatgaaacgtgccaagttgagaggtgcagataaaaggtaaaggtttattttgtaaatgtgtaatattttgatagtcaccagggaagaaataatgttactgcatgtggacgggcaaggtggctcatacctgtaatcccagcactttgggaggccaaggtgggcagatcacctgaggtcaggcatttgagactagcctaaccaacatggtgaaacgccatctctactaaaaatacaaaaattagccgggcgtggtggcgtgtgccagtaatcccagctacttgggaggccgagacaggagagttgcttgatcctgggaggcagaggttgcagtgatctgagattgtgccactgcactccagccaggcaacagagcgagacttggtatcaaaaaaaaaaaaaaaaaaaaaaggtactgcatgggccatcatgtgaacctgaactaatgttattccatcacgtaggatgatggcagtcacatcattaatctaaaatattcactagtttcttgcaaggacattaagtagacagattcaacaattacttttgctagataaagttagggcaaaagtatgacggacagctgaaaagttccattcttttcaatgtcccagcagataaattagtagcttaccagtaacatcaagcattttaaaaagagaggaaaaaacaaaacaaaacaaaacaaaacaccaccagtaatgatccagtttaataacctcatatatttggcttggggtaaatatcaagtggtgctgatcagtggaattacagatgtaattggaaatgttaaattttcttcttactcgactagtcacatagactattctatctatactaaggaaacatttataagattttttgcaaatcgacagaaaagagtcatcaaggaaaaaatatgataatttataattctgtttgttttaatgaggaataatatatgtgggagctgaaaatgttaaaatatatcaaatatttcaaatataacaaaatatttaatcaaagcaaaaattagttttttttaaagactgatacattctttcacctccatttcaatatatattaactctcctaaagcaaattagttaatacacagagcatttttaaatgaattataaggatagccattcaagaattgtttatcctggaaaaatatcagtcacaaattaaatgtaaaatagtgagcaaatggattaaaatatatacagcatgaaagattgctttgtctcttaggacttcacactttaaaatgattattattaacattgaaatgatttatatcagtgaaggcagacatacacctgacttcagggaccaatacaatagagagtatttttgaaaaatgtatattctctagacttgctgatttaaacctcagcttgtgaccaagaattttcatttttcagaacctgaccatgttactcttcttatcaccgaaatctgataaccactgcagtaccaacttcaggatgttcctagatacctttggatatgttaaaggaatcctaagatggttgagggcactccacatttatctaagcctttagaacaacaatcacaaagtccagtgactacagaggccagactttaaaaaggaatagggagaaataaagtattgccgacaggagagagccttccctgtttcaaggcagtagcaactattcacttccattcgatactctcctacagaaatgtagaccactttgttcgatattctgagcttttttctctctcttttttttttttaatagtagagatgttgatgtttatgtgaaacattctgattttcaaatgttggcaaccagtttcgaatattttcagtgtgcaaccaagcactatgcttgcaaataaaacacaggtatgggaaggctctgactgaaggacaattaatttacaatatctgattgtggtaaactatctgaaagatatagaatattatgttctgcatatatatgtgttcgtgtgtgtgtgtatatatatatataaaacaactacaaaaaattatattcatatgtatatacgtataattttcttctttctgtgtttacatatataaagcacagattgacaagctggcttattaatactaggtgtagatattttgaaagagataaacaaatagtattgaacgtatctaaacagacagccaaatcaacaagttgaatggcaacaagtaagacgtacactctatgacagtgactaaattaaccaagagttacagataagagagtgattagcatgcgataagaacattatagaggactacctagagaaggcaaggtttaaattgggccatgtgctgggaaacctggatatctatatgcagaagaattacattagatccctatctctcatcatatacaaaattcaactctaaaaacaataaagatttaaaggcaagacctgaaaatatgaaactactagaaaaaaacatagggaaaacactctaagacattggtctaggcaaagattttacggctaagtcctcagaaacacagggaacaaaaacaaaaagagataactgggactgtattaaactaaaagcttctgtataccaaaggaaaaaatcaatagaatgaagagacaacctgctgaatggaagaaaatatttgcaaactattcatccaagggactaatatccagaataaacaaggagctgaaacaattcaatagcaaaaagccaaataaacacgttaaagagtggacaaagaatctgaaaagacatttacttaaagaagacatacaaacagccaacaggtatatgaaaaagtgttcaatataactaatcatcagggaaatatgaaaatccaaacctccatcagatatccttacccccgttagaatgtctaccatctaaaagacaaaacagatgctggtgaggatgtggagaaaaggcaattcttacacattgttggtggggatgtaaattagtacagccattatggaaaacaatacgtagatttctcaaacactaaaaagagagctattacatgattcagcaatcccactactgggtatttatccaaaggaaaggaaatcagttcaaaggaatacctgtccccctatcaccatgtttgttgcagtaatattcacaatagcaaagacatggaatcaatcaaagtatccgtcaacaggtaaatggataaagaagtggtggtatatgtacacagtggaatactcttgggtcataaaaaagaatcaaaacctgtcttttgcagcaacatgaatgaaactgaagggcattatgttaggtgaaataagctaggcacagatagacaaatatcacatgttctcacacatatgtgggagctaaaaaagttgatcttatggaggtggagagtataatgatagataccagaggctgagaagggtgttcatgtgtagaaagggggtgaagagaggtaggacagggggtataaacatacagttagatggaagaaatatgttctaatgtttgatagcacagtagggtgactatagttaataaaattgcattttatatttcaaaatagctagaagagaggatttgaaacattcccaacacataaaaatgataaaagctcaaggtgatgaatatcataaatccccctgacttgatcgttacacattctatacatataacaaaatatcacatgtacccagtaaatatgtataaaaatgtatatcaattaaaaaaatcaaaccatgaaagctaattaagtttaaaaaatgatttcatataactttagtaagaaatactttaaaattccttaatgctaaaaaatttatcagaccagttaatatataaattttagttatataagcatttaaaaatttagaaatattaaaaactggaaataattaaaaatcaagataggttggacttaagaggtgtggcattaagggagatcagatacaacagactgagcaaaagcaagaaggtgagaataaagcgaaacccaggcatagaacctacaaagaatacagtaagaagtcaccagaaatgtcaagcagactgtttgccagtctgaactatcaccctatccccgtaacagaattccatgaaaaactaagaaaaaataatatgacaaaatatatgttttatttccttctttatgagcctgtttggttaacattttataccatgcaatgttaggttgagaactaaaccaagaaatatgaacacaggaatggaaaatagaaagaaggaaagaaggaaaggagaggaagagaaaggtagtaaggagggaaggaaggaatgaagaaagaaaaataaaagagaatgaggaaataaagaagaaaaatgtaatgcaccatgaaaaggagatacatatacaaatatgcaaagggacatgcagaaaagaaacattgaccaattaatctcattaatgggtacagctcgaaaactaatgtgcttaagtacagagggaacaatttaggataaataatatgaaagaactttatagttatgtaagaacactcaggcaatggatcatgctatcgagggaatttagagacactcttggctggaagacactaatttattatgcgctgatttaagtataattaaaatcaacctagatattaaacaagggaaacgatatgtaacttttagatatccatttattacctaaggacagagagagcagcaaatgtgcaaatgttctacagccagattaatcttcctttaaaaagctcccattcataatatcactcccttttgaaaatactttaattgactctacatgatccatccaaattcataagtggagtattcaatatccatagtctggctttaccctactgtttcaatcatgcctcccacttcttctagatgctggccatctacactcattaggttgatctactccccatactttagggtgcacaatgtttgcccagcgtaattgctcagtgattttttaatggatttactgattaagcttcaaaggcatttccaactccacagaatgtatgctaattctaacgttacccgtatagaatactaaaaaaaaattttaacattctccaaaactatggctatatttttctcctcttccattttcatccttaggatggttttccaaagtaaaacactggcctgtgaaagctactgaaataatcttggtttcttcagtaagaaataaattattcactatcatccccactccaatgcaatcatagcagaattatctttcaaattatagccacatggtttctgaagactaatgaagaggctcagcccaggagacagttttgggatccaaaaaatacctttcagtttctgctctttctaattcggacagtagcaatgaggccacactgattcaactggtaagcttccttcatatttttcattgttgttttttcccttagtttcaagccctacctgagccttgcccacgctaccaccactctgtctgaatttttgcacctttatttcatccaggttgatactcacagcccctgagttttcctgactgtctaagacaacagtctaaaagtgaaaccagaaagctaggggggagaaacagtgtcacacaaaaattctggcagatactgccacctacagggattataaggtcatccccaactcaatctcctaaaaaatcactcatttataatagagggggaaactgggcatatttgaactacacggataaagaagaagccaatttcatcaaatgataacctttgatttagtgtatggaataattatatatgtatatatgtatgtatgtatatgcatatgtaaatcaatcattaaacagggccaataaaaacagggctgtaagaaagaaaattaaaggagaaatatcaggttgtgccagtcgataatttctgttactagaaattattaaaaatcatattggacgagttgattacctatttttggttctatatgctcttgaaaagtttatgtaacactgtatacaacatgatagaatatttacctataaccaaggtgtctaggggttgacatttttatcctataatatttgaaacttaaaattatattttagttattcacaaataattcattaaaattcataaactaaatgataaactatatcattcctgaaataactaatataaatgtagctatttaaaatatgagatgctggctatttctgtgatgatttaatgccatgttaacaaatatagagaagaaaatagtataaaagcatatttttagtatttactgtttaaaaaacctttagatctatgatttttaaaaactgcatttgaaaataattacaaacatatagaaaaggtgcaaaaaaagcacaaaacatccctttacccaagttcacctattactaaaatttaacactaggatttttctcaatttatttaatttttttctctctctgtccacacaaatacacacacacacacagaaattgttttttttcctgaaccatttgatggtgaattacatacatcatggcgctttacctcttaaatattgtgtatttcctaataataatatcgtcttacataatcataatgttaccaaccaaataatctaatctaaaaagtagattatttgatctcatctacaatctatttccccatttcctgtcaattgatccagaaatatcttcacgctatctccccctccagaacaagacccagtctaggaaagctataatctttgaatctgcttttttaggggagaagaaggaagagattccttattttttagctgcgtaggctcttagctgtgtcaccattgcaaccaaatggcttgagtgtgacaactcccattcatctttttggtctaccttttcctttaatacatcttggagtcagaagatggataataaattattttggaattatagatgggtaatatttaatgcccaatataagaaggactgaagacttctaaggtttgagggcagatgattttttttgcatgcatttgacagctcaattgatttttacttcttcataagttacctaagtgctatggataggtgatatggtactactttaggtgttgataactgaattatgtcagtagtctagggatgacaaatagccagaaaaaaaaaattcattagtttccccaaattggtaaacagtttttgggaaattggaagaataatatgagtgtcatggagacactatcggctaaattgacaatcagtaagaattaggtaactgaaaacctagctctttaagtgtgtatgagaggagagaaggcgggttaaactggcagttataattaccatgattcattcaaaagtatgaactgcagtagttactatgcatttccaagtagattttcaaaactcctaaattggtgggagtctaaattcgttcaaccattgtggaagagagtgtggtgattcctcaaggatctagaactagaaataccatttgacccagcaatcccattactgggtatatacccaaaggattacaaatcatccttctataaagacacatgcacatggatgtttactgcagcactattcacaatagcaaagacttggaaccaatccaattgcccatcaatgatagactggataaagaaaatatggcacacatttgttagattatatagagtaatgctaaatatttaaatcagcaaatcatctgttccattatagttttttaaatgattattttgccactacccaaggatgctgtgaaaataaatgataagatattctatcaacaaacaatgaggctttcaattaaagctgattataacttacttttaatgtatattgctattatacttaggctaaaaaaccagtttacgttaacatagtttttatgttaggctaaacatcaatatacacaggccaagttttctttgaataatcttcttttgttaatgaatggtccaaatctttaccccacctaaaattcctttctttgtgttttttacccattgaaattctgtatcgtcatacttaggtcagtcttctgggaagtcttttctgaaggtttcaatttattcctcttaagaatttattttgcatttatgcattctaacactcattttcacattaccacttcatgttgtaaaattttcaagtaattttagaccctacataaataattccctaagaataattttgttaattttatcctattttgtttcccctgtaacactcagtacaaatgctctctgattggtgggtcctctataatagttggctatttcagatgaatggtaaaagacccctctcacatctgggatcatcaggaggtcagagtttcagcaagcattgcagttatgcaaatttctatttgttactattacaataattgctagcagctagaagaagctagagtaatgatgtattttttcaaataagtgccttagaagattcctaggaaaagctaattgcaaacacctaggagagaaggcatatgcattatctttatctgtatagccagagtcctactagttacagagtggcaaagaagcagcatccaaataacttgtcttaggtatttgtgaataactaaaaatttagataattgcatttgaaaataccatattttagtgcattctatatgtggggtccacctctgaacacttgcatccctagagttaaagagagctagaaaggacaaatggacaacagacagcgtctctgcagacgaggtgattctttgagatgttattaaaatgagtgctgttcaactacgtgattgactgtaatatgaagtcacgtgtggaaaaaacaaaactacaccctgcattataaacaccattctagtgataagacatcctctaacccacttgtaaaattaagaagataaaaaccacttagttagatttggcttaaccatagttaaaacaagtttctaacatgaagtaaaccttaaccacaggcttcttctttcagaaaagcaaatacaaaacagttatagctagaaatcccatggtgtcttttaaagtactgaaagttttcagactatattgctgaagcctgttgcatgtagcctatgcatgtagctgcttgtctcctgtaggaatcctagcttacaaagtctagatgtgaaataggtcctgggttgagtggggcatctataagttaaaaatattttcaactgtgtagagttctacaggttctccagtcttatgattgggagaatggtgcttgctgactgtcagatgcttctattctcacatccatcttaataatatattcacacaagcatatgctgttaaataaacaaaagcagtactgatgatgatctggtatctgtgagtgtgaaactaatttttttttaagttgtaagtcatttgcaacctagacacttacagagattattggggtaaaattgtggactctagaggcaacagctccaccatttattgattacatgactagcaagttacttaacctctgtttatgtcagtttcctcatttataaatccaaagctaatattagcttctacttcatgaagtctctataaggagtatgctttttactcaagcagagcacttgctacattgctcaaacaatattagcttgtcttaataccattacacaaatacatgaagggcaaaaaaaaacaaagtctaatttctccaataaacaaattgctcatgtcatcaatctaatcaccatttgattgagtttagttgtttttcttttcctgaacacaggtccattgctagacatgcacttgcttatccagagggccaatcagatttctgaaaaagttccaagttttggcatattcctctctttctctttgactgactgacccatgattcagaattgcaatcacaaagtgcccctgatgctactgttcacactgtcagaggatagaaacacacaaagtttaatcagattctcagtagcaatgtgatgtcaatcgggatgattaaataccagccattctaagcctgccttgcaattgttgtctgagaattcacctgagtcctaaggaatgtgataatcctaggtctgcagagtacactgacccagagaaagaccactgacaacatctacatctacctttcttttggtatgggggtgccagagagggttaaatttacagtgtgtataatcatctctgggttgaaagtctatttgccaggttcatattaacaatatgttttctctaagagcatagcataaagtagtgaaaatagaggtctttcagcaatgcatggcttttgcctacagcagcagagagggaaggtggaaagtcattgctatgaaagaggctatttgttgtttataaagcataatttttaaagataaattgctggaaacatcgatgccatgaacataagtagacattgttcactttatggaatccattttatatccatttgcgctgcctgcttatgaaaggaataaagggagaatttcagaaatggctaagcaaaaaagacaaagggtggccattttgttaaagttttaccatccaagaaagtgctggcaaagaagtggagatatatccacaccaaattgtcaccactactgataaataactcagagaactgatctatataggtgacaaatcaaaatggatatttgcatacaaagagaagcaaatgatatggaataccatatcatatcctcatgacctagtgtcaatgtgactatgatggaagccataagtgacaccctcagcaaaataattcgaattcattctagtgctcctgggctcccatagcaccttgtatatacctctttgataaaacttactatgttttactcttcctccttacccagctagcttttacactaaactgtgagctatttgggaatagagattttactttccttatctttatatatacatagatttatctcagtgccaagcacataataaacaccaaaaatgttgaatattgattggattctgtgctttcatctttggtgactagtttaattgaaaaaaaaagcagtagttctgactcaagagaagacttgagcccccagaaataggcttgttttcattattatctgtaagtattccagtatgttaaccatgccatttaactcactgcctgtatgtagccatatgcatatcagctgaactattgatgccaaatgaaagtgggattatataattcaaaccaccccttgggtttaaatttggtccaagacttgcactctttatatttcttattttttttccttctattagtgaatttctccattactcctggggaaatagataattctcctttaagtagattcaattactgtaaagaaatcacacttgatcactttgaggagatctaagctttgctcaaactacaattcaatgagctgacctagagttaatcaccttttactcattcatttatcaaagagacaagcacaacaatggatggattttggcatgcagtcttcatgcatgcaccacattaattaattcctattaaggaggttttaccagcacttgcaatgaacactaacacttataaagacagcacagtccacattcttgctgttctgtctacacttagacatcagaactagcaaaggatgtattgtctatttttttctacataaaataaagcttactactttgtgcaaaccacttacctactgataagtccacactctgctagtttcagtgttctcctaaagaagcaaaagtatattactgctaaatgttcctgtaaggactaatttccagtgaggtgtatctgtcattttgtacatctttacaatttctgaactgcagaaagataacaggttttgtagaataaagaagaatcatttaggaattaggtgttagatacctatctatatttttttgtttctactcagtatcacatttatcttctgcgatttataaaactatacctccttttacaggaacatgatgcttcccatatcacatccaaatggagcccatagggattgctatgttcttacatgaccatacacccctggccagagttggtagattgaggagtaggctcaaactgggccaaacacagtaccttacctccctgaacacatttgattggtccaggagtgggtacctcacttagcccactgcatctagagccaagtgtctattcccatctttatcctgggatatttggattttagatggtatcttcaaaaaactcagatttgtttcccacaggggctaaagatttatgcaataaaacttaagagttctcagaaactaagtttttcacctcaaggaaaagcctagtctgcagtgaaaccaaatgaagctgacaagctgagagaggcaaagaggaaaaccagattgatttctgacagtgcctgaatcccgagggctggacttcaccactcttctttcctcagctttgttatttaaggtttctttccattctgggagccaataaatctccccctttgcttaaatacttcaggctgcctttctgacagttacaaaccaaacaattctaatcatattcattaatagtgcacactaaaacacactgtcaaagacagttacatttcagactcttcaaaaaaaaatcaatgaaagtgacagaagtttaaaataggatatcagtatgcaccagtatagcattcttatttccccatgtttcttctctaatcaccctactagattttcatagagtgtttaatatgagggaaacaggggaggttaggcctcaggcttctagtttctaatgtatttatagggaaagaaacaattgtaaactagtaccaaaagctccaaagctttaaaacaagcaaataaaaaaaaatcaataaataatatgggatagaaacagaaagtagattagtggctgcctgggactgggtgtgggaactgagaatgactaaaaatgggtatgaggtttctttttgcctgatggatacattctaaagttggattgtggcaatggttgcaattacttagtaagtttactaaaaattagataactgtatactttaaaaattagtgagttttatggtatgaaaactatacttcaatgcagctgtaaaataggcaaataaagcaaacaaaaatagaaataaagagtatgagcaattctacagattttaagcagctagagaaaatgattaccaataataatctttaggaattaaaattaacaccaatagaagcagcatgctgtaaatgtaaatatagttcaatatttcatttttaattttttcttattgtggtataatatacataacataaaatatactgtcttaaccattttaagtatacagttcagtggtactaagtgcactcatattgttgtacaacggtcaccaccatgcatctcaataactctttctatctggcaaaactctattcccactaaacaataactacccatttcctctctctccagcctctggcaatcatcattctaccttctgtttctataattttcactactctaggtacattatataagtagaatcatacagtatttgtcttttcatgactagattattttacttatgacaatgttctcaaggttcatccatgaaccctgcatatgtcagaatttctttccttttaaaggctgaataatgttccattgtatgtatacagtagtccctccttaaccacagggaatatgttccaaggcccccagtgcacacctgaaataaggcatagtaacaaaccctacttacactatgtttcccgcagcttttatttatctgggaatatcttaatttctccttcactttcaaagaacagttttgccagatataggattcttggttcacagttttgttttgctttatttttttattttggcactttgaatatatcagcccattgccttctggccttcaaagtttctgaagagaaatcttagctaatcttattaaggatgacatgtatgaatgacttgcttctctctcactacttttaagatcctctctttgtcttttgacggtttgattctaatatgactcagtggtttccctttgaattcatcctactttacatgttttgaatttcttggagttttatatttatgttttcattgaacttgggaaattttcaggtattatttttttcaaataatctctgtccctttctccttctcttctccctctgagacttccaaaatgtgtgtgttcatttgtttgatggtgttctataggttccttaggcactatttacttttctccaatcattttttactttctgttcctcagactcagtaatttcaataggtaaaaatcttgacctatcttcaagctcagtagttcttcctcctgtctgctcagttctgtattttattccctctagtaaatttttcatgttagttattttatttttcagctctagaacttgtttgcaatttttaagattttctacgtctttgttgctatttccattttgttcattcatagtttttttcttaatttcttcctttattcttagagcatttttaagacaattgttttaaagtctttgtctagtaagtttgccatctggtttttctctggcacagtttctatttttttttcctttaaatgagtcatactttttcccaattctttatatgtaattttttttttgttgaaaaatggacatttgaatttaatgatatggcaactctggaaatcagattacctcccttcctaaggattgctgttttttggtttgacttttcatttttgttcttttgggttcttctgattgttgcaggctgtctttgagccagggatcagcctgagctataaatttgaggtcttctcaagtttattctgggctcatgcctttccctgagtatgcacaccgactttctaatttcctctgcatatgcagttgcttttgaatgtctaaatctttattttctggctccaaaaaaagaaagaagaaaagaaaagaagaaaaataaagtgtgtgtgggaaagttaccaggcctttaaatcctcctcttagctggagggaagaagggtttgcaacaatgaggagagggtgaaatgatgagtccccacctctgtatctgcacctacatggtcagagacagtagtcagaaatcaaaacacaggtctctggtatttgacactttgagtcttatttgtccatcatggcttctacaagctgcatgcaagcctaacacagtatggggagtagagaagatagatagttgctgctaaactaaaactgactaaaattaaccataatttatcatccaagtcttcccttagaagttatacacctttaatagactccagagattaaaaatagttacttcagacagattgtatcagtgcaattattgtctatataaaaagacagattcctggtgcttcctttttttagatcttcccagactcctctttgaagattattttttatcctaatctacatatagtttcttcagataaagatctgaataaaaaaaagactacgcattgagtacaatgtatactgctcgggtgatgagtgcaccaaaatctcagaaatcatcactaaatcattattaagaacttattcatgtaaccaaataccacctgctccctaaaaacctattaaaattaaacaaaaaaaacagtgtggaaaaaattaagaagcatgggaattgtaaataatcaaggatgtataatatctatgaattttataagatacaatgagataaatagaaaaccttagacagctttctatccggtaaaaacaaatggaattgaccatctattgttaaaaaaaggacagttctaaagatcagaggtcaactgtgagtgatgtgagaatataattagccacagaatattatagtacttcaataaagaaaggctcctatagttaaaaacatacaagtcagacaaaggaagaacaatacatctatgatccataaagaattaataaagcagaacaaaaaggtattctgcagatataatttgcctggatgttttgcaaaaacttttatgaagaatttttcaaaagaaagtcatggaaaataaagaccaaggaggattttgaatacaaattaaaatttcattgtttgagatcaaagagtatacctctaataagcattaagaaaaaaaagcatttaaatgtaagcattttaatgtattaaaattattaagatcactgttgcccaatagattatattaaacaaccttaacttaaaatgaaaaaattgaataaaagtataaaatcattcaaaattgtatctatagtggaatttcatcaaagctgtaaaataactctaattaccaaaattatatctattttttaaacctgttttcctatttaagttgattactccgtgaggtaatttttactgccccagtaatgcgattcaagttttttacatctttccacagattcttttattatggaaagaagacactaaaatactatccagttgaaaatgtaattcctttcttaatatatcccaggttatttttgttagtaagtgaagtattcagggaaaatatctctagcatccccaagtctatagagtagtgtgggtaatgaccaataaggaactattttggggtacattcatttattattttgcttggggccctcaggcatacatatacacttccctatccctaaaatacaaaatctgctacccaagaacaattaagaaaaaaaaaaagaagaaaggagggacgaattatgataatttaattacaatgctgacaaatgtatacatgaagttcaaaggttattctcatatgctccttctaagagtacaaattgttatataatttggtaagatccttctctagaataaaaaacaatacaagtttaaagctttaagattggatagtatttttgatcctgtttttttccaccctgacatttattttaataaatacatgatgcatatgtagaatattttatctaaaaagatgttagccacctttttccttataacagtgaaaaacggaaacctctgcctataagtaagagatgcataaaataagtatggtgtattcatataaactatatgcaactaataaaaatgatggccaaagttttcacagtagactgagcaaaaaactatgagacagtacacacatttctactgtttaaaaaaaagtagacatttgtaaatttgtacaaaaagtagaatgttcttaaaaaagtagaaatttatttgcatatttaagttgacaaatttgttaacttaaaaatctaagttaattcacatgcaaataaatacatctagaattatatatatatcaatatgtttttagcatttatctctggatggtgagattataaattattttactttgttctttgcttctctttgtattctataaagttcctacaataaatacatattacttttggaataaaaaaggaataaaggttatttctaaagttaaagtaaaaaaattaacagtcatataatgtaaaatgaatgtgaagataccctgaaaatacagagtaaagggatctctctctaggtagtaaaaccaagggctaagtctttttagaggccccattaaataagtaggatagcaagtaatacagtgtatgagaaagggcaaaggtctcagcactagcgtgcctgtgttttaggttaggttttaccatttagtggttaaagactttgggtaatcattgtttgacttttcttactttattttttgtccacctataaaaaattacgtaaatggttccttgccttttatcttacgggttacctcaatgttcaaacatgtgcatgaatgtggacacattttataactataaagcaataatgtaagtttattaaaaagttgttaaaataacattaaggagaaaagcagacaaccaaataatagcacaattcagtgaaaaaagaaaaaaataaaccaatacaatgtaaagtttcacacgccatgttttaatccttatctagttccttcattgaaaggaaattatatgagtatgtaagataactatcaaatcctacccttttcctaaaacatcccctttcaagtcagttgcaagtaaactcttaacaacaaccacagtactgctattggtttgaattacctgcaacatgtaaagcatatatgcgattcacaaaccactaaagtgctataagaaaatgtccttttggttgtctcttatgtaccacacaaatgctaaaagaacaataacaactaatattttcattgaaagtctattatgtccctggggctgtactaagtgctttgtatgtattatcttagttaaaccatttaaccatcttcttaagtaggtgttattaagtagccaattcaaagacacatagaggtacacaggtggggcaggcattaaagcctatgtgcttaatcactacataaaatgccttctgttttgcaatatgaatggatattgtggtgaataagatatgggctctgtctctaaggctactgacatttaacagtggaggtaagatatgcatgcattcccaaacaaaattcaagttgagatcatttggacttctctctaagagtagttggcattgtatctgcgtcttaactttaagcgttttcaccagtcattcaggcacagaaagttatatatgtaaagacagaatataaaaaagataagcataggcgtttataatatttacatatgaaattatgtatgcaatatacacattacatattattccaggaatacgtattttattcatgagccaacattatgctacttgagggcagaatgtgaccaattcttattacaagactttcacataatataggacttacacactcagaggcagatgctgaataaatgccctgagctgtgtttttaagaatatttgtttcaaggtacgaacatgacagatttggccatagggaaggtgaagcaggggaaaggctagtaagatagacgaaatgttgtccagcagcagaaatggaggcagtaagaatggagaggaagaaacaatgcaaataaagtccaccagcgttgggcagtctgtagtgagaaaagtttaaagatctcttttaaagtggcactctggatttccaaggaaaacactctattgtcaagtaaagtgaatgtgttgcttggtaggatgatcttctgaacacattgaatttgaggtattgaggggccatttcatgactgggattagagctggggatatggatttaggagtaatcccccgagagtggatagatgaaaccttgggagtagctagtaggggagagaaacaaggagggcaattataaaaaaaaagaaatgaagctgctggagaaagatccttcaggaatatttataagaagttgagtgtgtgtgtgtgtgtgtgtgtgtgtgtgtgtgtgtgtgtgtgtagggggagtcaaattagaggaaggaattaaagggtcacaagaatctatccattttccaccacatctgatccataatttctaaaagcttaaatagaatccacatcattgatagatttgtctttctataagtctgtggagcgttcatcagagcccacaggatgcaaaagtagtacaaaatgcccatcaaaatattctccagcttcaatccatttaacataatttaactaaggtaacataccttagttaagacaatcatcactatttgctgacattcatagacagtacattttcttacaagcatttacttcataaaacaccaagagaaattaaactatgttggaacagagtgatgtctaacacaactggaaaaggaaaaaaagggttctggacattgttatcccaatgttaatgtcctaatcttgatttttcttacaaagcaactggttttctttgaaatgtctaattgatgaatacaattaaaaactaaagttctttgtgaaggaaaaaaaacattatcttcagaaaccaggaagctgagtgttaagccattgctttgtttcaaatgcagctgtatcttgttgcatgatagcatttatggcatcaccagtggaatattgtttttaataagtgcaaaactggtgaagacattggtctcctttagaaagaaaaagttaataatttcttctccaccacatattggctaccctgtttattaaaagatagacatttttgacatttggaaagcaataattgattctacaatattattaggagtccatatagatagtgaacctttcctgtcaggatacgacaaaaaacgcgtaagatagggacatccaaggatcacctaccattcatcacacgcaaggtaactgctttcccctaagttcactcaagcagaaaatgaacagttgccaatgatgatcagagagatagaaaatgctgcttccaggaatgaaagtctctttgttgttgttgttgttgttgttgttttaaagttaaaccaatattctatatacttttgctgaaatagcaagagggccagatttgataagatcacagtcctggaactgatcagttgctccttgatgtgtttacagaattttacaatcatataaccaacagatgctcaaaagtagcctcaaaaccaacaaagacaaacattctgttttcaatctttggtgaattattttgaagtttcaaagcatattgctcagaatggaattttacaaagataatctttagatcttagttatttggaggattataaactataccaatttactgttctatcattggaagaactgcaagtattttttgctccccacaaaactaaatctcctctgaaaatagaaacctatttcaataattcaatttgtattgcaatcaatacaaattgattgggtgcaataaaaagtacagctaattcttagaaataagcatgcttatgtcattaaggctaaaactgctagcatgagaagctcaagtgaaataaataaagtgtattcttataataagcattgccaagccattggtagttgaagacactattcaaagatgcaaccttgtctttcattggtgttctctgtctgcatagaaagggctgtgaaaggagagatgcaaaagaggcaaagaaataggaaaaatgtcttgggagaaggaaggatgttccaatgatatggaataacaacaaaaaagttaacttgggacaagttattatttaataatactggagacaattccaaaaatattttgaatcacataattatgctgtggaagaaaaaaaaattattcaacgtccaagactttgtgtttgtgaaaaaactgtcctctttattttatagcccatatattctaaatgtttacaaagataaacaacattgtttttgtgaccattaaaatatgatatgtgaggaagtatgcagggcttgggacttgaagattctgcatcaaattcagaataaataacctgtgatttagctacaattcgggccaaaccttcatggctttttgacatcaagaactagtacatagtgagggatcaaaggatgcaaaattgagtgtaatcaaggatatatgattttttcttctatcaggtaaggtacaactgctagtattgatgaaatgacaacttaaaaaaaggctttctgggccagacgcagttgctaacgtctgtaatcccagcactttgggaggtcgaggtgggcagatcaccttaggtcaggagttcgaaaccagcctgaccaacatggtgaaaacccgtctctactaaaaatacaaaaattagctgggcatggtgatgcatgcctgtaatcccagctactcaggaggctgaggcaggaaaattgcttgaacccaggaggtggaagttgcagtgagctgagattgcgccattgcactccagtctgggcaacaagagcgaaatttcgtctccaaaaaaaaaaatggctttctgttacaaaaatgacaggtcagtaatctgttacagaaaaatttataataagaaaatgtgagtaggtaaacacacctaaatataccttaaagattgctcaaaaaaagactcaagtggattaaggacttcccaaagtattcttagtggtgcttgtcaaacactatccagaaagccctcggtcaggtttgtaatcttttcggtagtgttcatttgttgcaataaaataagtcagcagttttaacaaagaaaaaaattctataatgtttactgtttaatactaaacacaacagtgtgagattatttcctgggcttttaaaaattatacatatcttttttttagaaacctttacaaggaatagtagcatcctatgaaaagttggcttaatatttgattatatatggtgtgtatgattatctccataatttgagacattaggctattggtcagaaatgtgatctccactgtaacagcattttaggggaacaattatatttgatatttctgttttcaatttatagtgtctattctagaaatataatctgccataatctgtcaaaactgccaagactgtttgtagtacttcaatggtactttacagctaatatcaccaccacccaacacccatctgcataatgcatttaaccttacaaagaatacttttatctattatattacttcattttcaaaatggtcttataaaacaggtagagcagggattttaactgaatttccattatgaggaaaataaggtaacaacccattcctggcaaaatctggactagaattcaaatcatttggctccaaactaacacatgcttctccaaaaagcagcccagtatttccagcgacttaatttaatgaacagattcaagacatgggttaaaaatgttgaggatgtcaggctgactgtcactgagtatacttcttgggtaaggggcatccttactcctgttaagatgatcttactaacagctaaagcagactgggagaattttgacaggagaactactattcttttcagacacagatagttcccttttggtgaaacttgttgcaatgttccacaaagtgttaccgcatctggaaagtccataataattttgatttatctgcactgacagtcagcagtatgttatattcactgttgcataatattattatctgttgatcttcccagtagataatatattcctcaaaggaagaatcttgcttattttttaactctgtttagtgccagccatgttgaagttgctcagtaaaatttgtgggaggaatgaaggcaggaaggcaggcaggcaggaaggaaaggaaagaagggaggggatgacgaagttttggaattttcttttgcaaaacactctgctaattgaatttatgacacaaaagagttcagggacaacaacaagaaaaatgtttgaagtcattgtagcgaaagagtatctcaaaaacaagtaagagaatgacttaatccaaccacttgatatgaaaattaccagtaattagcctgtgttaaagagatcaacttttttacacaactcagcagcaaattggttaacttaaccaaagttatgcccaaattgctccttatccaaactgatttctatgttttggtttcatgaaactgatctatcattcaggacaataaactaaataagaactaggcgttttatatagtgttaaggaaaaaacatcattactggcactagtatcaaataatattgctttctttggcaagcaactcaaactaggaaaatgaatttattaaaactcttcatggaccttatatcaagtctgcaatctcctaaatgtaaaactctgcctataaacattgtcagggtaaaattttgccttaaaacagagtaattgcttctatttcctgtgatgtttacacagcaactccttcagaattactcttaaaaagaaatagaaaagaaaatcaatagcaacagtgcactatgaaataaactttgtggcagaaatggaaccagaagattaagataaaaccataaaagtatgaaataataaaaagggcaccaaattcactccataaaaaagactaaacatgatttcaaatgtatattacacacacacacaatggaatatagacattttgtatttcacaagaacatttttataaaaaataatttgcaaaaattaatccagtagcaattaatactattctgcctaacctcatggtattgacaaaccttaatcagatattatttgtaaaaatatactttacagcattattacaaatgtttcattttccaaataaattatctttgaaatatttttactttgtataaaatttttaaaattcaagaatcatatactctctcttgttaaaaatgtcaactactaattacacaacttactataactgcttttactatttgtatgcaacattcttcttcattatttgtgttctactttgcttgttttccaaagtctctggagatattcttgtaagacaaatttaaaacatttatcaatttttatcttaaatattaatttgagttgaaaattagacatgtttaccttaaatactgagcaaaaataatttcaactatatataacagttatagatctatcaatccaaaatgtatatatatatatatatatataaaacaatactaaatgtagtatcttaagtaattttgaaactaacatgaatttccaaatgcttctttagcctagcagacgtccaatgatacacggttgaaggtaactgcttcaatggcaatcaatcattaaccatcaaatccactcaagactagaatcaaactttcttctattaaattacccgcgcaaaacaactgagttttcccatccaaaccattggcctctgcaacttgtaagagtagagggaaaacagacagatctacttgataatcaatttaaaggttatcaaggctttctttacttttgctaacacagtttctattttgagccttcttggccaatgtgcttctgcctaagtgtcacaatctgttttaggtcttagctaagaaaatgtcttatatggtttttacagttaaggattgacaactgccttttgcttttgttggtaagcactcctctaaagttctcttgcctgatcaaacctcacaaaaatagaaattggtccttattctgaatgtttaaaagtccagtaagcatttactttttcttgacgtgtgttaacatatacacgttttgatctactcttgaagtaattaatttaggaaagtgaattaccaatactgtacaaacacatgatgccatatggattttcagggctgaaccaagttcataagcaagatggcaatgaggagacatctatactttatcttattgcaactaccactttgagctaagtacacagagcttgaaggagaaatcattacttgcttctttggaaaccaaatccatcctctcaaaccctatggttttcccttccctttgttaggccatactgatttacattgtatttcagtattgaaatttacatcagaccaatttcacattgtttagtaacttgtgatttatgtagtattaagattaattccattatgaccaatatcctgtcatatcatttaattacattgacatttattgtaattacatctaataaattagatacatttaaatacattccagctaagaatttaaacaaatgagagccacctggcacaatgagagaaactgtttcagtacagagacggcaaagacactctctgctccccaagttaaaatgatttagtttgacacaacctggaggaatttattctgtgatcacgatattttctcttttgcataagatacacaaagtttgagatggaatttggtggtaattagaaggcagagaagaccataagaaatatgggaggtcatgcttttctcttttcattaaaaagttatctaaaatgatagcataatccttgatagtcatttttaattggcaattattgagtacacacagtgcagccagaattgaactgaagtgtcacattgtcaaatgtgacttttcctgttgcatttgctttggcagcttgaacataactattaggaccaagaagaaataaatacttcacattctaaagaatatggggccagatcctctttccagagctatgatcaatagcaacccccaccgcctaatcctccttccctaacacactttctaatctacataaggtgatctgaggatcagaaaagagaaagagacaacgcattcttaatggagaatacagaggttgtgttctccgttctccgtcaaaacacccaatttaagtgcgattgaactccaaaataaataaagacagggacactggcatgtcacttccagggctctgtacttactgtcagtggagtgaagcaaagaacttttaactcaatttaatacatgatccctgtggcttgaggctatacatgaggagagagaggtgtctactcctcacctggaggtttctgaaagcaagagactctccaaacaatctatcctagggtgaaagaacctaaaaagccaaggagaaaagccctctctgatcctcacaaccccctgaggttgctgaagaagacctcaatgggtaactgacctcagtgggtaactgagcttcatgtggagaagtatgaagtagaaggtggaagaagaacgacaaggtggtctagataacagtcatattaacggatcctcatggaggagtgagggacattagctgcttatagaaagtacggtagcaggagcaacagcatgttgtgtttacacactttgacatcatatatttctggatgaagcctcagcactatttttttttctttttctttagacacagtctcactctgtcacccaggctggagtgcagtggcgcaatctcagctcaccgcaacctccgcctgccgagttcaagcgattctcttgcctcagcctcccgactaggtgggattataggtatgcaccaccacgtctggctaacttttgtatttttagtagaaacgaggtttcagcatgttggccaggctggtctccaactcctgacctcaggtgatacacccacctcagcctcccgaagtgctgggattacaggcgtgagccacccaccgcgcccagccagcactgtcaactcatttaaggtctctgagccttactttcctcctctgcaaaatgagaacaatgtgctctacctcacagggcttttatgatgaacaaatcggacaatacttttagaaatgatgtcaaatgattacactatgcaaacaatgatattattacttaacctatatattacattcaacttcactgcttgctcatattatcttactatattatatatattcttaggacagctggagtcttgtactactttatgtcttgtgtattctccaggtgtgctatatttagcataatctaagaatgatttgcaatgacccttatctttgtataattctcttccctttgagtgtgtgtgtaacctgtaaatatgacaatatatctcaccaatgatacaggctgagcaagccaaatctaaaaatttgaaatccaaaatgctccataatctgaaactttgcagccaatatgacactcaaaagaaatgctcattgaaacattttggattttggattttcagatttgggatgctcaacttggtaagtgcaatgcaaatatttcaaaatctgaagaaaatccaaaatctgaaacatttctggtcctaggcattttggataggagtactcaacgtatgtgtgtgtgtgtgtgtgtgtgtgtgtgtgtgtgtgtgtgtgtgtttgtgtgtgtgtgtgtgttcaagaatggaaaagccactaagaatgccctccagctgacaaccagcaagaaactgggacctcagtcctacagcctcacagaactgaatactggtaacattctgaagaagcttggaagcagtttcatcttcaaatcctcaagataaagagcccagtcaactggctccttaatattagccttcttgagaccctaagcagagaagcaagttgagctcccacagacatgtgatctacagaaatgtaagctaaaaaaatatatgtgttttttggctactaactttgtagtaatctattatttagtgattgaaaactgatacagatgctaaaacctatttattaaatgcatactatttattaaatgaaagccattgattgaatgttcatgaagcaattaatatataatatctgagaacatttcatgtgaggtcttgtctgaaaattcttctgaagaattttgaatccttattagaatctgaaaaaaaatctcagaggctaatcacaactaggattaattggaagacatgaataagcacccctggtgatgtttaaaacatttgttgagggtagagtggtagagtttagcaaaacctgtagtcaagtaggatggaggctcggcaccaatataatttggccaaaaacttccatggtttactcataggctgatggcatgtagattacatacaatgaaatgataatttttatgttaaggagagaattctcaaaatatttgtaaaaatgggcagtttgggatggctttatggaaaagtggggttcatgttaagtctcaacaccgagtactaatgactaaagtaaaagaacactgatgaggaactaaaagaaaactacagagataatcaaatctgctcccctgcctcaccccttatgcattataatatgtcatcattccctgccaaaaatagaattccttttattttagtatatctctagggaataagatcgaagaacactctcctaggaatttaattatccttcgttggaggaaatcctctcgctcaacatgaaggcaaaaagtaaaggccatttcatcttgtcctgcctcccccccgcctgttaattttaaaacacatgtttagatactagaatattttaagaaaacagctaccatactggcatctggtgctattggcaaccagtgcaaggataagctccagtgagaatttaaaaatgccttttcctaaggagaaactgttaaaaaaaaaaaacaacctgattatcaattgttccccaattcatgaggaaaaagaacaagtattatcaaagagctaatttataaatacctggatttacaactcttttccactaagtatttccaaaataattgttctcaaagttaactgtacactagagttaactagggacctttaacaaattttgatgcctagtttctatgcctttaaaaattctgaactaattggtctggagttcagtttgtttattgtgataatttcaagagctcccaggtaattctaatttatggcctctgagctatggtccaggattacatgcatagtagacttctgaagaaagacaaccatgagttcagtttatttctccactagaaggactggattttagagatctctgaagtaaaatatccatgcatatttgctctgaaataaaaatgttacagaacaatgcttttatttcaaggtttgcatttttccaaaggttttttttttcaattcctctgtttgcaatgcagcaatatcttgtttgaatgcaaattaaatcttcctcttaataagaaggatgtgtctctgcctcaggaccatgtacaaacagtctggtgatggcaggcagtgacccagggatgttcatgatggactgagagagacatggcaaacattacaagcatgcattgcaaatactggactgtggaaaattaatagttttaacccttaagccaacttcacctggcacagtagcatattttagcaataatttacctacattttacactaacttgggggaattacagacacaaagttggaaataaaccatactgaagatagcattatactttaccttggctgaaacttgggaagcaacacaatttggcctttatatttaaaaatcacggttcatttgacgtcacataaatgtagagagaagagtggaaatttgagtgagaaaagctattaggaagtatatttactagagaaggaatagaattaacagaacttagtttttttcatcttacattttcttttgttgataacgaatcaattggaacatttttgaggttgccagaatcttctgattctggagcctaaataaggttttttactggcaggttgaccgaataatagaaatttcatggccagaggccaaccaacactttataaaagccctctggaccaggtggttgacaagcccaggacttacatgaatgcaaccccagaagaaaaacttgcaagtgcctcttcaatagccatccaagactcttgcttgaaattcaaggcagctgatggtgatttcgtcttccatttacaacttctttattcttataaaaagaatgctgtatccttttctttcctccccaacaccaacagttcactcgttcaaaaactctaaggcattcagttaaaagtagatgaaaatattgtttgccagaaacatcttcaaacagaatatgagttttcacacacggaatgctcattagaagcagaagcaaacgtatcactgtaacataataatagctcatattgagcaagtactctgggctgtgtgcctaacatacaatagctcatttaattaaccataatgttgggtggaagctattattttcatttcacaaattaggaatctcagacacatagaacttaaatcacttgctgaaagccgtacagaaagcagtaaaagatccagtattcaaaagtaggtaatttggccaaaagtgtccactcttaattataccactctattgtagctattgtgtaaagtggcccatgagaacaagcaatgggtaccttgccccagtggaaaaagataaattcagggaagtttcttgggtaagtttatttctgcactaagtgaaaatgttaaataaaaaaatatatggatgaggtaggcagggcccagtggctcatgctagtaatcccagcactttgggaggccaaggagggcggattacgaggtcaggagttcgagaccagtctggccaacacagtgaaaccccatctctactaaaaatacgaaaattagctggtcatggtagtgggcacctgtaatcccagctactcgggaggctgaggaaggagaattgcttgaacccaggagcggaggttgcagtgagcggagaatgcgccactgcactccaggctgggcaacagagcaagcttccatctcaaaaaaaaaaaaaaaaagaaagaaagaaattatatggatgaggtagatggaggacgggggatggaattcctggcataggggatagcataactgaaatcaaaaaggttgaaacaaagcaaaacaaaaaaacaaacttacattgtgtgttgggcagtttggtacagtaaagagataatataaaaatcaaggagatggcactggagaggtgaactaggagaagatcatggcagtcttagtatcacaccaagaactttgactttgttctacaggtcagaaaatctcaaatatttctgatcatgacccacagaaaaaaatatattttacttggtgacaaatacttttttaagcatgtattttacttctatataataaaagtttatatatctttattatacatgttatttataatacgtcatattatagataatatcacacacacacacacacacacacatatgtacactcaaactggttgagcaccctaaatccaaaaatttgaagtttgaaatgctccaaaatccaaaattttttgaacaccagaatgatgctcaaggaaatactcattagaacattttgttttgttttgttttgttttgttttttttgagacagtctcactctattgcccagtctggagtgcagtggcacgatctcagctcactgcaacctccgcctcctggattcaagcaattctcctacctcagcatcctgagtagctgggactacaggtgtgcaccaccacatccagataattttttgcagttttactagagacagggtttcacgatgttgaccatgctggtctcatactcctgtcctcaagtgattcgcccaccttggcctcccaaaattctgggattacaggagtaagacacgatgcacagccatcattagagctgggctctaatcatcattcatattttatattttcatatttgggatgctcaaatagtgcaaatattccacaaacaaaaaaaccctgaaatctgaaacacttccggttcaagcattttggataagggacattgagtctctctctgtctgtcgtgtgtgtgtgtgtgtgtgtgtgtgtgtgtgtgtgtgtatgcatctgtatagttggcccttgaacaatgtgggggttggggtacccatacactctcagttgaaaatctgtgcataacttttggcacccccaaattttaacaaccagtagcctactgttgaccagaagccttactaataacaataagcagttgataacacatattttgtgtgttatatgtagtatatactgcattcttacaataaagtaagctagacaaaagaaaatgttatttagaaaatcataaagaaaatacattgacttcattaggtggaaattaatcatcataacagtttcatccttgtcaacttcacattcagtaggctgaggaagagaaggaagaggaggggctgatcttgctgtctcatgggtggcagaggcagaagaaactctatgtataagtggacctgtacagttcaatcctgtattgttcaagactcaagtgtgtgtgtgtgtgtgtttgtgtgtgtaagagagagcattttatatatatatatatttgcaattgaatgaaaattttcaagaaaattaatgaatcttactattcaaatattcatattttctattctatttcatatcagttctagactatttaggaaatgagtaggcctctcaattcatttttaggccccattaatgagctataatactgtttaaataacactgttatgggtgttggaaatatatgcgctatcatcaaaggattttgattacaggagacatagtttagagtgttacttcaactgggtcactctgatagcagtcattagctgtctgaagatgattttgagtcatttgccaagctcaggcaaaagagaaaaggggagacaaaatcaagtctacttagatgccacaaaaaataaattgaataacttagagtctccactaaaattataattctttattagaagaatgttaaagaaatgatccgaggaccactattcttgaatatccttaaaagtgcaatacaaagccagttagattagcagggttactgacatacccgcctgaaggaaaggaaacaaacaggcgaccactggtgccctccagctctagatttatttccctggtcactgactatctgaaaactaattttggttgcctgagaataaaaagtcaaaagtacatgagattgctctgaagaggagtctacagaaatgtattagaaacagatgaatagtcatgaccctctttactcaatccactcttacacaaatgtctatgcaactacagaagagaattcagtacctatttatcaataaaagaatatgagaatgtttctgcaggctcctaaaaaaaacctttcctatgaacagaagataatggggttattatagacaaggcaacagcgccttctgaaatattgcaaactaattaagaataattattaataacatttttggtggtattgtcttatgcttgactaatttgtaaatattctggtatatttgaactttcactattttagcctgtaccctattttttagcacagattttaattagaaaaatagaagtaataacaagggaaatcacatgttaactaatgaactgagcctaacaacaaaaaagacacagggaggcccttgaaggactctctagcttgatgttcttcttggaatctagggcagggcaaaagtcctaacatcactctatggacaacagagatgaaccacatgagccaggtgctagaactgtgatatttatctctgtttccctgtgtgtaccaccaccccacaactccaaaaaagaaaaaaattataaacacatccactaaaattggcaattctagagaaactggatggcctgttaacatctggctttcccaaaactcaatttttctgtaactcattcattttttagcctttgattctgaagaaattacttgcctcctggccagccacagaggctgacgcctgcaatcccagcactttatggggcaaggcaggtggataacctgaggtcaggagttcgagaccagcctaataaatatagtgaaaccccgtctctactaaaaatacaaaaattagccaggcgtggtagtgggcgcctgtagtcccagccacttgggaggctgagacaggagaattgcttgaacttgggaggtggaggttacagtgagctgagattgtgccactgcactccagcctgggcaacagagggagactccgtctcaaaaaaataaataaataaaaataaatgaaattacttgcctccttccaggcttgctatagataaataaacatatacgcgcaatctatatttctccattacactgcaatcatttccttgtcactagaattgtatcttgtagtccaagaggtaagtaatcggaactgtcaggacaaactcttgggactgtaaatgtgctatctggagcataactatcctaagaataaaatccaaaagcaaaaactcatcagaaaagatttgaaactcatttcagacaagatgcagactataaacaaataaatacacaatatgaaagcaacttaagtctcatgatggaaagattttgatccaactgattattattgttcctagttcaaaatattttaggccttatcaatggcaatgcataacaggaatgactaaggttagcttttcagtgaatcatcagagtagtgattaaactgatgacatacaagactcctaactggattttgaagattgagtacagtatccaaaactagcactggaacaagacaacaacgttcattcagcccacaagaaaaccagtttaaaactctgaaacaatgacaccatgagtatatttgtgataattatttgccatgccaattatattaaatcatgaggaggtagtacacatctacatgcataacgagcccatttttatgttagcatatctccaaggactttcctgctgtgtattttatactgctactgccttatattttatgttagcattaatgttttaattttcatatacatatccttaggccattttacgaagggcgtggctttaaaaattcagttgatatattaaattaatgttaaaaaaaggtcatgtaacaagtagtcctaaatcagttctttgtgttccctctgtacattcaaaccttctaatatggtttatttattatgggtaatacagaagtaagatctgggctctaaactctgaccatctgtcaggttaacatgcatatgcactaagtgtctttcttcagatgatggatcctaccacaagtcctccctaaaacaatatatcaatccccttccccacaaaaataaaaaaaattgatttatatcaaaataaatacataaaatagagcttctctctaaattggccttctgattagaatactacttcatcacctcagaaaacctgtcttaatattatacaggtagaataatttaccaaggtgtaaagaattttttaaaaaatacaaaaaagagacaaaatagtgtagtgattaggaataaaagttctagaacaagacgatctctatcagacccagttcggccattgactgtcttgtgagtctggtccagttatttcaccttttagagctttagttttctcaattcaaataagagtattcaccacaaggtttatttaaaaaaataaaagatccatgtaaagcatttgtatcaaattcaacatatttattaatattactattgttactaatacacagatgacttcaaaagctgctattaaaaaccaagtaaggatgtgggtggcatgctgtattttagattcagattcaacagccactatactagttacattcatatgacattcatatcacattaacgtcatagcacagcacagcaattaagaataagggtctgtctggttttaaaccttagttctatcacttattagctgtatttaattcagtaatcttcttaacagttctataaaacagataatagtattacataccttataatgttgttggaaggattaaataaattactatatgtcaagctcttagaaaaaaaaatttgctgttgtaattatggattttatttcagaacggaaaatgtccaaatatttaaaaagccagaagaacaacagaaccagtcttgtagtcactgaagtaatgataatttaaaaaatcataataataaccattaaaacagtaacatgctatacttagctcaagcgtagcatgctatcatttgcctacaatttcactatattacccacatgacctctcaacaagcctgtaatgtgggtaggctatagattattgccttcaaattatatttcatgaacttgaggttcagaaatcagtgacttgctaagccacataatagtaggtgttcgagccagtgctagcatctaagcatgggcctcatgatccaatgccctttccacttcactccttcacaatggccgaagaaccaaattcaaggcaaggccatccaacaggccatcctgataagaacccctcctgaaataagacaacacggtcacacaaatcaagtgcacatgctttctaactcaatggttataaagaagttataggtaacaactgatacatctgcacaaaccataaggccattaacacaaagatgcattttaaagctaaccagttccagcagattatattcatgtaaagagaatttggttttcctttccttctgacacttcattttccctttgtctcccaaatctgttaataactatttttaggcagatggagcatttcatgaatgggtcactcttaaaaatctcatttggtttccaatttttcttcaagcattaagacttactacttttagattttttggttattatacacaaaagaatatatgtggatagaatatacacacatttatgcaaatatatatatatatatagcatgcatatatatgcacatgcatgtctatctatacatatacatttacaacaaagaaaaactgcttaattttatgtataagagattcagagaactagaccaggtaacactcagaatatacacattattaaggagaaagcaaaaaataaaagagaaatcagtaaacacacaaatcttcccattgacaaggttccctttctgagcttcctttcactttacttctgattttcttctcatattatgtgcttcaggtaattctgcacattttcttctcctgaagagaagccatcaccagaagaaaaagccatgaggtctttttagagagaagaaattcacaaatactgttaggcagggaggcagtcaacaagcacttactgaatccctagccccctaagcactgtactaggtgcttagaactgagtccctcctgctattcagttagaaggatggaaaagctatgacttctagtattagcactgacctagttaagccatgaataaagaattaaaaggttttcatcttccaccatacaagttaagaaaacaaaaccagaaaccttgatatatgtttttcagcccaatgcattatggtttcacatatgtttcagctcttattgaaattttttagctcaatttcttttggtctagaaagttaaaaaatgtccaagtcaacaactcagtaagaaatttagaaagtttccaaacaactcagttttggaaactttttagttcagcatttcccaaactctttgctattgacattttaggctagaaaattctttcttggaaggagcaggggcctttcctgtgaattttagagtgtttaatggcatgcctggcctcgactcattagatgcctgttatcacctctccaaccgagtggtgacaaccaaaaatgtcttcagacattgtcaaatataccctgggagcaacataattcctgagtgaaaactatctaggccaaaacttcacctaacacataactctattagatggatagcatgaaaggatggcatataaaggtctggaaatagaatgacattaaacttaaaataatcagcctttttcctaaaggtatttttattcaccttgtacataacattgagaaaacatcacttgtccaatatcaaaaattggggaccttaaagcaatacacccctggtcttcccaaatcactgctctggcttgctttagtttgtaacattaaggctctgtttcctagaaagtccagagctaagacatacaggttgctttcagttcttcagaggcaaggaaactaagaaaggtggtaatcataagaacaccacacataaaaagaaagggaagagtaaaccgagtttctgttcttaaaagaaacagtgggaaaaaagagaagacatacattatcatttcaaagcaatttatcttaacaataattgggcaaaagacattgtttttagttgtgttcttgcagaagtaatgtcaaatttacttgaaagttagagttttagaaaattttagatgcagggagtacatgtgcttgttacatggatattacttgtgtaatagcggggattgggtttcttgtgcacccatcacccaaatgttgaacattatacccaataggtaatttttcaactctcattcccctcccaccatcctcccttttggagtttccagtgtctgtcatctccagaaaatcagataacttaaaaggtttcatgcacgttaaatagttaatagttgttttattacaccaaaggaaaaatgaaaaactgtttttcccaaaacagcataaatgtttattttctgtatgtttactttgctgtcccatttctataatatagaaaagtatattatttgaatagctaaatgtatttatcataaatatattacttttatataaatatagtaaatatatcttttactttgggatgtaaacagagctaaaatattatattctcaaaagccccaaaatagtccttaaaaatcattgaattaatgtggttatttaatcttgctcagcaatttgatgcaaacgcctaaatacaaaaagtggtttagtaggtactacaaaggaaggaagaaggaaggaaaagacttaatactctagaatgtttcctgaaaatcagaaaacaagtagcattcaattgtagctaaactaactaactaactctctctctctctctctctctctctctctctctctcctcctctccctccctccctccctctctgtcacacacaaaaacacacaccacaaccctgattaaatacctgttggaagaaaggaaggaagcatatgaggcagcatggaagagagaaagagagtgacaacctcaagagacatcattgacttgagttctagtcctatgatggatttcagaaagtggtcataatctctttaggcctcagtttctcatatgtaaaatttgagggtttactagaagatacatgtattctcttcaatttaaacagtccctgattcatagtgtgtttcagattagggtagtaggaggaagattctgagtttcagaatctaagaaaaattaaatgatctaagttacattctaaaatcgatatgagctgcaattctgagaacaacttggccagctagcccgaatatttttggcaatgccagcaacagattggctggatggcactgcacaagagaatctttttaacacagtctgctcaatctggtctatccaatgttctgcttgggataactttaaatttgggttgacttagaacttgtccttggtatctcactggctgttaagaggacagtccatgataaatgtcttcttcattaaaagtcaattcttgccaactttttcatgctactttttttctacaataccacatataatttgagacatactgcccacaaaacagaacctacagaaggttggaaacaatattctattctctctttcagagacatgtaacattaaacagggttcaaagggaatgcattagaagtttacagaggaatttggattacaaatggttcacaggaacagtaagtacttttttttggcttaccagctagaagtgggacataaggtaaacaagctatgagtagatttctatagaggtaaaacacctcatgttacatatcaccacacccctgctgtataatacataccataaagtattattacaagatttaaatatttacatcaaggtttgccaatgaaaagagctttgagaaccatgttagcttgtagctgccaaagacacaagtaacagcagtagttgaaatcaggcagtagtctggggaaaatggggaatccaagaacaaagccatgtatgaatttctccctgtcttccatttcaaagtgctctttgtaaagagaaatacctaacaatgcttgagaacagtttatatttataattgtaataaaaaagaaaatactgaagactgtatttttaggtgtcttagttcaaaggagcaaaacactttgtcatcctaatcagaaaagacatttaagataacaactggagaaaagtagctttagaaataagtaggaaacatgtcctaagatattttaataatgtcaagcagctatttgcacaaaaatatggagctgctccacatttcactacatcttccagggagacggtagtagatatgagtaggtaaacatccctaacctgtctagtcacatcagcatattagccacagagaaacaagatacataaattctgggaccacctaaagtgatttgttgatcagctctgtgcataattactgcttttgtttaattacttttaattacctgtttttcttttgtccttatgccctgaggtgagtttttcatcagtaatgggcatgattttatgaatatcacatgcaaacaagcaaattagacccactgaacttgggaaaccatttttccccatcccttctctaaaggttagctgctattttctgaaaatgatattgattctatggtaacatgcacaaaggcactaatcaggagaacaggagcttttgtgaattcagtaaagcttataaaatacctcattataacatgctaccaatctatgaccccaataatagcagtcccaaaattataaataaattagatgtttaaattgttacccttttttatactacatagtgtaacacacattataatttccagaagagctcttaaagaaaaaaaatgtggagaatgaaaattgaaaagcagcagctgcttaggagtgcttaacctagagctagacgtccaggcagatcgaaactgcctgctgctcctccttcccttttcctatactgcctacaaataatcggtttgatttttcataccacgattttgattaagcactgtgtcattatttctgggtaataaacagtttttattattttcagtttaaagcaattattgccaaaaggaatttttaattttaatattaatttatttagagacaggctctcactctgttgtccaggctggctggagtgcagtggttcaatcagacctcactgtagccttgaactcctgggctcaagcaatcctcctgcctcagcctcctgagtagctaagaatacagggcggtgcccccacatctggctaatttaaaaaaaaaaatttgtagagacacggtcttgctgtgctgcccaggctggtcttgaactcctgacttcaaggaattctcctgcctcagcctcccaaagttctgggattacaggggtgagccactgtgccaggctcaatttttgtttttaatgataatagctaattctgatgagaatccttgaagcaaaactctcacaccttgctagtgttccagcatgtataatcccctgttatagcctgaatgtgtcccccagaatatgtgtgttggatacttaatccccagtgtaacagtgttgggagatggtgtctaatgggaggtgtttagataatgagagctctaccctcaaaaatggattaacactgcaatataaagagctttggggagaagggttctgcccctctgctcttctgccttatgaggaaaaggattccttccctctgggggatacagcactcgaggccccatcctaaagcagagaccaaacccttaccatcagacaccagatgctggagctttggtcttgaacttcccagcctctagacccatgaggaaaataattctattctttataaactacctggttttaggtattctgttatagcagcaaaaatggactagagacatctccttttaaaagtcttgcatgcactgataattgttgatgtggtaaattgaattaaataaaagaatctaaaatgactgtcttaatttttttaaaaacagttttccattgacaggtgttcaaaacagcattatttttaacttttgggtttgtgtagtaaattaattaggggttttcttttatatttgtgttttccaatttttctttaaggaggatttagtatttataattacaataatttttagaaaaacattctcatttaaccatgaaaagagttttaaggtattcacaataacgtattagagctcagtagctttaacacatttctttctacaggtacatgacataagtgcatgatgatatttactaaaggatagaaagagaagtcttaactatcttgaaaacatgaaacaatttaatggtgagtttaaaaaaaacctatgtattgcaattaattgacaaataaaatattgagacatgggctttaggttcctctgaggcaaaaaaaaaataccctgtttattaattttttgtccccttctccttgctgttgtagaatatatgaacatggtcttataataggttcagaaccatggatagcagatccatgcttttaggtagatgcggcattatcttaagagacaaagtatctgctgatcttcagtctgctttgtagtggcctcgttatgagggcaaatcagttaccttctctgggcctcctttgcctcactggtaaagcaattcattgccttgcctttccaataggggaaaattagactaaataaattttggccatttacagctgaggactaggacttttttttaatcgttctgatacacaaataaatatgctctgacattattccacggatgagttttactttttttgtttacttgaatgagaataatggataagaaaaacattttcaataaggttaatttatcaatatatctacttccctattgtcttcagtccatagttctagtaatgagcgcaccacaaaattgataattccatcagattatcatggaaaacgagcattgttgtatgaacgtttttgtgactactgcaaaggtcaggaacaggtctgctttgaaaacttcagataaagatagtttttaaaaagttccttaacacacagtcctaggagtacgctattaatttttcaacttaaaaaactaaggtttccatatcttttttggtagcttcaagggaaaggaaaaaaaaaatgccttcacattcctaattattttgaaatatttttcattggttactacttcttaaaaattcattatccttttttttttttttacttttagattttatcaaaaccatatagctatttcctctctgattgacaaataaagccactatcggtttggcacaaaatctagaatatggtagactctcaataaatgttagatcctctttttcttctctcctattctttcctatttctataaggtacatttcataagattttacatgtggcattcatcttctagatcaaaaaatgtatcatttaatggaaaagaataaagtttaaaatcctagattagtgtctgcgggtgttggtaaagctgaatggctcccacgttttggataatctcattcaatttttcttccatatttttccttgaatttgccactttctttctttcaaaagccaaggctctcaatatgtttggattctctgttaagttatgctgtttattcaatggaggcatgaattcaaatttgtccacataaatttgacctcctaatgctacacgttgttattggatttctgttgtttctcttttaagtggccctggttgtcttaaaacctgctcattccttcttcgagctgtcgccatcctctacaatgctggaaattcacaatcatgaatattatacagggagatacaataaaaatctatgtctttataatagagtcaacaggtataaaaagaaagttatttcaaataaaaagtttaatattctacatttcataattattgggaagctttgagagtcgatcccaggaatgctcttatcacattattcattgtggagaaaaagttcagtaaagtaaatatagtaattagagctcatgcaagaccatcagatggtaaaatatctaaattatctcactagaaggctgtttatagcaagggaaactaaaatatcattctaacaatgtatacataccatagagagaatgatattgagtctaaacctccaattaagtataggcattaaggatgcacatcattagaaatatgctgtgacttttgtttcagccaattatagaaggaagttagagctaagaatttcttgaaaggtgattttagatgtgagtgaagaggaaaagacaggaaataaagctatcatttattttttgtcttaggacaacactgaatatttgtcagaagcatctgctccttaaataacacaattgaataaaaattggcatctgaggtttgaaagttaatttcaaaggtttattataccacagggttcatatttagcagctgtcaatttgttatcgacaagtgtaataaaattcagcaaaacttgaaatcttcccttgccaaagagacagctgtttctgaatgttggagatttggggagtttttttttaaaccaacctctatttgaaaaagaccttacttttatttatcaaaaaagtcatttgatgataaaatattgatattctttaactgtgtttgtaaaaaaaatatatatttttaaatgtgggattttgttgttcttgctgattcaatatttgtagacagtgtttcaacctgggtaatgtggaccctccatgggatatctggcaatatctaaaagtgtttctgtttgtcacaactagatactattggcatctagtgtgcaaagaccagggatgctgctaaacattcaataaaatgcaggacagctcccacaacaaaggattatttggctcaacatgtaaattgtaacaaccttgagaaaatttgttttaaggaaactgatacaatggatttagattaaagattagtttgcatttacagactttctaaaccatggttttcacctggtggggagctgcaggcaggcaccggttgtgctttaagtaagtgttatttgaacaacagagtaaaactccttagctcgaaattatagcaagtacattcgcactgatgtaattaagtttgtgtcagttacactgaatatatttctatgtacaacattttgtaactgtgctataaaaataaatctgtaaaaagttcgacaggaagtttctttaggtagtaattgttttctacagatgcattagctaatattctacacagactccataattcatattaaacaaaaaacttgaatattgttttagtcctaccttttaccccattattttctcaacttgacaatactaataagcaaatctatattttcaaacaatatctctagatcacacattccttaaataattattttaagtatgctacataaccaaaacagacattttcagggccgaaataaggaccagggatccacattttgttgaatgtctactcagtcattgagaaaagtactttttatttaatatcaatttacttcaataaaaatgtcacctaacatgtaaaaatacttaaagagagagtactatttaacccatgaaaaataaaagaacagaatgagacagctgcaaaatcaaatgtatttaggtgttttagctaaaagtatacattattccaataaaattaccttttgcaaataatattactaagaagaaatttaaagaaaacatactccactatcataatggtgattttcatttaaattagaaacacatttcaaaattcatgaccttggaaactctcatttcatttgagcctccagagtagtgtgctgtctctctctgtctctctgtctctctcaatcttttaatttaacaaatacttatatagcatttacaatatacttgataattgtagaaatattttacaagtattaactcctgatgaccctataatgtaggcacacatattatcgacattttgctaacagtggaaccgagtcatgcagggattaagtaattggccaaggtcccatagctagtaagtgacagaggtaggatttgaattaaggaagtctggttccaaaagccttcctctttagcgccacgtaggtggcctcccctcttcattacatagtattacaccttttatttatctcaaacttgcccaggtagtgtgaccttggaggagacatatgtgaaaggtttcaagtcaagtcaaagcctgtgggaaagtgatggggagaatgagagaaactgaatgatctcaccagctaatccatccatggagatgctttgttcagaaatctcttagaattagaagtacaaacatagttagatctgagttgaatgcatctgatctataacttccatttgtttatggcacacattttatatcactgacaatttcttttttctctacaaggagaggcagtatagaatggtgtttaagagcacaaactcaggagttaaatctcctgggttccgtttccagatttaacttgctattaccatatttgtattgtatctcttgaatggtgaacagagaaaatatgatgtagtcaagaagttctctccttcctgagcacactgtcagattacacttccccacttcttcctaagtggggccatgtcattagttttcaccaataatgtaagagtagaaataaatgcatgatacctgaagcctcagatgcattgagagccagtgtactttgtctttgctcttgttcctgccttgtctagcatctggatgcagaagatctggatgcagtgaaagactcaaaggcctaaatgatggtggagtcacaatatgggaggagtctgcatccttgaatcatcacagggattaaagcctccaccctgatactgaactatatttgactgtacaataaacatttataataactcactgaaattttgcattatttcttacaacaactagcttttattatactactatgactgcacatcattcatgtgagcaaaatggtcactcttttaaacttcaaattaccttggtttaaaatagttttactcagtgtgtgttcctcttcaaaagagctttgataagcctcattacctataaatatttttctgtatagttccaaatgttaaaataacttagtagagatgcagatatttatagcagttaaatactgatttataaaaccacacaatactagtacaattgatggaaaaactcataaactaagtaaaatatattgaaactatctgccagaaaacctgcattttccatgatttgaatgggccacttcaatgaacagaacaaataaaatggctcttgtggccataactctcacaaagaaaattatttctgataacaataccatccttttctgtaaatgtatactacgctcaactaacaagggaatctttactttgctacatcattaccaaattggtaaataaatctaagtcttcatgtcaacatttcaagaagggctccctaaagcttgtaaattgtcaaagatatcagattttaaaggatatgaacctcttaaaaagtacttggatgaaatgttatgttcagaatctcaaatatgaattcattgtgttcttgtcagaagttacatcatcagggtcctgagctggtgctggttcagtcccaaggaaaagaggaaacttgtgtattactcagccctggcagatgagtagattcttctataaccttttcatcaccaaatgtctcaacgaatttaaaaactaaagattatttcttgatttggccaggttccttgtaatcttgacagtaagaagctcagaaaaatttcctttgctgtgcatcatgtatgctttactcaaaggccgaaaagacatagaatgcttcttctgaactttcatttaaccagcggaatttgtgagggtataatattcatatattttattgaggagatataagcaatatctcttaacatgtagtttttaattgactattaagatacacaatcttttaaaaatttcaaaatgactcaacccaaattatttagaatatgatttatttcaaaacatttttaaaattccttccttccacaattgtttattttgtctatccagttttgtaataaatgctatatatataaagatggttcctggcattaaacaacatctgcaaaacagtgagcaagaacaagatatttctagaggtaagtaaggtccactaaaacaacataaaatcatagttaataacatcataaagtcaatggctgattctatgttttaaaatcagacaaacaaaccaataaagatcacacctaaaacatgtgcaactgtatagcataaaggagttcagaatgagactcaaccaaattattgcgatcatgaatattacacatcctgagaaacaggaactgtcatagcagtcttgaccacatgttcacatactcaagttggataaaaggaaaagtccaaaatcttggcacaccaaggtaaaaaggtggatatatatttaattaacatttaaaacaaattttcccatttctccacaaagagctcattttttaaatcttaaggtttagtgaagaagagatttcaagcccactgcaaaatgaataacattcttttattatgctgttgatctccaaatatgcaaatgcctttttctttaaaaaaaatagtggtagtttgaaatcaggtagcatgatgcctccagctttgttctttttgtttagggttgtcttggctataaggagctcttttttggatccatataaaatttaaagcagagtttttttctaattctgtgaagaaagtcaatggtagcttcatggggatggcattgaatctatacattaccttgggcagtatggccattttcgcaatattgattcttcttatccatgagcatggttccatttgtgtcctctcttatttccttgagcagtggtttgtagttttccttgaagaggtccttcacatcccttgtaagttggattcctaggtattttattctctttgtggcaattgtgaatgggagttcactcatgatttggcactttgtttgtctattgctggtgtattagaatgcttgtgatttttgcacattgattttgtatcctgagactttgctgaagttgcttattaaggagattttgagctgagatgatggggttttctaaatatacaaacatgtcatctgcaaacagagaaaatttgacttcctctcttcctatttgaataccctatgtttctttctcttgcctgactgccctggccagaagttccaacactatattgaataagagtacaaggctacagtaacaaaaccagcttgatactgataccaaaacagatatatagaccaatggaacagaatggaggcctcagaaataacaccgcacatctacaaccatttgatctttgacaaacctgacaaaaacaagcaacggggaaaggattccctatttagtaaatggtgttgggaaaactggctagccatatgcagaaaactgaaactggatcccttccttataccttatacaaaaattaactcaagatggattaaagactgaaatgtaagacctaaaaccataaaaaccctacaagaaaacctaggcaacaccattcaggacataagcatgggcaaaaacttcataactaaaacactaaaagcaatggcaacaaatgccaaaattgacaaatgggatctaattaaactaaacagcttctgcatagcaaaataaactatcattagagtgaataggtaacctacagaatgggagaaaatttttgcaagctatccagctgacaaatagctaatatccagaatctacaaggaacttaaacaaatttacaagaaaaaaaaaacatcaaaaagtggatgaagaatatgaacagacacttctcaaaagaaggtatttatgtggccaacaaacatattttaaaaagctcatcatcactggtcattagaaaaatgcaaatcaacaccacaatgagataccatctcatgccagtcagaacagagatcattgaaaagtcagcaaacaacagatgctggagaggatgtggagaaataggatcgctcttaaactgtttttgggagtgtaaattagttcaaccattgtggaagacagtgtggcgattcctcaaggatctagagccagaaatatcatttgacccagcaatcccattactgggtatatacccaaaggattataaatcattctactataaagacacatgcacacgtatgtttattgcagcactgttcacaatagcaaagacttggaaccaacccaaatgatcatcaatgatagagtggataaagaaaatgtggcacatatacacaatggaatactatgaagtcataaaaagaattacttcatgtcctttccagggacatggatggagctggaaaccatcattctcaggaaactaacacagggacagaaaaccaaacactccgtgttctcactcataagtgggagttgaacaatgagaacacatggacacagggaggggaatatcacacacctgagcctgctgggggttggggggtaggggagggatagcattaggaaaaatacctaatgtagatgacaggttaatgggtgcagcaaaccaccatggcacacgtatacttatgtaacaaacctgcatgttctgcacatgtatccaagaacttaaagtataataattaaaaaagtggtaaaataaaatgaaaatcaaagtatttcttagctagtatatttcatattatgtgtaaggccatagcaaaataaatcagtatatcttggtggcaaatgatcaattgacaaagccttctagaatgagtcatctcaaaactggtaagaaggaagtcactcagtataagcagaaagggaatatggatttgacagagtattcaaactacaccgaagcttaaacaccactttactgttcattttatatacaatagatctgaactctaagaggcctgcaatcatttaaagttattgaattagtttatcaatagattttaagcattaatttggttgagtctcattctgaactccttcatgctatacagtttgcacatggatgatactcagatgaagtattctgattgacttttctacatttcacaaatcaaactcaaacaatatacaatcatcttgaatgaagtggtatgagattagtagcaaaaggctgaaagaatcagaaatgagttctaatactatgtcattgataaacaatggacattttaacttcaggatactaattttgaaaatggagacactacattctgttcaactattgggactataaagaaactagagtaagatcatgaaaatggtaaatatcataagttattatctccaattatcacaggaaagtttgcaattaaataccattttccttaaaagagtaagaatatatttcaactatgaaaagtttttttctatatatgtatttttttcttaaagtggaggtacaattacactacataaattagttgagaatgccacaccaaatattgtatatgcttttctcagggatgcataaaagtttattcttgggtgtgttctaacttcaaagagaattttgtctgaaatatatgggacatttttacatctcaagcatataggcaatcatcataaaaaagttatttagtttctagtattaactaaggctttatttgatagcttaatgatctttaaaataaaaacaaaacattgccattttctgttgatttagcctctcttctatgaaagtctccaagccccattatcacaccttctaactttttttttcttttttttttttttttgagacagagtttcactcttgttgcctaggctggagtgcaatggcgtgatcttggctcatggcaacctccacctcccaagttcaagcgattctcctgcctcagccttctgagtagctgggattacaggcatgcgccaccatggccggctaattttgtatttttagtagagacggggttttttccatgttggtcaggctggtctcaaactcccgactgcaggtgatccacctgccttggcctcacaaagtgctgggattacaggcatgagccaccacacccggcctacacctcctaacattttaaagtgttaacacaattcttttatttacaaaccttttattttgaaatacagaatcacagaaagttgtgaaaatgtaccagaaattcttgtgtgtccttcactcagtttctttctttgagacggagtctcactctgtggcccaggctggagtgcactggcgtgatctcagctcactataacctccgcctcccaggttcaagcttttctcctacctcagcctcctaggtagctgggattacaggcacatgccatcatgctcagctaattgttttttgttttttttttttttagtagagacggggtttcactatgttggccaggctgatctctaactcctgacctcaaatgatccacctgcctcagcctcccaaagttttgggaacacaggtgtgagccaccatgaccggcaatttcttacaatgataatatcctgtctagctatagtacaatatctaaattaggaaattgactttggtctagagattattccgacttcactggttttatatgtactcatttgtgtgtttgtatagttataggtagttttatcatatgtgtagatatatgtggccaccaccacagttaaaatacagaactgattccatcatcataaggatccctcttgctacctctctttggcttacacaacccctctccccactccatccttgagacttgtcaaatcaataatctattctccatctctataattttgccatttcaagaatgtcttctaactggaatcatatttatgtaacttcttctgttggactttttcattcagcatagttcccctgagatccatctaagttgttgtgtgtatcaatagtttattcctttttattgttgcatagtattccatggcataccatgtaatatgttatacactgtgcataacacattttaatacatgtattaacttaatacagtgttattaactctggaaacaaatttttgtttgtgtttcttcaaacatacagcttctaaaactgaaaatattggctaggaagacatatctaaattataaagaaccaattgttcatatgctatataaaaatgtttggagtaagagggcatactttcataaagtttttttttaagtcctaaaaagaggattttatctaaaatagaatgcagcttctaagttctaaaaatattatatatcctattgagtagctcagtttgtagctggaagaattgtgcctgtatcccagaaggtcttataaataatttattcaatttcagtatttaatttaattcatttacaaatgagatgaggttagattattcagtgtaataagaaatctgttagagaaaatagtatttttcatagttgattattatagtatcattttctttaaagcatgaaatgcatcttttaaaatattgattagagactataatgtaactttgctgtaattacaatacttgtcttccagatacgtcctgaaaatagttggattaaacaaattagtgaacatccattcaataaaatactatgtagcaatttataatgatgataaagatatacaatttaatgacatggggatatattccttagatgttagtaatttgcatagcaggttacaaaatagtttacataatataattatatttttgtaaaatgatacctatatatccacacaggcatacaaatcggaagaatatatacttttttttggggggggcggtgggggacagagtcctgccctgtcacccaggctagagtgtagtggtgcaatctctgctcactgcaacctcctcctcccaggttcaaatgattcttgtgcctcagcctcctgagtagctgggattacagacatgcaccaccactcccggctaatttttttgtattttttagtagagacaaggtttcgccatgttggccagactggtctcaaaatcttggcctcaagtcatccgctcccatcggcaggctgggattagaggtgctgggattacaggcgtgagccacccgccccacaggaagaatacgtaataattgtgtagtaaaatacatatttttaaaggggcattctgggctactgttgtgtatattactctttaaaccctttaaaatagtcttgaactcaatctgacaagattactgttctcatgtaagaacaatattttccttttactacagggtcaatattcttgcacaatagtattgcattcctttacttattcagctgtacctaattagttaacaagttcactttaattattttcataaaaataattccatttttgatgatccttccatatcctcatcatcaataaaagcagcagtcacatagcactgattaaagaaattacttcaaaattaaaactacaaaaataaaggcttcaatatcatagtttctctaaatgtatcaaattcagctgttaaatatatttagagcctacgagtgttctggtattgtcccactcacatcttatgatttctttttcctttactttttaccaaacaaagctgctgtgttatcatttaggcatttataatttattcctgcttcttattttacaacaactttcagtgatatttataaactgtggcatattagtgattgatattatgtataaccttgggtagacttctggcagggcttctcttctgctctctctcctgtcactactggcagcatatacaaattgttaaattgccctgagtaaagctttattgtgccactaatatctaattttcttttgaattaaaaactacctttcatatattaagcatcaggattagtacttcaaagatacccattataaaatttctcaattaataagatactcatagaaaaatggggtcaattattggcataattatattcttttaatattttatatccattaccattctgtggtcacaaaactatctcaaggacatactgtcttttaatttggaaaaaaaaaagttgagcaatttgaaagtggttgtatgaactacttacagaaaacaaacgtgaatcctacactgttgataatgactattacactactattactccttacagtaacagctaatgcttgtgtagtagtaattaccatcaattaccatctatctgttatgtaatttaactccttttgtcttaactacaaccctatgagttaagtgacttgcccaccaatttactggcttaccctttggtcatcagataggggaactacaactcagacccaggtggtctggttctgattacataatggtaaaatggttattacagaaatttatctgaatatggactactttgtgactaatattcacttgaattttgtgtccccaatgcttccttcatattcaatcttacccgtgcctatactaatcatcaacagtttagcttgagagctgcagcagttgactagttttccaacagctaaacagaagattctggctatttatatgagcattctcttaatgctttactatattatgaactgaccctaagggctaaatattatttacaaatccaagaatacaaattcataaattctagctatttttatgccaacgtggactgccaatttgctttgaattatattaaaagttcaaaaactttaaagttctttacccccccgattccccaacttcaaaacgtattagctgttacaattcatacatggactagcattctaaagatgtgacagttccctttgaaagataatgtttggaagtctcaagacttgaattccagtgtcatctttgctctatgatgctggataagttacttaaactctctgggttttatttaattcctctggaaatttaaacataatttttatgagaatggacttttctaagatatttttacaagaatctaagatgaattagagattcacttaatgatgactgtctgaaggaacatgcatgaactggtctaatttaaagagatttctttgagtgatctgtcatttttctctcctctttgttcaaattaaagaacaacaacagataacgttaagtatttttatacttcctaaaaacaactttaactgacagagtgaaaggtataaaacttcaccctgtaataaatttgaggccatctttagacagaacaaaattaatacggccctgtagatgaaagatttacacagatcgattttctgtgcccattgacagagcaactggataatctgtggtagtcttttacacttgagcagttaaaacctcagatatatcctggactgaagattggtcagcagttcttttctggtccatgaataattaaaatcattcttattctgtattctataaatatgcagagaatgcaagatttgaaccatatacattccgctggagaagctgcttgggtccaagcgaacctcatcagcgatcacttcaaagatcaattcttcatgtccacagcatcatgtttaaatgattgtgtgtgatccagctgcttcttgtctccttgttgcttcatgcatgatctttactcatgatctcacaaactatagtgcttcagtagtaattctgcattttgtgctaaattttaacagtgattgccattttataggctaataggctgttgttgtgcatatttattataacacttttttcttttcctatcaataacagtgctttgcttagataatgagaagcaataatctctttaaaatatttacaagtctattcatcatgggaaaaaataatcttacaaagacagccttctccactggcattgcttttgattgtcactctcctccctcttcccaagacaggcatttccataattgcatcttatctttttgtatagactgagaaactggcaataactatgcctgggcaactgttttttgaggaaacacacaaatactacctgataatgtgattatatgcaatgatctaacttgctcttacttttaggactattaataatattaatgattttaaaatataatattatcatagtttcttattctgattgtagagtgagaagaaagaaatgtaaaggtagaatataataatagtaatattgtctgtacttaattccttggatggcctttcttttttggtttgttttattttttattttttaattttattttaagttctggggtacatgcacaggatgtgcaggtttgttacatatgtaaacgtgtgccatggtgatttgctgcacctatcaacctatcaactaggtattaggcccaacatgcataaactatttttcctgatggtctccctacccctgaccacccccacaggtctcagggtgtgttgttccactccctatgtccatctgctgtcattgttcagctcccacttataagtgcatgttcttagatatactctcttactaatctgtgtagggtagattcactccctgaagtcactcatggggttctaatttctatagctgagaaatgccttttagatgcccttgttctatcatacaaaaacactgttacttattagaattccagaaaagtttcctaaacaccatcaaaaattgtatggcaaagaacatgtttgtacctcatcaaattttatttatgttttgattatctaatgtgctagtcatgtttgtgactttccacacgaaatgatttcccatgttttctttctaccatgcaccatccttatcattaaggaacacaaatacatttaatatcaatgcaatcagtgtagaagtgaggcaatatgacacagtataaaacaggcagatatacagttatatatttatcaacatgtcccatagataacatatatctatattccttcaactaaaaagatttgtttaatattgccatttattatcccatatttctattttaaaatgttttgcagccataaaaacaaatgagatcatgtcttttgcaggaatatggatggagctagaggccatttttctcagcaaactaatgcaggaacagaaaaccaaatactgcatgttctcacttattagtgggagctaaatgatgagaacttacgaacacaaagaaggaaacaacagacactgagatctatttgagggtggagggtgggaggaaggagtggagaaaaaagacaactgtcgggtactgggcttaacagcttggtgattaaatgatctgtccaagaaacccccatggcttgagcttacctatgtaacaaatcttcacatgtacccccaaacctaaaataaaagtttaaaaatatatcaaatgttgggataatatggacagagtctcctagcaaactttttttcagaaaattatagtccactttttgatgacggtgatttcaaaggaaactatacttgagttcagctgccaaatctttgtttttttttagatgcataacagttcaagtaccattctctcttattttgtcacctgggaaagaggtcaaaagcacagtgggacactttacggggaacctgagagtctaagaaccattcttacatgccattagcatatcaattgatcatgaacatttaaatttggtagttttaggaacttagtttccttttcctaaaatgaagactttggattagtctctgaagcaactttctgctcgaaatgttgatgaatccgaatcaccttttcattcacttgaaatgtaatgacgtttttgatgtctacgttacagagattgaagtaacgcatctttccccttttacactattatattttgtgatgttttgctttaaaaagttttattttttattaatcttcaaatttcatatttttatccttgataacttccttctagagatgaggccagtgataagcagtatcttaattctcttctgtaagtattttttccttttgcatatgttctcccattcagtacagatatcaatttagctatttctttattccagacacaattctcctctgagattttcatcaataaataaagagacatgctaatatcacagctacttgacacctaccaaaaccctcattaactagtggactacaacataagagaatgaacatattttttaaaggccttattgcaagtcaagtcacaaagttaatacttccacatgtatttgccactcttttccttcaacagaaaaagaaattccagttggttgtaaagtcaaatctcttgtcttttcagtttaaccagctgcactctaagtctcaagacaactccctccttattctatgtttaattgactaccttccctatgccattatccatctgcatctttatgaacataatcaaacctccaacccttcagatcatctgtggggcattgctatcaccaaatagcaatttaatgctgagctttatctttcctggggattttataaagccttgaaagaataaagaatctagcagttggcacactcacttgcatgcaaacttagattgttaggaaaagaaaaaaacatttagataattaaataggatcatttaatagttcactcatttcataggatgagtgaggcaccaggggaaaagtggattgtttgagataacacagctagccatgatcccatgtaggagaataagactgctctaatatttcactctagcaccatccctattacatcacacaacttcccacacttccttcgtattttcccatgataaattataccttctgatttttccccaacctctcgaatgcccataatgtaactgaagaaatatagttccttaaaagtagctatggtttctaaaggcaactcaatgatttttaaaatacaatacaaattgttttttaagtgtttgttttgctttccagcttcaagcagaaccatcgatgtgacaaccgaagacaccaaagaagcagtcctttattattcaagatgtcattaaagtgcagggatcctaaaaccccattctagattatcccttagtatggatcaggctaaaatatttgcttcatgtgaggccctaggtcttgaatattgcatggtttcttgtactctgcaaatttcttctgaagaacccccttgggtgagtgactgttgtcagtatttatattaatgaacttttggagcacaggtatatctccaaagaggaaaggcctaattttgtccccagagctacaaaggtgtatggcatggctgacactccccagtagctgcccaaggatagcatggtggcagatgcattatcagaacaaaaagccaagagtgcccagagctgaggacctgatcaagtgaaacaatcagtcctctctgtgctactttgcaaatggttcatatacttttcaattagcacctgtcatctggatgcaccaattttcgcagaaatattttgaaaggacaattttatttcacgttagctggatgaaaataaaaccaaattccttctagtcagaaatatgtttggaaagattgaatccaaaggttcatatatccatcattggctccagatttcattataatgactgcaggtcaaggattcctgcaaagattttttaaaaaaatagtattttagaaatcatattttgaaaccaggtttgcttctgtttagttaactcccagagaaatatactgtttttggaactcccaaccccaccccaccaaaatataatttgcttttaagaatgtaaaaggattatggtttacacaagaaactaaaacaaatataagaagaaagtgcatgtatgccaaagtaatcgctctctctcttactcattctctctttcttatacacacacacacacacacacacacacacacatgcacactgacattaataagtcagtaatgagtatattagtgtctctatttaagttttctggtggaaaccaaactcttaatgctattttaatgaaggatttgtcagtgaattgtttccaagagtggtaagggagcatgcaatcacatttttataatgtttggcatcattttggggtgtaggaacaagcagattaactaactgaatgatacaaaatggtccactcctcttttcttaaaaagacacattgctccctgcaaggctgcatgaaatacaatttattctttttggacaatttcataaaacaaaagtggaaaattcatcctagaaaatcagatatatagaacactacaattttattactatttctggacaaattttcctaacatccttgcagccttctattatgattcacaatgtctgcaatgagagattagatgacagagtaacctattaaggaacagttactatgctgctggatgcagctaataattcctttatttttcatttttattactttatagtttatgaatgtacaatctactcattacctattataaatattttgattcagcaatggaaatatacaccagtaaacaaaacctacttgaagctttatgtattacatacccacccataaatgtatatcatagcatttgctgcctactagacttatttcttgagaatctagatgaactcttaatcttagctgtaataactacctgcaaacttagtatcatctctgctgctttcactgttttatctactgtctggagtcataattaattggcctcattactgtttctactatgaaatacagtcttctaagacattaatattttatcagagatactagtcttgacctaaaacagagaagaataaaaacataattgtgagttggaaatttttttaacaataacataaaataatcgatgttttggcaagaattatgacaaggctgcagatagcgacacacagctcactgagtgtaaatggagagaactaaacaggctctcattggtgtaacccttctaaaactctctagctaacattcatgccaaaacatccaatatatcaaagactttgtagcaatctggaataaaatcatttggtttcctctagactgtttctgcaagaagtaaatataacccagatacaatgaatgaaatgaaattttagtgcactgagttatggttttcaaaagtaagagcaactttagaacactaaatttaaagtcattcctaagaaccttctggaacctatgaaaattgtattaggttggcaaaaccttctctcgtcttcctatttctttttttcatttttcttgttctttttatcagtcaatactaaataagaatgtgctgcccaaaaagtgaagctataaatcgacttctgaaaagcttccctttttctccatgggtctctatttcattaggtcttcttttattttacttctgttgcccactgtttaatttctgaggccagtattttaatatcctttcaagtattgttttcaagatgtattgtgtagcagatcagtaaacaaatagttatttgcctcttactctatccaaggcaccgtactaaatgctatgcagaggtgaaaagtatgcttactgctatgcaataaattacaatctaatgaggagcataaaaaacacaataataataaaatagttcaagtgattttcaaccttggttgaacgacggaatcacacatagagttctaaaaagacttgacactaagaccttacctcaaaatccattaaactagaaactactgttgtcaatgtttaaaaactgaatgatagggacaatagtatggttaggatccagtggaagatgttctaaatgagtactcgttgtaaatagcacatcaagtgtccctcaagggcaaggatccagtggagctttaaatctacgtaacatgagggaaagtaatgcattagtactgttctaaagttattcatggaattctctcttctgatagcttattatcttctgagttcatagtagatattccatatctcaatgaactggttttattaggaaaagaaggtgtactggttatctgttgctgaataataaattaccacaaaactaaatggcttaaaacaaccatacacacgcattatcctcactgtttttaagagttagtaattcaggggtacttaactaagcagttcaagctcatggtctcatgtgattgtcaccaagtttctgaccctggctatagacagccaaaggcttgagtagggctggaacattagcttccaaggtagtgcacttacagagctagcatcacattgttcttagtccattggttttgtatttctccttttccttacctgtatttaaaagttttccttaagttctattttccccactgtgatacctaggactatcaagtctacttttattcaatacattgttactgagtatctctcctaatcaagacattatgccttctgtctttccaagcttgaatacatcacaagttaaagggggaaacacatttgttcacatgcagctactatgcctactgtactgttttaatttaccataatggacaccacaaacaaagggctacagcaaacgaaaggaggaatgattagttacacaggagtggtgtataggaagaattaaaaaagtaagctggggctgggcgcggtggctcacgcctgtaatcccgccacttttggaggcagaggcaggaggatcacaaggtcaggagatcgaggccaccctggctaacacggtgaaaccccgtctctactaaaaatacaaaaaattagccgggtgtggtgctgggcacctgtagtcccagctactcgggagactaaggcaggagaattgcttgaacatgggaggtggagcttgcagtgagctgagatcatgctactacattccagcctgggcaacagagtgagaatccatctcacaaaaacaaaacaaaacaaaaaaaaaggaggcaatggacttgagcagtaatgataaatttgagttttgagaggcaagaaaaggaactattgacttaagcctcttttctgggaccactggtactttgttatcctgcctgacacttatagcaaaattaacatatgtctaggctaaataaacatattaaggaggagatgatatatgaatataaagtatattaggggaggcagaccaaatagcttcaacatttatagtaaaacaaaatacaacatcattggtagcaagtgagagaggagggtttgaaaattcttaagatgtgaaaatgcatgaattttacttggaactgatccacatttttttttgtttagacttttaaaataactctatagcaacattcaataacttgggattgtactggaaaaagtaaacagtgaaagggacacagaccagaaaattaaaaatggctagatgtcaatgggagaagaaattgaaggtcccagagagggcagcctggaaaacggtaaaaaagatctcctgaagtctgagagggtataatgaatggcaaaactgtgaagagcctggagaatcaaggtcgtactgcaggtgaagagctagcaaacctattgccaggtcttctgataactgaattaaagtcataattcagttcttggggtcaaagattgaaaactcagtatctttttagcctgaagtcaaagaggaatagctattttcctcaagttttacaaagctaacaacagcaaggtacattggtctaactttttcttaacaacctagtgtaggaaacaaactctgaaaaaccaacagtcaaatgagctctacagtttgtgacatgggtctttacattcttgaatgtgtttctgttattgctgaaccttatttttgtacaagggtccatgtttgaagcatttgaaagatttgaaatgttggaattccatttttagctgacttttttatatactgagttttctaggcattactttggacaacaggttaatgcttgccttgctctctttggatgctgtctactccacacaggtataatcatacatacatttctatctagacatcatgaagattccacttctgattcacaagagctatcacaatgttgtacaagtccatattcttaggataaaaaggttaactctgtgtctcagctttgtgggcagaagaaaagagaagacatatgccctattatttgtgttatattacatgcattatattttcgaaatggcatttcaaagaaatagctacaaaatcaatagttcttttcttcttcatttttttcttagagctgaaaactgttcaacagctttatcgtattaaattaggctttcttaatcttaagcagtgactgggtgagttttcctggggaaaaacaattctgaattccacagtgtttaggaaataatacaatccaaatctgagagaaaaatttaacgccaatactgtgtaaatatttcacaaaatatttgttctcaaatattcaactttctatgtatacattatacagttttgactcaaagatcactaaaatgaacctaaaataaacccaccatggaatagtaacttccaataatcagtctttcgccttaagtgaataaggatcacaataacataaaatgcagaggctataaagtaaaaagcagcactcaaattgtagagctgggataatacaactaggtgaagttaaaatttgaaagaaataaatgggttggttttgagtgatggtactgcccatgattttttactttaaattttttgtcactattaacaaaaaataaagttatttgaaataaaaatataagaaataccgtgtgtgtgtgtgtgtgtgtgtgtgtgtgtgtatgtttgtatgtaagacatagaggaaaagacctaaaagatacaaaatgctaccttccaattcaactgtagctattggctctgtcagttttagccttccaagttgtttatttccatgagctcagacaaattataccactgactcatgtgctgctccctgggtgcagtgagaatattaacctttagaaggggccttaaaaatgagaagtgttatatgaattgatattttagttgtgtgttgtgtataaacttttctggatatggcttgccatttggttgggtgcttatttttggccactcaatgtgcataccaatgtgtgtgacttcatatatgggaataaatgttggcatttggattatttttggccaaagagtgggtgagaaattagacacactcaggagccaaaaataaccaaatggcaagccaattacataaatgttttctggcataccaaaaaaaatctggattagttatcataaaacaagagttttagttccagttattattactattactactactattacttctggtgttattcctactaaagccactaatctctattagacacttatgcttgttaaatttataaagtttaacatgaatcattccatttacaccaaacactaatcctatatatgaagtgaatatcagtactataaatacatggatatcagtcccacacaaagacaagaaaaattatgcttagaaaggttaagcatcttagtagagtcacacacaaataagtgacagagttgatgagaacccagacatactgaaattaagaatcagacaattcatctgcatggaaattctgctactaatatatcatgtggccttgagcactcatgaaaaactttgcattttagttttatcatctgaaaaatgaaaatgagtatatgtgctgtagaacatgagtgtaagtgctataaaagtagaaactgatggaatgtgtaaagtggatgattactgaaatattttccctttcctataaacctaatagatcatttattcttgcatctgagaaaaaaatactaatgatcaacagaagactacatgaaggcagtaactctaatattttcacggtattcttcaaagtttgaatatacattatagttcatttgaattctttcaagaatgccaagaaataggaccttcaaagtgcaacatacggaatatatgttataaaattctatgttgtataagtcacacagatgtggagaatggaagaaaactggacatcaagcagctaagcactttccacacaaaatcttgtacatgattgcttataatagcattactcatgattaccaaaaggtggaaataacccaaatatccatgaattgatgaatggataaataattgcagtatattcatacaatggaatattattcagtatttaaaataaatgaaatactgatacatgttacaacatggatgaaccttgaaaacactatacaaatgaaaaaagcctagtcacaaaagatcacgtattatattattctatttatatgacatgtccagaattagcaaaggaatatggagaaaaagtagtagttgtctagggcttgggagaaggagagagaagggatgtctttcagggggttccaaatttgattatggtgatggttgcacaactccgtgaatatactaaaaatcattaaattgtacacattgagtaaatcacattgtgtatgaattatatcctcataaaacaaatgaaaagttcaccaccacctcccaaagaaatactagaaaacttatttatttgcaaaattttcaactgcaaaaattatatgtgtgaattcattaaacacttatacagtacaataagttatacatgcatacacacaaatacacacacacacacacacacacacacacacacacaacaatttttttcctaactagacattttgaaaaccagttttaggacaggttgttgtaaacaaaagtattcacgaggtggtcagaccaatttgaaattatccaattggcattttcaccatgtctcatgcaaatgtatgtcagaagataataagatctcagaggacatttttttctttctagtcagctgcatctacccaggcttaatttcaatctattgctcctcattatatccctttggagagcctaattccattccccacttgatggccataccctctgtctaaacctgagcatcagtataccacatcctctgcagtaatcacacctcgggacagcacattaaaaattacctggaactcccaaggagctgacattatggaccctcaggttgacaatctgaaacaatgtctggaaggttttgttttgttttgttttcagctttgctctactattgaagtaatgtttgaaaacgtcatttgttaaaatgttaacaaagcaaagttatatataacatatatagtatatatttaattacatatgcaaatgtaatatatattttatttattatgaattacacaaacaatgtgtgtgtatatacacacacacacagaaatgggcagtacacacacacacacacacacacatacatatacacacacatacaaacccagtgaatccgaatctgagtactgcccattttaatatcatgtcataatattgaaattaatatactaagtgtacattaggttaaaaacagctgctcttctagcactcttcttcaagaaaaaatacatagaagaaattcataaaagtatgttagatgctaaaatctaaaattcagcagggacttaccgatggggtataaacaagattaatcaatacgatgtgctagatttcaggagaggtaagacacattcaccaaactatcttcacattttatctacctgatttaaaatacaaaatctttccatgttagaacaggtgtatgaatttactaagagtataagtagaaactgctattaaattgctgtggaaatacttttcatatttacctaccttgtcacaagatgaattttttaaaagaatacctctgtaactcacctcttgaataatcccttgtggtcacaatggaaaaaatatttttttattttgatacttactgatacatgttatgccttattatagtaacttaatatatacaattaagaaatatatatttatatatcttccccttaatcttcttaaaggaatttggtattattaatctactcttaccaataaggaaacagaaggttgcagatgttagataatttgcttatgattccgtagctactatgtgacggaacttgactttgaatcaaatattatacttcaaaggccatctatgttctttcaagcatagcagttgcctccacaaaagcattctgatcattgaagagtctaaactcaagaaacaaaatatgatcggctttagttcttctaataattgttctaatccatactattctgaatcagctatcatttgggaaagttctcttaatatcttggcccaaagtttacagctttttggccatttcaaatctcttccctgctattcagtaccacaagttagggcctttgttgtttccatgtagagtaggagggacacaagcctaggttggtatatggtttgaagacctgcttttcccctttcttctaggcccagcctcttcttagcccttgggtgaagaagaggagaaaaaggcaaaccttcccttcctggacttggtgagctgctgtgctccactagttagttgtggctggcttacagcctgcaacggttggcaggagaacccactgtctggtgtccaaatgatggtgttctgaaatgcactgctcatttccctccagtggaagactgaatttccactcaaccacttttgcaccttctcagccagtaactcacactaccagggtaccctcatccagtgggcagacctcttatgtactagcacaatgaactcatgcccagcaactttctgagatgtccaatgtatcaatgagagatacagacatcttcatctcacaaacagtgagtgtacaggttactgcaatgctgctacccttttgtcagccctttactgaccaagcaggtatcaaatgaaggaaatacagttccggtctccctcctctgaccattcttgcaaatctttgtaaatctttctcacagggtatccctttccagttttgaaaaggggatatagcttttcttccagcatatgacattcactaaaatgctatttgctccatttctcggattattttgatttagagaggaggtggtggtggagggtcttggctcctgtccatgagcctgcaggggctgtactccaccctgcttcccagaagctcttagaaaatgcaggtcctgaatatccactgtcctcagtttggggtctgagctaacattcagggacaacaagcaaaagctcatcccatttaattacacttgaaaataacacgagtcctttaagttgtagcccaaattttaaaaaatcaagctatctttcaaaacgtgctaacattcttgcgttaacacatttgatgttaaaacatttgggtcttgttcattgtctctttgaataagctttaatagatatttctcacacaaactacatataatatagagactgtatgtaatttccatttcatatttgcagcaaatgtgacattttcctttattgcacacctcttatttcttcattctcaactctttgaactctgaaagcccaagccttaagtcaaaaaagtatgagaatccatgtccacactttaaaaaggaccaagaacacaaggttgtgaactactctaaacactgaaagaacaatttaagtatttctatagccttcacccctggagtactccacttctttgataaagtgactatttttgcaaaaagtctagtgaagttcatgagtttcacttctctcaggttgagagaatgagttaacttggactctagcgttcattataaacactagagatttaatatatggccaaatgccagagagtctaattcaaggcattaacataaaataataacagttaccatttatgcaatacttgtggtgcactagcactatgctaggcccttcacaggcctagtttcaggattacagtctaactccatgacgtgggtagtattggagccttcattttacaaacgagaagactgaggttgaggaattaagtagcccaaaactgtaaaggtggaaataattggggccaaaattcaagtttatcagttcaaaatagtttttgaaaatctaccatatccatggcataggtacttaaataaaacaaacaaaattataccctttgagaatttctatttggttctgtcacaacacagtgcctacattcttacaactaaagtatgtatgtaaataagacatgtttcaataaaaacatggaaaacatttaacagatatctgatttattttcattaaacaaataatagatataacttggtgttttcaaattatttacacttgttgcaataaaaaataaaatgagaaatgtcatagatttaaatctcagttgtacttaaagcctctgcaataattcactttgtaaccactgtatatatttattaatgaagtattaaaaaataattgtgctatactatatatgtactgttctatgtattaacgataatgctgtattagtgatcttattaatgctgtttatctctcaactctctaacagtatattttccattcaaaaccaaaattataattacttgggtaaatattatcatttacaggcaaataataagaatttgaagaaaatcaaaacagaattggtccagtcaagcccaggcaatgagacccaatcacaaattcgtgcataaacttttgcctaaagaatagccttgttttgttttctccttgtatccaatcttaaaagtgttttaatgaagatttgaatattaagaattcattataaaaataacaactcatcatcgcactgtgtttggtttattcaaaaaactctaaagttattaatttcagcttcctaattagaataatccaattttaatctactggcatttttggagatgaatggattggtggtgcattattctaaaagttaaatctcattaatatttaattgcacccacattcacaggtattaattagaagtgttttatgagtcatagctattattggaaaatcaggtacaattttataattagcataaaatgaactgtaattttgaataatcactgatagtgatcatttagtagaccttgtgagattattaaacttgttgatccatataataatttatatgtagactgcatatcaccattatagtgatacttttgagacaattaaaaataacattccctttcagccaagcaggaacacatatttcattgttgttttgactatgaataaaaaccctttctgctgaatacattttaaagcagtagtagaaaatagataatgtactagttatgaaattgaataaagcacaatcaaaactataattttattgatatttatatattattatatgtttatatcaagatctttcaaataaaagatatatttagcttttaaaaaataaaattactttcacatacataagacttgcactttgctcaaacacacactatttaagtggtttaatcaagtctaaataatggatagttactagaaattcccaaacaacaaaatgacacagtgatatataagttaagttctattaaagagaaagcttttgaataatctctatccatttttctggctttcataataaaatgtggacataccaaactgacttgaaaaaaatttaaaagtggccactagattcaagggaaactttattttaggagaaaacttgttgagggaagttcctcttataccttatgtaagaaagcccaatataagaattaaccataggaactgctgaaaaacctccccttaaatgggtagatgggttcagtgaaaaacacacatgcacacatacatatacacatatacatatgttatatttatatcattttgatatcatgcttagagtatctgtatcctaaatttaatagaacattgaaaataagaatccaaaatagtacttaataatcaactatttcttcttaagatgaaaatattcatagtccctaaaagatgattaaattcctatatcaacagactattaatttgaattataaaccttgtaattttcatattaaatgataataagacaaatataatatgcctgtgatttccattataacagcaaaagaaatgtgacgattcaataatcaaatattttcatatatactggagtctataaagcatttcatataggtaaacttgaatgaaacctaatattatatactaaatactaaggaaatatcgtcataatgaaggttaaagtttagagataactaaaaacaacagtatagtatattctgtaggcaaatgtttaatgtatcaattatacatattacactcttggttataaatactaaatatctcttagtcaaccagactccatttgatgtgtaataattttgcctcatcaagaagaagacagggtaaaaaaagaacaggaaatacgtgttcttcgttcatttaatacatataattgacaatttcaggaatatgctgtaatgtactctacacaaatcttgcatttcctttggctcattcatgggagcaaatcaatatgaattcctaatacatcttaagagctacactagacagaaaatttttgcttattggcaaactaaatccactatatattcactattaaagtttcctgtccttaaaactgtcccctcaggatttaatttaaaagcatgggattcactgaatatgaagtatatttttccaaatttataattgaaaaacaaagtttgtgagtcatcttttttcagttttaaattctactaacttctttataaatgtcacagaaactctcagaagtagaaaatcaacaagataagcagtttcatggtagtgaaaaaaatatgctttgaatttgcaaaaaaaaaaaaaaaatgggtttgcctagaaaagatatcaacactttaattccacagattatttcacccattaagttagcattccctcttcacctatatggctaatattaaaggcctgtgtgtgaccctacaacttaagtcttgtaagagcatcgatttgagtctggttttttttttctctcttctatacacagcctccaggaaagtccccaaacttagaagtttttgataaataactgttaactgaataaatggcaaagtttgtcatttatatgtttatttaaatctgtagcctcaaaattggtaaaagaagttgaaggtggtttgggacattacagttcctttatctgagtgaacgaggcagaggaggagcattcttaggaaacaaataaaccaaaaatattactcaggtcagcttgaaagaaaaaccaagggaaaggaataagatgcctttgtcaatcacacacagcccctttaacctttcacagtttgcttgcattatatgaaacttcaaggttaaatgcaagacaaatgtgaactgatatttctgcaagggtcaggtaggtaccagttgcaagtcattatgattgcaaagtggttcttcatcatgagaatttccaaactgcaagaatatgcctgcaggctttagtatgggaaacactcattaaagtagtaataaaaatatcacctttgaaattgtttcccagtttctaattcccctaagatgtgttctgtctttataattgctcatagaaattaacattggtaccatggcagacaggagctggttgttgtctttgacattaggagggtgctgcacattctggagatcccaagagctttaatttgagaaacagtggtcaagtgaacgaggtgagataatatctttattcattcaacaaatataaaatgaacatttacaataagctaggcacggttttaggtgctggatatacagaagtgaaccagacagacataataagttcctcacttatacagtttgcattctaatgatactttaaatattgaatacattttatagaatgaaggaataaaagctatgtgactaaggatataagaaaagacaggaaagaaaaaattgggatgaatatattgtttgtaaaaacaatggcactatggattgtatgtgaacttcagcttgtgaatttctgctataattgattttcctatacaacataatagaatgataagactgtataatggatctggaagtttcgttagtccaggcagccctctgatgcttaatctttccacactctacacaaaggaacttgtaatactcatgacctcttgaggtagcccattccatttctaacccaccgaaatttttaggtatttctagtcaattaattatcatgcctcctcgagtcattagctagtggttcaaagaatcttgtttggactcctaaccaagaattctaatcacttttaatttctttgatgattttataatttaacttggtttcaacttttttcatcaacttcttgttcaactctgaaggtattccatttaaaaagtgtgacaagcagagcactccacaaaccccagcagagtcaccactgcagctaagaggaattcaccacatccatctttctaaatattaatgcatcctaaaattgattagttttacttggcaacttcgtaaaactattgacttacattaagtttatgctgattactaaattgtaacagtttatttagttgttgtttattttgtgctttacttaaatgtgtccctcagttttagagttgtcagtcttatgttcttggatttgatacttcattctagcttgggatactcatattagtcataactttgattttcagcttatctacatactgagtaacaatatcttcttttattttaattcaagatattggataattttcatcaggccagggcaaggataaagccctgtaggaagaactagcaatctcactctgtgatcacaattcctgaacatatccagtaattgtccctaaatgggaaagtctttagcatacgtctttctctttttcaagtagattgcataaaatatgtatcagcaaatctctaatgctaaatattttcggttccttctaatccaatcagcaactctatattccatactttcagcatttaatgagtaaattaccaaataatttgggtcatttttgtccaggtagagactgatgtcaacattagtatgactaatgtaagcaacagaaacaatattaattccagcaggcacagaaaaaaatctactgcctagttataaaacagaattttaagataattcaaatatagtctgtattctagctactttcaactcttaaatagagagcttgacttctgatttttctaaggagtttactgataatttctctctagatttcatgcagaagtcataacatatcctacattttattttttaagtgactataagataatgaaactgctttcttgtatgatttttggaaaccacatagctctgtattgcaccatgatgacttcaatgtttcaaagtacattcacatcctgtttcattcgatcttcagaataattctataaggtggataggaaagtattattatctcgactttataaactgatgcagggtaaaataaaatatgtagcatctctaggactcagctcactttaatatagctaggtccctgatttgcagccacattattacctgaattgtacatatcacagaaatgagacagatggcggcaaccctcacaaaattcattttagataatatgttatttatctaattaccttcctattcctctgagagttgaattattttatctgatacagacttcctttacgttttcttataatggcattaatgcccctttacattccacctccattctaatcctactcccattctcctgattaatgtgctcctgtctttcttgtattgcattaaaagaaaaaggttattataaggctctgaaggtaaagaatgttacatccttattacacccctggggcacattttaaaataaaggcctattataaataaatactatatgttatgtgtcagtgcgattcttaaagctcaacaaatgaatccaattcatattaacatgacctgctaccaagtataaatattacagcttcctgtgtctaacattgtctcaatcaaatattactgggtgaaaacatttaatttataaataaaaatacagtaaaaaagtaatgagattgaaatcagaaaacctaaactctgatcattgcttatccttttattagtcatgccatttatccacaggccttaattttcttattcatgaaatatgcacagtaaaaagaatttctgtaccttttgaagttgttttaaaaagattatgtgtataatgctattaactttaaaacaatatttaaaataagacatcatgatattaataataatattaaaaaatcaggacaatctaaattaaggaattattgttaaatagtcaaacttctgcagagcaggcaattatttttatccattcttcagctcaacaacatgtatctcatgctttgcccaaccatatagccttatgcaaagtgaattctccaaagaaaatttaagcaagtacataattggcatttttcagctgatttcacaactgaatgtggttaaacctcatattcagttggtgacattggttaaatatttcaaggaactaaatatgcttataagtagataaagaatggagggagtgaagcaaagaaaagatggtgtcagaaaagttatttttaaaatactttgggcctgatacagtggctcatgtctgtaatcctaacacttagggaggctgaggcaggaagaatgctggatgccaggagtttgaggctgcagtgagctatgatcccaccacggcaccccagcctgggtgacagagcagaactccatctcaaaaataaataattaaattaaattaaatacttcagtgtcaaatgagttaattatctcaaatgtttataaacatcttaatgtttataattttaagatacttgttattgttttttcaaacttaatgctctactttgaaagagcaacacagtatgagaagaagggttcaatttaagatatttgattttgaagttgaatgaggatactgtatttaaaggcattgagccatacctctgaagtatttaccaatcggattttgaaaacagaattattacttcctttgaaccacttttaattttcattacaccaaatgaagagattctacaagatctacatttttcaaataatggaagtgagcagagactgagacatgccaacagatagagttttttctttcttatttttctgttttcaagccattatttaaaaaaaaaatcagagtgctttattgagcttagaaagacacagccttagggaacaaaatgactacactaattttctgcatatgctagttgggtggaaagttcaacacaagttttaatgatcaatgatgccacgttagcacactttcaaaaagtggatttcagatttgggtgtgattccaaacatgcacctgccatcctcaaagcagagaattcaggtccagaataatcacaagttctaaattatacacagtgtgttgtgaaatatcattattatttttagaaagtgaaaaaatatctgtgatagaacctatttaatgttttgtcagcctccacagatgtggctaaaaacagcttcccagtaatactttcaagggtcaaaagcaatgaccttgtcatgtttctgtgatcgtggtaaaacacctgggtcaagacactagtgaagattaataaggtaattataaaggaatcagaaatgttattgtagcaaagcagatgtagcaaaaacagcacctcctaatactattggtattgtcctcaacttttttcccaatccttgattatgaggaccaaaataaatatgttttacataataaaatttgctattattaagaataacaaagactatttaaaaagcagtagacttattctcaatcacatctttaaaaatcacctttgaacaggatgttcaacatgcatatcagagctgtgggagaatataaagcatgaccccatataccattgttattgctgtatctgtgcccattgacagttgagaaactaagtgattagaaaagacaaagcttaaaaaaacgtaaacttattggaccttcttttatctggctggatctataattacatgctttaaaactctctaggtatgtagttttttttaaaccctataagtaggggttcaactttcaatttagatcatgtttcagaaatgcctaaagagatggacagaccgaattataacaggggacctaaagaaacagtcctaggaaagcgtgcattctgtgggtctgtggagcaagtctgtcaacagaacgcctggttgaaggtcatctttccaacccagagtcctatgcagaaagaaacttaacagcaaagctttagactcttacttgaagtctctctgcagtatgacatcacttgcatacttattaaaatatttttgccacttctcttttcatctaacttattgttattgaaaaactagataagatatttcccatttagccattcatccagaaaacatttactgatgcctagtaatggctatgttaaaaggcacataattagccagacacaccatgttgtatctcaatttagctcattatttctgatggcctcctttgttttcttctgtttggcacactcctctcccatacatacctgaactacctcctctgcaaaggtgctcctgaggcatcaaggcaaaattcactcttctttcttatatgctactattataaatttcagtgcttccattattgtctttacatcattttattaaaattatttcttcaaaagtcttaatggagagttttcactattcaagtttattgaagcatatgcaatatctcatccacatttctatcccaagaagctaacaaggttctgttcactttaaagccctcaagaagtgattcatgaatgaacgaaaaactttccaccttcagtgggaattgggtgacagttagctcccagacacgtttttgaagagatctaccagctcttagtatgaataccatcctttctgacaaatggtgatgattctctcaaaatggaagaatatctctcacattctactggagatttgaatgtgttctccttaaagttagcaccttctttttttttttttttttctttctcagaatctaaacgtctttggtaaacttcatatttagccacagtgattatagccccctccccaccacatacccacggttttggagaaaaataagtttgtttatcttggagtctaagacagaatctaaactttcagcaaggccatagcttatataacagcattactcatttacttttttaaattagagtatctttagtctttgattaggggttggaatacaagtgagcctctaagggaaataactgcctttccaggtcctgaaacttatctgagatagaaaaacttcaactttgtacccagtgacattttagttaaatataatttaagattctatggattcctgttatacatatgcaaaacaaagtaaaggtgtcctttccaaaaatattcacttttattccatattgtttaaatagttttcaagagagatattccaatagcctttatttttttttcttctctattgccaatggatttaaatgtttgcttcattgtggcattccaaacacacaaaactccagtggctatgggttttattcctttgagtgaatagttatcgtacttcaaagactgctttggattttaagttagggtgacctgttttcattatattcaaacaggctttgatccatttctcaattaggtattgcagatgacaaacaggtacgtctagctttcctgccatctaaattaccctagaattctatgaagatgataatttgttctgtgagtacactacttctatgtgttatccacacaaatttcattatttcaagtattgtctttttatgtatctcttttgtggggagactaatattccaatacaaaactgtgttctgttttggggaaaaaaaaaaaaagagctcttagacagtcagaacatgagaagtttaccaaaaataatttgtcctcaagtctagttgataaaaaggccctatgaggttagatttatacaattttattggcaatgacaaaatctagaataaaatatataattattgaggtacttacatttttagtataaactggaataacaaacacatcaactttacaaacctctcatactagtgtctcactttaaagatattcttaggtcaaatacagtggctcactcctgtagctgcaacattttgggaggccaaggcaggaggatcgcttgagcccaggagttagagaccaacctgggcaacatggtgagaccccatctctacaaaaaattcaaaaaattagttgggcatggtggcacatgcctgcagtcccagatacttgagaggctaaggcgagaagattgcttgagcctcgggagtgtcgaggcttcagtgagctataaccacactactgtactctaatgagaccttgtgactatatatacatatatatacacacacatatatatataaaatctctctctatattatatatattatatattatatatataatatatatattatatatatataatatatatattatatataatatatattatataatatattatatatatatataaagaaaatattcctaaataagtggctctcatatgagccacaatttaaggaatattttcttaaaggcagacttagagagaaatatgagtcacactaacacaaagcataatcagcctaactcctcagtcaaacaccctgaggttcacattaccaaagagagaggtttgaacatgagggaaacatattattttcactatactgtgatggaaggaaattaattctggttgtgcaaacctagagcatttctctgaattctctgaactagggtggattgttaagaccaagacagagtgtgcataataaccttgatgttgggaaaagactatgccgtgagtcttaaaacagatcctagttgatgattatgccaaccctgctgaagaaattctgaaaagatgcagaatgccttgaaatacaaatgctttttctggcccagataattgatattgcattagaacattccatgggatttgaaccagcctctttcacactttagatttcaggctagtataattccctcaccacacaaggcagaaccgaaatccctgaagttcaacaggacgtatccaatttcaacaactttacaattttcaatatctgtacaggatttttgcaaaaacccatttcaaatatcccattatcagttccacgtctttttgtgaataccaaaatatattagctagaccgtcatcttattttagctttagaatgtatatcagattttttttccagacacaagcaattaaaggattggaaaatagctcatggaaagctccaaagaattgatcctcagagagcaaatcttgtaacaccaaacaaccacaattcccctaagccactctgctgacaaaagttattgctagttatgcaaggtaactagaagatatgcacacaaatcattgcaattaaatatcctgcccaccatataactgatacttgccgagcagatggttggcagaattttcttgctaatctcgtgttatcaatgtccatattgcagagcatccttgaaggtgctcctctgtttgttttgtattggatacacctatttgtattgttgtatagttatctgtgctgtgtgtcttacccagtctcacccagttattttactttagaatctcatgggctgtgtatcgtgaagacaaacaacctgttggaaataaacaacaaagaactgaatccctcttatctgttcgctgcctaacaaatcaaaacacactgaaatctgggattattagagaagttttggggatatagaaataaaataaaaaccagcttgtcaaatggggctgcctgctgctcagtaccatgtgttaccacagcaagttgcatctgttcagctattaaacctgttagtgaatataatatagacagccacggcattaacaaatattcttaatgcctattaaactctacagctacacattttaatttttacattgtattagtaaaattcaagactatagcacctttaggacaatttaaaagtgcaatgaaaaaactataattttggttatatctcacatgcttaaattatatttagccatcattttaagaattggccatttaaaaaaaagttctttaatttttaaatgtggttctcactgctaactgtaatttagctcactatagatgcaataggactgaagtaattaatcacatgtagaatttgaaaaactcaactaggtacatcttttttccactactgaacatcttacttcctttcgatttaatattggctattagcaaatgccacagaacatatgagttactcccttgatataatccaccctctgagctcaggctcaggaacttcgtcatttaaattggctatcaacagctaggacatgtatgttttactaaacactttatagcagaatacatctgttgctactctgtttgttatattaagattaagcacaatgatgttgacagtattaatacatttaaaagcctgtcacgttccatggtgttcacgagtcctggggactgcaggattgaaataaaaagtgactagaggcaaaattaagaattatggaatgtgtagaaggtgaagaacacagaggtagactctgaaatgagtactgctacccaggaggatattaacctcttgcctgcctggcttttcccataatattgtgaagccacattttactgaaaagagccgcatgcttcatgaaatagttatccaacctccttggcctactgctgcttcatgaatgctgccagaataggggaaagtttgtgactgaagttaaaggggggttggtttcaccgctatactagtgtaattattaaaatgcgaacacactcaaattaaatacaccagaaagaaaatcattctatggagctcagtttcctaagaaataatgagaccaatttgcttttatatgaaaacactccagtttgtgatatcttcatacactgctggtgggagtgttcaacagtacaatgttcttagaggacaactcagcaatatatacattggttcggcttgtatgaatttgtacataaaaatatgcttttacacatgtgaaacgatatttttacaagattttaaaatgttatccatttgtaatacttaaaatgctgaaaaaattaaaatacccatcattagggtctgctaccctcataacatgtagcagatgcatgttatgaggtaaatatgagatcatatgctctaaaatgaaaagatgtacaaaatatattaaataaaaatactcaagttgcagaatagtatgcacatgataatatttcatctttttaaagaatgttcaggtatgttagcatatatacaaatccttgtacctatactatacacaaaaaagaaattgaatgtatatgcataagattaaagattagagttttagacaccacagtaaaaaagtgggtatattatatgctgtttttactttttactcccatcattgttgtattatttaaatttttcaatacaaatttttatgatttaaaaattaaattgatttaaaatatgggctttcctgaaaagtaaatactttcatccgtaggcaacaaataaaattcaattccttctgaacagcctgtcataaaatattattggccttcaagaccctacagtatgcctcactagtctattgaatctagtttatgtctggatgcttagaagaataccaaaaaattagtaagttaaaaaaaaagttaaataatataaatacagtctactgagaaggacaaagttaaggaaaaactagttaaatatggagttgatggttatagcatgttcctcacataacaattaacaatatctacatagcactctcaaattccagaaacatccccagccactgcatttatccaacacccttctcaataaccagttacaaataatcaaataaccatcggtcttgatttaggtatttggaggcggagctagaatttacaactttttcttcccaccttatgaaatatctttgcaatacctgttttttaaagatcaaatgaacacagttctggagcctagacgagtagctgtctaaccttactctgcgtaatagggctaaaatttcaactctatttctctgctgatgctctatgggatttggagcccccaaagcctgattttattcctaattaacagtaatgaacagatgacatacttttcctttgaacacctctgtcgggaaaatgtccaatcagcaagagctacaagcaatagacaaattccctttctctgacctcatttacatgcttaagtacacagagactccccctgcctttagtttggggtgcggggggaaagaagtaggtcaagacattgaggctttatgcattacctttagaatgtggtgaaggctgaaagtcatggctccaaccagagtttccagagcaatgtgggttactttcatattcatcacacataaggccaataccctcctagcagtattagtttagttctacatttaggcacaactcacaaagcagcaaagatacctataattgtacccattaagagacttataatagaaaatactatgtgctatgtcatcacactttgttgttatttagtgcattcaccttgagggtcacagaatctctggaattccatgtttaaggaatatcataaaataatacactacaaagactcactggtttcacatcagtagttgggattttataatcatttgcaaaataagctgggccagcctgaaattttcctttgtacaaagaaaaatgaagctttgaagtcatatacaactggttcaaagacaggcagttatttactatctgtatgattttggtcaatttatttataatgcagtctgctcattggtaaaactgagataaaattcatacctcaatgaattattgtgaatatttaataaaatctaattttatgcaaaatgtttagatcagtgtgtgttccacagtaagcaatcagtacactctaaagagtattgtttagttaccgttcttctgactaagccaaataatagggtaagcatgatttcagagggggaatttaaccctacttcagatgattcactgatagtacttccaaacatttaatatatattaattaaaataatttttacaactcaacaaatggagaaccaattttacctccctcagctaagccaagtgttagaggttggcacagcagaagattaaagagagagagagagggagaaagagagagagagagagagagagagagagagagagagagagaatggttaaattgccagggtagtggagattgatcatctctacattcctaatcaattagggaggattactacaggacagttttttgtttgttttcattctcctagtggattcttctcttctcatcaagtcaggatgcagggaaatatatcacataagtttttgtgtagatattagaaataaaaatgatacagagaacagacaagaagcatacctagactcagagaaatgatcacctgtgtgtagtatttgaatctgaaggtggagctagccattaacaaaagaaaagtcttcctttcataagaaaataacacaggaaaaatgaatccatttcatgacaggcctcagtcctcaggcctctgacttttgtttgcctcaggaggttgtaaatgggaagtcccaggagaacatcacgtgctttcacgattatcctttggtactgtacctcatactatgctccaaggagagcacttctggagtgagcgcctgcatgacaatggaaaactaccagcaggagggcaagagaggccacagtcaaaagtaaagcagcaagagttcacttatttctccattcactcaggtatgcattgcttcctctgtaaaccattactatgcatctactaagcaccatgctagagtatgaaaatacggacatgtaaagatacatagtattatacattgtcagtgaccctgaagagtttacaatttaatgggctacaaggacatataaagacatagttataactacagtaagtaacacaataggattaagaacaaagtattatgattgtaccaagaagggcataattagtcttgccctaggggacaaaggaaggtttcacaaatacataaaatatataatccaggcctcaaagatgaataaaaaagcaccagactaggaaaaagagaaggacaggtaggaataagaggaagtaggagtactttaaagaaaggaacagatatgaacagcggcactctggaggtctctttttgctgactctcattattggtacatttttttaaactgtgtttctcggtctttaaaattatttatgccccaaacttacaaatcaaactagttgcaaatgctagctagctaaccacaaaatctttggggtaactggccagtcagataacttcctatgtatttatttaactagagaaaatgctttatgtagcagatatctgaaatgctccataatttatgtgatatgtggtatactaaagggtagggttgtttgacttcataaaacttcattacacagaccaaaaggcagagttatctcgttcagcctgatgagggattgtctcctgaactctcacctgcatcacagaaggcacagtggttaagcacatggatttaggagtcagactgactgagttcaacactggttttgcagctcactagttgtgtgactttcatttcttcattaactacctgagtatatattttttccttttgaagttttaatgcatattagatggacttacatatgtaaacttagaacagttatgagactgttgattgcttttataaaagccacacttgtagactgcttcatagtttaaaaacttttaagtgtgcttttacagtgtgaggatttgaaatatcagcctattttctgtggctaatgtgccagtagaataatgattatgtagtaaattataaggtacttgaggtcagaagccatgccacatctgactgtatttctagtgctttggaaagtgcttagcacttagaagaaaaggaggtagaagagaaagaagaagaaggaggagaggagaagcacaaggaggagggggagaaaattttgttaagaacatgtattaaagagtgaatgtgtgtgaggtagaatgtggagtagctgaagatgaggctggaaaataagtctagattgtgcatacatcagaggtccagctaaggaagttggcctttgaagtatttgcagtagaccactggttctctatcagaactagaatcttgcttcaagataccaatctataaataggtaacacataaactggaaacatgctgatagttagctcagatttgtatctctaacccccccaaaacacatttaatataaactggcttctgatattgcctttaacctgagcagcaccgacctattgccattgaacattttcagaacacacatagtttaagttggtagaacttccagaatgcaaagattatttcaacaaatactgattgctcacttgctaaattctaggctcatgctgggctctaggaatactaaagtgcacgaaatagataaaattccctgctttcatgacacttgctgctcggcatcatgctgttcagtatggatgaagatttgccatcagagtttaaatactttaacctaattccaaattttgtctgcttcataaaattgccaacaaaaaatgcaagagtacacaaagacgggaaaaaaaaaaaaaaggaagtttgttgttgttattttgccaattttttccagacgtttgactttgctttgtcctggagaagtaaattactaagtgtccgtgtctataattttaataaataaaaattagtttctcttcatatgctattaaatacacattgggaaaaatacttaaagaatactatgagggggcttcaaattgacaactgaacagggagcccatgcccatctctgaccagccttgctaccaggtgagaggtggaaacacacccttgcagagcagtgggagaaaatgggtgaaaggactgatagagtaccaggatttgtgctttttttccactgatgagcagctcataagtgagcaaaattactgctgaaagtgggtgaacattatcagccaggtatgtcttgaactaaaagaggttgagacccactgtaactgaacatttgaagccagaggttgaaacaccacaattttattttataacaatcattctggtagcagtgcagaggatggattagaaagggaagatgctggaggcagagagattagttagaaggctattgcaacagttcaagaagaggtcattaaactaaggcaataatagtggaataaaaagcaagcagataccttctaaaaattgctgttcagtaggcaagccagtagccatatgttgagcatttgagatatggctaatgtgaccaaggagctgaattttaaaatgtatttaattttaattaagtttgttgtaagtttaaaagatactcaaacttttaagtatgtttagaataacttgagtatgtgaatctacttttacaactgtagatataacaaaatataaaatgcttctgatggaaaatttagattctgaaatgagaggtgttgttaagtgtacaagaagttccttgttttgacagcttggcataagaaacagggtttgctaaatgttaagtgtaaaacacacattggatttgaaaagcttattatgaaaagataatagaaaacattaataatttatatcatttatatattaaaatgataatattctgggcatattgagttaaaatatattctcaaagttaattgtatttagtaaaactaattccatctttttttccttttatatgagtagtagaaaattaaaacttacaaacatggctcatatatttctcttggatggtataggttgagagacatggtagcaattcggtgacaaactgattagattgtaaaggcaagcacggagtaaaagatgtcaaagatgtagcctgtgatcgtgtagatgagtgggtgattgggagatgatgagttcagttgttaatgtggtaagtttcagtcgcctgtgagacacccaggtagagatgctgagtaagcagttggaaatattagtatggtagtgacagaagtctgggatggagatgtgtctttgggagtgagcagccggcacttatttgatagctaaaattcagagtaaaattttaagtatatgaagataccctttttcataggccaaaagccttactaatcaattaaatttgatctttcaccaaacttttttgtctgtcaatcacgaatttccattctttattgggcaggaaggatttaagggctaaaattccaggaagagcccaccattaaagcatttacttagaagcctagttgcagtgtgatcttccagggcagttgagcgtcccccattcagggctgtgctctgttggcaaaaaggttagacagttttccagtttgttttgaggaggagagaggcctcctctgtgttgtcgatataagaatccctagttctggtctagcacaccatctcctaaagtaactcctagagacatcacaaattgttttcatcagaagaattttctcagaccccataaaaattatgtctagtcctccgattctaatttataatttggattatttatgtctactattaacttgagtaccccctatctatgcacctagattatttccttccattgtttaaataaacttgcccatgtctagagtgggccagcatcagcattaataggattctaatgctgtagaatcaccatcatcatcttgttttctggtctttggctgacatatttacaatgctgtttctattttgtaaccgctactgccatgcattttgcttatggctttcagcgcatttttttttgtgtgtgtgtgtgtaataaaagtaattttcctgatcattgtgcaaatgacccatattcagtatgtattccccaaactggttcttaaccctcaagcaatgtctttgtttctttttttcttccatcaatctatattgtgtttagagttctgcaaagcctccttaataacgtgcttgcatatagtttaaattattgctcatcatttcttcccgagacacacagactctgtctggatcataagggtaaacatattggatatgttctaaatacaggagttcttaaccattacttcttctaaaaattccagaataactaagatgctcctggattcctaagtcagtgtaagattataaatgtttgctcttttaagcttctaaattatggaaaaattggttacacaggaactaatcacacacattataaattgcattataggtgatcaaaaataatgtgtttattttgcctaaaatgtttcttaaaggtacgcttttgaaaaatagttagtagctatagaagaaattgtggtatagtcagtagtcagaaagaattcaacaagaagttccttgttttgacagcttggcataagaaacagggtttcctaaagccactcatcactggctaacttaagaatagatttgaagccattctataaaatagcttggggcccaccacaaagcagtgggtcaaaaggagtagtgatcacaggatggagcagaatcaatggacatgattttctccagctaggtaatgtcctaggaattgtttctgcaactcttccaaagagattccggagacctaacttctttctgctagcttaggaggtgaaaagatccaggaccaaccctgaaaacactcactatttgaaaaaactgttcaatgactgagtcaaatctatatagtgagagagaatgggaagaaatcttttgaacaggaattagaaatagagagatgacaagaagctcattttttaaaaaaagttaatatgtttcactggagttgaaagataagtagaaaaatgggaaaaatggacacgaaaagggaaagagatcaaaatgctgaagacattaaattttaggtacagaatttgcctttacccatatataattgcagcggcatcaatgtgttttaacaaaggaataatatgatcaaagaaccagattagcaaattaacctgccataagtatataaaatggatagaaaagtactcagaatggagacagaaggatagctgagaaagtgaggcagcagtacaagcctctaagtggtaagtatgtgaaccgagaagaagctagaaatagctgttttgttctcatttcttaaatttcacagcaatagaatttcagatgaggaaataactctagaattctagaaaccaaaaacatagagattaaatgacacactaaagatgatgaccagtaatttagaagttgagaaattgaattaacttccaagggaaaaggatgaaggtaggaatctgtattgattcatttacctctcctacctcccacataataaactatttagcacttaagccaatagaaatgtgaccatcatttctcacattttccccaaaaatgacttttacacctcagaagtttggacagtaattttacaatacatggtgaaaaggcattatttaacccatcttttgaaattgtagtaaaataggccacatgttctctaattcatataagaattaggaaagctacctcgtgatacggcaatagaaaaaataaataaatgaatgtaaaagaactaggaaagcaaaaccaagcaatatatatacaacatatgatttacaggactgaatctgaatactatatggcaaagttaaacctctataaaatcagtgcatctgttgattagaaagagtatttcaaatggaacataatttctattcaaggaaaaccctgaggggaaataactgggtttatcttgttgatataggtgtgcatctatgtataattactgactttaaaaaggtatttctgaatcaaatcttaatagaccagcaagataaataatgtataatggagagaagcagagaaagatgagaaagacttgacacgtcaccaatattggtgttattttgggacatgtaatatttactataaatacactgtttctagtctacactaaaaccaatgatcaaaaggcatatttctaaatcaaaatcaattaagagcttggtttcaaaataaggcttccggcccagcaaagtacaaagaagcaacacttaaggcaaaaatgtgcaacaattcactcatcaaatttgcaatgctcttttatgctcccaagatgaaaggatttcaaaacacactcttcactcatcccctcctccaccctcagtgacatttcctctggtcagaaccaatgcacatgttaatatttgtggtagtgaatgcatccagatttatagtgactttcttctgtcagagaggcattaagtaatttccaaatgacatcactaaactgctatatgagcgcttttctctagaagtgacaacattggtaaaatttctagatatatcttatataatataaaaacttgagctaaatttttcttattgcttctaagaaattatttaagtcattatcagttaaataatcctcaacacatcgtaacttaaacatgtcttgtgtaacacttcacagtttgcaagttatttctttatattctttatcttaaaaatctattatttgttaactgtccacacaaatactatacaagtaagaaagttaaaactgtaaggaagagagatgaagaaatatcaagacagaaaaataccaagaaataccagtcatttggggacaaaatgtttgctataaatcatataagttaactggatctcagctagcttgttcattcattcatccaacaaatatttattgaggtggttactaaacaaccagctcatttatttttgtatccacagagcctaacataggcctgggtcatattaggtgctaaataaatatttctggagaggcttctaggatgtactgaagtaaatgatgaaaagtcacattactgtattatttttctttcttttcttttcttttttttttttttttttgagacggagtgtcactctgttgccaggctggagtacagtggcacgatctcggctcactgcaacctccaccttctgggttcaaacgattctcctgccccagactcccaagtagctgggactacaggcatgtgtcaccacacccagctaatttttgtatttttagtagagatggggtttcaccttgttggctagcatagtctccatctcttgaccttgtgatctgccagccttggcctcccaaagtgctaggattacaggcgtgagccactgagcccggctatttttcttattaatcatcaccattattataaatcatgttctctgccatcagaaagtttatttctatttgtaaataatggacagatataaaataactagagaataattcatgataaaagtgaattacaataaataaggcaattattaacaaaaaataaacattcatccaactaaaatttcaccatagactttctttaaaccaccaatcaccataaccaattcttagttgaagatttctgaaaactacctttaagatttgaagcttctcaataatatggctgcttatatcaagttctatacttttctgtattgtaatcaggaacctggaggactttctcagagttatatagaaattaaaatgtctgtcactttacttgactgttaaataattgaagatctacactcatcctaagccacagtattttcaatgtataatttattaaatctattaaattctttcagaaaatatttattgagcactcatattctaggtactatactaattaattgctcttcacttcatgtcttaccttctcctcaccccttcataaaaccttaacaatttcaatagtaatattatatgactttgaggttaacagtggtagcatcaatattaatatgacaaaaaaatccatctatcaaaactgggccacctgactcaaaaaccattttattccaagttgttatgtttttaagagtacagttaatcaaaatttttaaaaatccaacatttttattctgaaaaattggatgacaaaccatgtcaaatattcaaatcttcattaaaattatatgccaatcagattttttaaattatctaatttaaatagcagtatatatttcagcaatgatggagcatctcttaatgcaatcaactttctaatttattggcttactctatcaaataaggatgaaaatattaaatctgatcagtacatagtatacttcactgactttgaaagcttacacaaattttccttgaagtttaatggataatgaataagtctaacttttacagataaaaatgtatcattgatagcatagcaccaattaggttaatttttaagtcagttatattcacaaacctaaatcataagcaataatctagaatttataaatcttatttttccttttaaatttcaataatgaaagaagtagaacaatttattgggcaaaccaaaatggactcaaagatacctaaataatttgataaaacagcctttcaatattctcaaatctaaatattaagaacagttctgcttctatcacccccaggcattatcttgtgttgctttgcactttctttgttcctttcttccctccctttctttctttcttctttccttccttcctttcttcttggcttcctgtctggttttcattttttcttttaatttctaattcctctttcttttattattccatgcacccaacattttgggaaagtgctggaggtaaacttaggtagtaaaaagaaaaccactggccttgtgttaatttttattatatgcttaaaacatggaaaaaggccgggcacggtggctcatgcctgtaatcccagtactttgggaggcagaagcagttggatcacctgaggtcagaagttcaagaccagcctggtcaacgtagtgaaaacccgtctctaccgcatatacaaaaattagctgggcgtggtggtgggcacctgtaatcctagatatttgggaggctgaggcaggagaatagcttgaacccaggaggcaaaggttgcagtgaactgagattgcatcattgcactccagcctgggcaacaagagcgaaactttgtctcaacaacgacaacaacaacaacaacatggaaagaaatgacttatctccacatcaaagacttgttgagtctgtaatgtctaatcacctcttctaggcaatgggagaaagaaaatttaatttgaccagatttgaactcagactgagtcccattagttgataaggagtgggtagggctgacaataaacagtatttgagaagcccaggaggacacggtttacgagcaagggagattttgaagatatcaagtccaagagaaagggtgtgtagagacatgcactgaatccaaagagaacgaccaggcaagaccaagatcggagattcagaaagaagaaggccttcacagtgcagctatcagaaatccatggctcgtaaaggagatatggagggtattacgctagaatggacgccgagaaagtcaattctttacttatgacaggaccctaagaccacatttgaccagaattggaaagaaatacctattcttgcagtctaaaactctttgaccataaaataaacaacagtggtttgagtaattcaataacacagccccttgtgatttgagagtgatcattgtagaaccttttctcagagtaaaagtgtaattggttatggatcaataagtaatttattttagaaggaaaaggcccttgttttcatttttatttatttattttttgaagtagcaaagctcttaaatcagaacggagcaaatacattttgaaagttgagcttactctaaacagcaagattccttactgtactagtaaaatttatcttaactgatcatttatttatgatgccataaaaatccagatgttcttaattttgattgttagaaatttgctaaaaggcacctgaaattacttttccagagttcccctcttgagaactacattttaaattgaaattttactatggttcaataatggctgtgctgaggggttttgttgtgtttttcaagcttatcaatgaattcagcccttgtggtcagtgtaaactcctacacagcttattggaaattccagaattctaaggcaaaattaagattaagaaaatagtttaataaaaacagagaattaaaaacttgtaaaagtttgtgctaatgtactttggtgtttcatgtttttcttaattattttagaactggtacccgatgaccactttctaacaggaaagaacatgatgacctaatcaaatgtcctttggagagtgagcactgatagaaggagaacttatagggaaagacaaaacaaaatagaacaaacttccatggtcgcttaatgcatgggaaataaacagaacctcaaggataaaaaagaggatggggagacttacctgtttcttctgaaatcttccaaaagatagactttagaccaagaactatgataataagaaccctttagaaaagtttttgaatatgtgacacactacgattttttggatatatcaataaaatattcatatctcttaataaaagacactgtgcttctttacaaataatgcaagaaaatgaagatttaaagagttgcaaacatactcattaataatttttaaaatgcagagaaataagtgcccctgaaccctaaagttaattatggcaactttcaaaggaaaatgaagtttttcattcatgactattctttgctatctattatatgctgagtaaattactgtgggaggcttacaactttagagaaaagagaatgggcccaggatgtaagtggtaattatgaattaaaatgtattttcctgacacgtatcaaaatgagtacaaaatggcacagaaacaatctttttgccatcttgtttcacatccccaagtatccttaaagtatactttcgttccttttatttcatgtagcttcagataagtactttctctagtgagcaaagaaataaagacagaatccagatctttggatgtcaccagtattacaacctcctgcttccagccagatggtgtggtatctactaggcaataacttattttattcatttggcaagtctgcctaaagacactaaaatcactccaaaatttttttaaaaattattttgaacacagaattaagaggaattcacactccaaaaaaaaaaaaaaaaagtttgcattgtaaagaacgcgattaactacagcaataggtatatggtcttatttcctctagattgtattcatatttcctataacaaagtactggtttctgggggaaggaagcatccaagaagcaaaattataaattctttacaaaaagttaacagtaaaaagtaaaagctgaatcttatgcaaaaagtacttactatatgcagttctaggtagtcacccaagcctgaagaactgtccactcgcaccaatacggcttctttctgaacagtgctaaaacctatggccagtctgtctgctcgtgtactgggtcggtcattaggaggccacttatacgtgatttgtccaccacctttgctaaagatatatgtcgtcccagctggaaaacaaaaaccaaaaccaattagtccaaatacatcaagtctgcacattagcaaggcatgttatattgatatatcagtaaagtatcaactctacacacaaaactatggcaaagtaaatcatagatttcaatcaaatgtgctcaagaaagtggaccaagttgttttaaaagaaatggagaggtagctcagtttttaatacactgattcaatttaccagtaggtgtttcagaacaaatagtaggttattgtgttttccattgagttggacaagaacggaatgtaatgaggcattatctcttcctgccagtttttaagaaatagtttagtagaaaacattgactggatgcttccaaaaagcaacagcagcacacatcaacttggtattgaaataggagctgcatgcagatgtgacagggtcatacagcacagtggagaaagtcgcaacaaatgtgctaggaatgtaacttttatggaaaaaggatctacttacatgtgacagataactaatggatgaatagccacaagccccagtagccatgtcaagaaaatacagataatagatgtcatccctagaagtcaggttttgtttaacaagcaacatctagtagctgtcaaactattcagaatcataaaaagacccacatcctctgccaccccaaggtgaatacaagccttatagcactgagaataatgtcacggactcattctgtgagtgttcaaattttaccttatggttgtctggtcagtaaattatccagcttaaatgaaaagagtctttttcaaacaaatttattcagcatttgatatggtttggctctgtgtccccactcaaatctcatctgaaatggtaaaccccataaaccccatatgttgagggcagggcctggtggaaggtgatgggatcatggagtggctttgcccatgctgttctcatgatagtgagttctaacaagatctgatggttttataagtgtttgacatttcctcctacacacacttctgtctctcctgctgccttgtgaagaaggtgcctgcttccccttctaccatgactgtaagtttcctgaggcctcctcagccacacagaactgtgagtcaattaaacctcttttctttatcaattacccagtctcagggaagttctttatagcagtgtgaaaatggactaatagagcatttggtgcactagtcttacctcaatgcatcattcattggccacccattttggttctattattttgaggtcctgaatagaaccaaaaaagaaagaaaaaagattggattttccctctgtcttcttctgactgcttaaaatgggacattgttgttttcctgcctttgcagcttcttgttctcatgccttcaaacctggactaaaatctacatcgttgtttctccagttgtcagtcccataatcgatacccctagcttttctggttctctaacttgcagacagcagatcatatatgatttgatcatatatacatgattatacataataagagaaaatatgaaaacttaggccacaaaacttcttgtatttatagaaaaatagcttgtaccaagagtaacatttatgtgtaaaagttgtgtgtacagcagtatgttttgaagaaaactatacattgaattgccatgattaccaagtttaccagttaaatggagttgacctactatcacatttgtgtacatttaattaaacagctgacaatattgattttgtggccatttttggaagcaactcttctttgttttctgttacagacatttccacaggcctttgagaaattccaaagacctctgcaatatgcctattgtacctgatgcttaaataggacttggtatatagacctcttccaagaaacatgttaggagaaaattgaatgcaaaagtgataaacatgaatactgttaaaatgcaaagctatagaggctgtacccttctctattaattttgcagataccaatgcatgaaaacagtttatctctttcaagagagaaaaggcaagccatatttcaaaagcaccagtcagtgcacaaagaaaattcagaatatacagagtgtagatcagaaatcccagggctttcctgagccacttatgttctacatcctcagaagcttgttcatcataatctttataggcaaacactatttgagaaatatttttctgcctggtaatttttgcaaatgattaagtattaacttttctagtgaagcccattgttgataaaaataggacaagaacataaaaaagtggagatggctttaaaaggaggatgtagtggttatctctgagtgctgatacttaataattaatttttttccttttttaaattggctttgttctctaatgactatatacattatgtgaaataagaaaaatattcaaaactagagatgctatttaatgatataaaacaacacatatctaagaattcagatggtttaagaattatataagtgtgaggtaagcattataaaacaacattgcatattaatttttaactttaaacatcactttcacaattaaaaaaaatcttatctacttattatggaacatagggcagacattacttccatgctatatctgaggaaatttagtcataaagattaacgtgctatctaaagttgcaaacttggttaattggcagagttggtataaaacccatatcctgatacctattccagtatatatatatatatatatatatatatatatatatatatatatatatatatatttatgacagaaatatttctgttatcataaccaggcagtcaagaaaaagttaattggatgtcagtctgaatttatcaaggccaactgttatcatattctaatgtcttatatccataaagtgacatttgctcttcattatcatatactttcttctcacctcacaatacttttaaaaagagaaaaataacatctaaatgtaaaatgacagaacatttaatatatgtagattaacatttagttggggtacacttcccaaacctatggaactatgaaagtttctagcacaattatagaacttgtgggtaataatttgaagttttacactttcagtaagataagtgtcacaatacaaataccattactcaagatttgatttcttctcagattttaacctttttcaatgaatctaaaacttgatgactagaatgagattagctaatctgtcttgtttagaatgactttacagttttttaggtttcaccaaaacaaagcaaaaaaatcgcaactactgtttgtcaaacattgccattatttctagtttccttttttcccaccagatatatcctgagagcagtctttcttagtttttcttctgtatgcacagtagtgcattgtattgtactcatcagcacaattttataataagcgagacaattagatatccagtccttcctcagctctcttctacatacttctataagcactctggattttttttaaaaaattaactttgcatcaaactttacaaaatctcctatattcttaaagccctcttttcactgagctagaaaattactctcataatcaaatatagtgggttagatggcttaaagtttcaaaatctacctcctttaacacacatctttctgaaccaaggacatgatgtacttactgaagcagaatagcttagagattaagaatgtaaactctagactcagagagatctgggttcaaattccaactgtgtcatttactagctatgtgaccttggtagccatttattctgtattgggattcctatttgaaaaaagatggggatagcaacactatcttatagagctctatcagaattacatgagatattacaaagtaacatttagtccatttcctagtatgtgataaatgcctaataaattttagagagaataggtgtcatgtgtgagggcagttgtgtgtgctgtaaaaatataaaataatgaacactgtaacattgttttattttaatatgaaagccttcagaaaagttggacatatttcaaagttatgtccaaatcaagtgactttcaaaaatgacattcctacctcgtaatttttattaatattttcaatattttgtagcacagattaggacttttatgtaaactcattatatcattatttatgttcagtaatagttgacaatggaaggaatattaaattgtatcacatgggagctttcatgagaaaaagaatattagctcatcaccataaaacatctagcatagtaagatttatagcataatgcaaaaaaaaaaatcacttgaccattaaataaagaccaaacttaccaaaaaaccctgccagctagctttttaaaaattttatctttacagaaacatgttttattttactatataagtgagttaaatatgcagtggcagtacatcttaatcacagttccaatatagagaggaacatagaggaatgtgtcacctttattatttatgcatgtttctatatggcaagcactaccacatcagtaccatgactactaatggatttactgcaaattaaccttgacatccatcagatcgctgaatgtatgaatgactgaaatttaaagtggttttcagcaatctccacatttaagctgtgcagcaagcctctattactcactctaaattcattaacaaagctggctctatcagacacaaatttagcaatgtcaacatactttacactccaataaatgtttgtaaaaaatatacatgggctcccgtatctcttgtttaaactgcctgtgatgttataatcagggaatatttttagatcttattgaacatgctatttacatatagggctctctcccttcttgttctttcttgccaactgtcccttgcctaagtgtgcccacttcagcctcacgtcaattctgcaaaggctaacatattcccttacatagattgaaactttctgaaaaagaaaaccaatcagcatgtacaggtctgctcaattattggttgctctggatccttgctacatgaacaataatataattaacttcggagtagattagcttctaactcataacataagtatatgaataaaaggttactttttgaaagcctataattcttcaaatgtcatcttgtagccaacacgaaacattcaggcaattatgtttctattaataaatgtaacaggaatataacacttccttcagtgaaagtttacagtgaaagccaggtacccagatgaatattaaaagtaaagcatttgtaagtaaggggaacctttattctttctacaaccttttccagatgctgttgttaatttgaaattttctggagaatttctacctatatggaggaattctttggcttaaggttcataaaaagcaaaagcacagagaagaccacattgtatgcaaaaagagttttagatcagggcaacatttctaaactgatgaaacagaatcttaacaatcactaaaacaataacaagtaaatacactttattttccttctgaattattgtaagttctttgtagaatcataaggaattatttcatgaagctgagcactataggttcctaattactaaaatttcatataggcatattaaaaattcagaaaaagtgaacatcttaggagaagttaatggaatcaagtaatgagtttctacctataatatgtaaccacttctagatttaaaaattaattacaataattactaatattgagaagtaaggcacagccctcaatgttacatatgcatgtaagggtgcaaagacaaagatgccaggaaaagaaaaagaaaatatggactatatatcataaattaagacttctggtgggaggggcagacaacagaattggcaaatgtgttataactagctaaagagattggagaattagacagatttttaatcacatctttgagaaagagaatgcatatgctctttataaatgaaagaaggcaagaaacatgacatgtcacagaaatggtttaggcacaggtcccatattctcaatcaggtcgaaacaaaaaatgtccagaagaatttagataattcccaaataatgaaagctttatggaaatagttaaggatgatattcaagacagcaacataggtcaacagatacaaagttacggttagataggaagaatgagttctggtgttctgttgcacagtagggtgactatggttaatattattatattgtaaatttcaaaatagctaggagagaggatctgaatgatctaacaacaaagaaatgataaatatatgagatgatgaatatgctaaacataccgatttgatttttacacaacatatatatgtattaaaacatcactataagtgtgtacaattataacatgtcaataaaaacaaaacacaataaataaatttgaaaaaagagaacaatgggaagtttgtcatatatagcaaattgtatgttctgtcaaaactctaggctaaagcattttttaattattaattttttattaaataaaattaagttattaaattttaaaaaatacgttgttgactacttattaagtcaaatgcaaactgagcaagacagggagactcaaacttgtgagcacactattttcttgcattggaatttcatgaaagtgatactgtctaggatcactgtccacacactattccaccaaacaccaatcataaatttggttcaagttaatccaaaagattcttgaactcttgcaaatcagacactgtcatacctccagtatccaggaggactcattaggtgttaacaattaaggttttccaaatttttaaggggatcagaggagggtgaaccagctagactccacggtagacattggaagtctgaaagcagaagagtattcctcttcaataagccagcccatctgagattaggctctagcccagccaagataccatttaaaaaaaaattgtgtgtgtttactcaacaagaaattttaatcaaaataaaacaattgagaaaatgaaataactaaaagttactgtgattccaatgaggtcaagaatcatttctctcaaatataatttcaatagtaattatgcgcttcaataaaaaatgaatttacctctacctattggcccaaaacttttctctaataaaaatgtttttctaataaatgttctacattttctatattctctaataaaattgctatatcttagaaagaattatatattcataaatacattttatcacattttgatgtttataaaaagagtatggtacatgaaaataaagtattcattcttctaaaaacaagtgtataccactctaataagtgaaataattatttaaaatgtaaatagatccatggctgacctatcttgtcaatatcctagacattcattcagaaacaccaccaatagcagcaaagactgcacactggacaatcaaatatgcaccattcatatagaatgagatgttaatgatgttcattggtgtcgtataaaactatgactctacataatcaatgatcaatgattgatagagattgtgctgatttgaataagttattctcttttttttctgacattataagggcattaactaacatagaaaacatttctaagccttcctatctcttgatttgctgataagtgccaactgtgtgaaaggagctaagaatataaattcagaaacagccttttctcttcagcagataggatctgttcattaaaggtaaatattagggcaaaatagtttgtgtgagatgtcagaaaaatggtggtgttctgttgcacagtagggttactatggttaatattattgtattgtaaatttcaaaatggctagaagagaggatttgaattttctaaccataaagaaatgacaaatgtatgaatatttgtcaaatatttgacaaatatatgttattcaaccatgttatcatctattttggatttttaaactgctttttaagaaggtgataatattaaaagcactgattaatgaaaacctaagattatcagaaaaaaatgataagaaaaatctatgtgtgtatatgtattttcttttaggtcaaagtcatgtaaatagttgagtagtttgaaataatgttcaacccaatgaacactacttttaaaaatgtatgcaataagtggtccacttagtggtatctttgcaatatattttcttttacaatctacttattattttcctggcaaatgtgtcatttagaagtatcccctccaggaacagttgagttcaatagtttgagctgcccagagagacaaacttgttttgagatcaaattcaaagtcctgggaactgcttaaaaggctcttggtccaggttacctggctgagtagaaaaacaggtaagtagtagaacttttgccaatcagatcagaaaaaattccataaagacagcaaagtgatctagaattaaaaataaaacaaagcaaagtaatcccacaaccaataatcctaagaacatcaaatgcttatgtcttcccttctgaaactaggctccctccagcagtaggtgaactttattaaaaagtctctggcaagtaactcagtaatcaatttgtattaaagctataggcagcagggataggaagaaaaagaatcacatcatcaggaactttaagaaaaatctattttgaagagcataacctaagtgtgcatgttcccagtaaactcttaaaattattagctggtcggtagaagttgtagttgcctagcaatgtcctttaacttacttatttcaaaggttaattgtgaaaatggctttcattaggattcaagagtcaagaattttctttactataattatggtctaaaaaatgtccagtttaaaaaaaaaaatgacataaacatagaacttactgccgaaatactcttggagaaaagtgagtaaattttccaatttacaaataacaaaactgaggcacagagaaaccaagtgtcttctcaatgtcaaacagatgggtgcaggcttgtacttaactctattcttagtgattttttttttctatacaacaaaaagctaagctcaaatgactaattcttatttagaaaaataaattataattcacaaatcaaggtctcatttcaatcattttagagtttttctaatgatgcttccctagtctgatttggggaaagtttctataatgacacttaacagaaatgattcactcacattctgacatttttagagtctatcctgaatctttaaaaggtgtgaggtatctgcaatgctttattgtaaacatcctctctaagcagccatccaagcctttggcttattctgaagcttctaaattgtggaccaaagctacagaagacaaattttccttatttttaccacagtcacttttactctataccagaaaggctttatgactttttggcagtgacacttctttttgtccttagcaatggaattaaatccttaatacaaaagaataggtatttattttgaattatttgcatcgcatagttaaatagaagggaccatgcaaacaataaaatttgtagtaattttaggctaaaaccagaaccttaacttttgtttatttcctaatgttagttctactcatttatcttcttcctgcctatctgctatacttaagtcattctttacctgactaggccctcgtcaaaaccatttactaattattttggactggaacagaagggaatattagtttttgactcagaaattatctcagactaagctctaactggatttacctaggcattcacaaatgcaatacacattctcctctcaaagtcacttttacttctgctggtttaggcttctctgctgcaccttgatttcttttgtcatgctttccacattcattccagccaaggttaattctcgcctttcaacatccactaacttatttttaatttttgaactattataatatatgagaattgtcttttattgaaatatccattttaaaaagtatgcatcctgaagaaagggatcttgctttaattctaggtatccttataaaaaattatgtgcttttattcacttactaattattaataatgactaatacactcctcaagctaagtcaggaccactgattcaatgatgaataccataagactcctgattctgaaacaagcataggaaagatttatttatgtgatccatcccatgcctacatccatcagcatgatggagtatctgcagctatataagaaattggaatgatttcacctaatacaacaatctcagataaggacacagattgcctaaattattctgataagaaaaaacatggtcgacttagttatacctgggtaagaaataagtattatgaagagacatgggactcctcaacctggtaatggtgatcacatgaaaaggagcaccagatctcacagttcacttgaatagcatagccaaaaattctgcatattttacagggaaaagctggatataccttgctagtcctcaggctttaatgatttattaatactcagagaaatctgacagatagcaccttaaccaggtgatcaaagctagcatcaccagtaatgagacatatcaaattcaggttctccaaatatggtacactgaggacactgcaacattctgtgctatttttggcaaaaattcacagtctcagttttagttttccaaaaatgcatagtctcaatctaatcataagaaaacatctaacaaacccaaattgaaggacattctagaaaataactggcagcactcatcaagagtcgagggcaggaaacagagaaagactaaggaactgtcctagattagagaaaactaagaagatatgacaacttgatgaaatgcaagatcctggctttgatagtggaccacagaagagggcattagtgggacaactggcaaggtttgattaaggtctgactcttacttaataatactacattaatgttaatttcctggttttaatcattgtactctggatatatgagatgttaacatttgtgggagctaagtgaagacacaagaaggctcttttaattttttataacttttttgtaaatctaaaatttcaaaataatttttaaagataaatatattagtcatgaagagcaatttagaatctctctcttttttattgagacagagtctcattctgtcacataggctggagttcagtggctcaaacatagctgatttgcagcctcaaacacctgggctcaagcaatcctcccatctcagcctcctgagtagctggggcttcaggcacatggccaccatacttggcgaattttttaatattttcttagagataaggtctcactatgtttcccaggttggtttcaaacttctggcctcaatagatctttctgccttggcctctgaagtgctgggattctgggtgtgagctatagtgtacaatttagaatcctgaataagattcttggccatgggaatttatgcaagagaggtagcttgagaaacacctacctcttgaaatgaagtagagtttgagattttgtttggctataaaaacaggagagcatttagaggtgggcagaagacatttaacttttgttctacctaataaatttgcttaacgcagagctctttgtaaataaatcattattaagtctttaaaatgaacatattctaaaaatgcaagttaaaatagaaattgcctaagtagagtagtcaactctgggatcagttcacccaaaaagacagacaacttattcattcatttaattcttttatcataatgtcattgtaaatatcattgaaattcttatgaaatgttttccagtcttaaaaccatgtagatacatagttttaagtcagaatacatttttcctgtcttgtaattagaacttcttcacattagtgtgagctaattccttccctaagtttggaatctaagagggaaactagtgtaaacaaatacttgtatgtgtagaaattggcatacgttttgggctgggtatggtgactcacacctgtaatcccagcactttgggaggccaaggcagaaggattccttgaggccaggagtttgagactagcctgggcaacatagcaagatcctgtctttacaaacttttttttttttttttttaattagctgggtgtggtggcacacatctgtagtcctagctacttgggaggctgaagttggaggatcacttgagcccaggagtttaaggctgcagtgagttgtgatcacatcactgcattccaccctggacaacaaagtgagaccctttcttaaaaaaaaaaaaagaatgaaatattgtggttatgatgaaaaagatgattcaaaaggcaggggatggtgataattatagaggaaggactcatatctcttctaataaaacaagacaaaaaaatcctatgagagatcacttttagatttcttgaaagtttaaaaaccagatggcttagagaggtggcagggaaaaactctaactcaaattaatgagtggggcattttgacacaaacaaacaaatcaacaaaaaacaatgcggagacaacagcagaaatatattgctggagacagaatacaaaggcaataaaatagtataatttaagaataaaaacatctgtatactcaataaatactaattaagcatttactatgtataaagcaccatgctagatcctgatgatgataaaaaggtgtgacatagctctgaaatccagctttttctcaactatcatgacccatccaaacacatgtcatttctttcctttctttttttttttttgagatggcgtcgcactctgttgtcaaggctggagtgcaatggtgtgatctcagctcactgcaaactctgcctcccgggttcaagctattctcctgcctcagcctcccaagtagctgggatcatagatacgcgccactatggctgtcaaatttttatatttttagtagagatggggtttcaccatgttggccaggcttgtctcaaactcctgacctcaggtgatccgcccgtcttggccacccaaagtgttgggattacaggcgtgagccaccgtgcctggcccagatttcatttttgaatttctctttcatatttccattcttaataccatccgcatcaagttaaaaataaataaataacttttctaataaatactttactgactgacttgctttactgacctgctaccttcttacctcttaatttaaatctcttttataaattaacatcagtttattttttgaaatagtattgctaattgcttctctattcaaagaccttcaatgattaagtgactgtctcccaaattaagaatttatggtaacttggactaccttatgtacaaaccaaccctgtacttcaagcaaactggagaatttgcttgtctcccaaatactcccaaattattttcatagaagataaaatttaatatggctctgaaaagataagagcaaattttattggcaggattttgatgaggaaaggcaaaaaggcacaaaatttggttttcaggagtaggttgtagatccacttatataaatggaaagtcactttttaatattttttttttttagcggaagctgatgcatttttaaataccactatgtcttatctctttgtctcttgaattaaatctccagataaatacagagcacaaatcacatagtagaaattaggactattcaaggtcagtgttaaaaagagattagataagttctagtatcttagtttattaaaaattctatgaaatgcaaatttcctttaacaaggagtcacataaattcacaaaagtagaaaaatgtaatattaatgtcataagaaagactgcacttagtaagtgtcttggtgatattttgctatttatcataaattgtgtcattctatctttatgagaaataaaatcatttctcattttttcaaaatttaaatttaagtaccgggatacatgtgcagtacgtgcaggtttattacataggtacatgtgtgccatttacctatgtaatagatattgtattacatatgtaattgtatatttattacacattgcatatgtaataaatttattacatatggcatatgtaataaatttattacacattgcatatgtaataaatttattacacattgcatatgtgtaatattacatattgtatatgtaataaatttattacatgttgtatatgtattacatatgtaattgtatattgtattacatatgtaatacaatatgtaatagatgcatctattagcccatcacctaggtattgagccccacatgtgttagcattcatcctgatgctctctctccccctggctccctgacaggcaccactgtggtgagctccccttcctgtgtccatgtgttctcattgttcagctcccacttataactgagaacgtgcactgtttggttttctgttcctgcattagtttgctgaggataatggcttccagctccatccatgtctctgcagaagacacgatctcagtcctttttatggctacatagtattccatagtgtaatgtatcacattttctttatccggtctatcattgatgggcatttggagtggttccatgtctttgctgttgtgaatagtgctgcaattaacgttaagtgtacgtgtatctttataatagaatgatttattgttctttgggtatatacccagtagtaggattgctgggtcaaatggtatttctggttctaggtctttgaggaattggcacactgtcttccacactggttgaactaatttacattcccaccaacagtgtaaaagcattcctctttctccagagcctggccagcatctgctgtttcttgactctttaataatcaccattctgactgctgtgcgatagtatacgattgtggttttggttcacatttctctaatgatcagtgatgttgaacgttttttcatatgattgttggcagcataaatgttttcttttgacaaatgtctgttaatgccctttgcccagtttttaatgtttttttgtttgtttgtttttgtaaatttgcccaggttccttgtagattctggatattagacctttgtcagatggatagattgcaaaagttttctcctattctgcaggttgtctgttcactctgatgatagtttcttttgctgtgcagaagctctttagtttaattagatcccatttgtcaatgtttgctattgttgccatttctttttatgtttttgtcatgaaatctttacctatgcctatgtcctgaatggtattgcttagattttcttctagggtttttacagttttgggttttacatttaagtcttttttttttttaacttttttaaaattttatattttaaatacattttgtccttttttttttttcttttttcttttctttttttttttttttttttgagacagagtatccctctatcacccaggctggaatgcagtgcgtgatcttggctcactgcaacctctgtctcttgggttcaagtgattctcctgcctcagcctcccaagaaactgggaatacaggcatgtgccaccacactcagctaatttttgtacttttagtagagacagggttttgccatgttagccaggctggtctcaaactcctgacctcaggtgatccacccacctctgcctcccaaagtgctgagattacaggtgtgagccactgcgtccagcacatttatatctttaatccatcttgagttaatttttgtataaggtgtaagtacggggtccagtttccattttctgtatatggctagccagttttcccaacaccatttattaattagggaatcctttccccattgcatctttttgtcaggtttgtcgaagatcaggtggttgtagatgtgcagtcttatttctgagatctctaaactgttccattagtctatgtgtctgtgtgtgccatgctgtttggttactgtagccttgtagtatagtttaaagtcaggtaacgtgatgcctccaggtttattctcttcatttaggattgtcttagctatacagattcttttttggttccatatgaattttaaaatggttttttctaattctgtaaagaatgtcaatggtagtttaatgggaatagtatttaaactataaattgctttgggcagtatggccattttcatgatattgattcttcctatccatgagcatggaatgctttttcatttgtttgtgtcctttcttgttttcttgagcaatggtttgtagttccccttgaagaggtccttcacttccctctttagctgtattcctaggtattttattgtttttgtagtaattgtgaatgggagttcattcacgatttgactctctccttgtctattggtggtgtataggaatgtttctgatttctgcacattgattttgtatcttgagactttgctgaagttgtttatcagcttaagaagattttgggctgagacatgggggttttctaaatataggatcatgtcgtctgcaaacagagacagtttaacttcctttcttcctatttgaataccccttatttctttctcttgctcgtttgcactgaccagaaattccaatacaatgttgattggaagttgtgagagagggcatctttgtcttgtgtcagttttcaagaagaattcttccagctttttcccattctgtataagatttgctgtgcatttatcataaatggctcttatgattttgagatatgttacattaacacctagtttattgagagtttttaacgtaaagggatgctgaattttatcaaaagctttttctgcgtctattgagataatcacatagtttttgtctttagttctttttatgtgatgaattacatttattgatttgtgtatgttgatttcaccttgcatcccagggataaagccgacttgatcctggtggataagctttttgatgtgctgctgcctttggtttgccagtattttattgaggatttttgcatcagtgttcatccaggatattgacctgaagttttctttttttttgttgtatctctggtaggttttgatgtcaggataatgctggccccataaaatgagttagggagaagtccctccttttcaattgtttggaatcatttcagaagaaatggtaccagctcccctctgtatctctaggagaattcagctgtaattccatctggtcctgggcttcttttggttggtaggctatttattactgccttactttcagaacctgtttttggtctatttgggaattcaacttcttcctggtttagtcttgggagggtgtatgtgtccaggaatttatccatattctctagattttctagtttgtttgcatagaggtgtttatagtatactctgatggttggttgtatttctgtggggtcagtgatgatatcccctttatcattttttattgtgtcaatttgattattttctctttttttttattagtctagctatcagtctatctgtcttattattttttttcaaaagaccagctcctggattcattgattttttgaagagtttttttgtgtctttagctccttcagttctgctttgatcttggttatttcttgtcttctgctaccttttgggtttgttggctcttggttctttagttcttctagttgtgatgttagggtgtcaatttgagctcttcctagcatttttatatgagtatttagtgctctaaatttccctcttaacaatgctttagctgcatcccaaagattctggtacattgtctctttgttcatttctcaattttttaagtggtggttttatgcttagtagaaacagtaacagcaaaagaaataaaaaaatataactttggtttgtttgtttactcattccttatctcaagcctactccaacagcctatgaagatggcagtaagagtaaagttcagccatttctgtgatttatctatccacatttattttttttgtagacactgtcatgctctgctgctctgtcacccatgcttgaaagcagtggtgttatcgtggttcactgcaggctcgacctcctgaactcaagagatcctcccacctcagcctcccagatagctgggtctacaggcgcacactaccacacttggctaatttttgtatttttttgttgagatgtggttttgccatgttacctaggctagtcttgaattcctgggctcaagcgatccacccaccttggcctacgaaagtgctggtattacaggtataagtcaccattcctggcttatccacatatgtttataataacggttataaaaaacaaacaaacaaaaaaaactggaaagttaggtcacttacattgacaagaaattgtgggtatctgtaagatttataactcaacgatataagattttttaacccatgaagttctttggccaattaaatttaacaaaggaaatggattttcaagtgaaaaagaaaagaaagaggttctctatggagaattttacattttaccacccatgtgaagattataactatgtatgagagtcatttttgaagttgaaataattgaaacacaagagcacggattaaagtaccaaatcagacatggggcaggtaagtgtcaaatcttttttcttttgtatttggttcaaaaaattctatctttctagactaaaattacaaggtggttccaatttgcacatcagatccttgaacactcaggtccccaatctcaaaataacctcacatttgaaacatacgtccttaagctctgaagtgaaaatggtggagaaaaacctataaaacagaaaggatagaacactcagaggtgaagcaggcttccaacttaaaaattcccagttctagggtcattttaaaaattttaattcattttaaatgggttattgtattcaaataaagtttgcatgccatctgttttcaaagtcatttaaattaagttttatgactcatgaggaagagaggccatttttaacacattatagtctgcttattactatcattaactaattaaaattaattattaagagtgattccttttgctctcaaatcttctagatcatttatcaaagaatgacatgactttctcttccttccttggaatactgaagtcacagtcatatgacttttgggtagatgctattgaaatgatgattttagtcagatgtttaacagtaacgctgtctaaaagctacatttaaccaagagagcagtatttttgaaacagcaggcagtataaaactgctttgtgaatattaacatattctagcaaattagtttgcactcattatcataagcaattgcttactgtttagatgcagcttgtattaaattggcaagcaatttgcaagaattaaaacataacatggagagctttctgaaaactcagcaatatcctgggagaaatgatgctactaggttcacagaccatgtaccaaacgtttttacccattaaacatatttagcattagaacaatagttggttggctacataggtttttaatgtaagatcattttctaaccgctgtttggacaccatcaacagaattttatatatcagacatttaaagactttgttttaaaaagcctgaggagaaagtaggaaggctttgttttctaaaaatgaactagctatcaatttgactaaattttgatacttcaataacctattgcattgtcttgagttactttatgctacccaatttgtccctttcacaaagtttctgttgtcttgatcattctttccatttattcctgagttggattctgctgatgtttacccctatccactttactttctttaataacagaacttttgagtgtcagctgagcagatagataactgcgtagagcctacatttcccattctcttttacagcttgaagggtctattgactaacttctggccaatgagagatgagcaaaaatgatgtgtgtttattctagttcagatcctgaaatgtgtctgcattctcctgcccatttccctctttcttgcctagtgatgacaaaattgaatcagctgcttcagacttcgagatggaagccaaaggttgagaactgtacaatcctatcctaggacgactgaaatgtgactattatgtgagaaaaaagaatcttatactgtgttgagagatgagtatttctgggtctcatattgacagcaaagggtgtttatccaggctttgaaaaaaatgacctaacatttccatgtatttttttaaccttatgaggcaagtaaatttgatagagaagctattattatctccattttatggatttaaaagagattaatattcaaagagctaaaattatttgtccatggtcacaaagtaatgtaaaactttttctgtcaaaaccttccacaggaggctaccgataatctattacctttttaatagtaaactgaggttacctaccctgaataattctatgggaggtcacatgtatttatggatttccccattctgcaattctttgctccttaagaaaacaaaatttgcaaaacacagtaaaggatattgcttgtaatatgaaacaaagttaaaataactgacccacacaagcccctcagcttgaatagacagcatttactttagaaaacttttaaatactttctccaccttttgagatttaaatcttctcccagctttttgccagatttacggcttgaaaatgtctttctcaagggcctaggagtcatctatttgaaatgtaatcatcaaggaagacagtgctctgtctaccagtatctgaaagggtaagagcctaacctctggaagtgccaacgagtaattttttctgtactatacatataataaaggactaattaatgggaagttggataataaagaaaagtgtaatgtattaaaatctgtacatcagcaaagaaagataatttaaagagtatcgttaaagtgctacggagtactgagaaaagagactatccaaaaacaaatctagtagctagttttatggtttttcaaatgataaaattaaaatataaaacaaaaaatttaaattttttattgataaagtatctgcacaattttttttttggtttcccagtgcatataaaggttgtttatactataatgtagtctatttaagtatgcaacagcattatgtctgaaacaaacaatgtatataacttaattaaaaaatactttattgctaaatcatctgagcctttagcaagctgtaatatttttgatggtggaggatcttgcttcattgttgatgggtgcttactgattagggtggtggctgctgaaggttgaggtggctgtggcaatttcttaaaacaagacaacagtgcagtttgctgcatcaaatgactctacacaaaagttttctccatagcatacaatgctgtttgatagcattttaaccacaatagacttctttcaaaatttgagtcaatcctctcaaaccctgctgctgctttttcaactaagtttatgtaatattctacatccattgttgtcatttcaacaatgttcacagcatcttcatcaggagtacatttcatctcatgaaaccacatttttcattcatccataagaagcaacttctcatttgttcaagttttatcatgagattgcagcaattcagtcacatgtccaggcttcactcctagttttagttctcttgctatttctaccacatctgtagttacctcctccactgaagtcttgagcctgtcaaagtcatctatgaaggttgaaatcaatttcttccaaattcctattagcactgatatttttaccgtcttccctgagtcacagatgttcttaatggcatctagaatggtaaatcctttccagaaggttttcaatgtactttgtctagatacatcataggaatcactatctatggcagttataactttataaaatgtatttcttaaataaggcttgaaagttgaaattactccttccttgggttataaaatagaagtgttatcaaggataaaattatattaatccccatgtatatctccatcattgggtgacaggtgcattgtcaatgagcagtaataatttgaaaagaatctctatttctaagcagtaggtctcaatattgggctcaaagtgttcagtaaatcatgctgtaaacagcatgtcattcactctttgctgtttcatttatagagcacaggcaaagcacatttagcataattattaaggaccctaggatttttagaatggttaataagcattggcttcaacttaaattcaccagctgcattagcccctaaaagagagtcagcctgtcttttgcacctctgaaaacaggcattgacttttctccttttcagctgtgaaagaagaagatacctacatggcatcttcttcaaaaactatataaagctgttttgtctacactgaaaatctattgagtatagtcaactttatcaaattttagctaaatttttttttataacttgctgcagcttctacatcaggactgttgcttcaactgacctggaaggggagtagaagatgtgccattcactcagataggaaacatcagagaagaaacatgatgcttaagtaatataaggggtttgttatgttagaatttagctaccttcctccaggtaagcataccacatcatctctacattcctacttagcatactgaagtgtacatggaagacttttttttagtatcctgctaattaatcaagtaaataattaagaagacatcttcaaatgaaaactctgccctcttttgtagatttttgccaaactcaaagttataaacacaattaactcctcatctcttttaaaatattctccaaatgtaatatttagctttcaataatacctttccatgaaacacacatgaattggctttatctgaatatttgcagtgttccccttttttccaaaaatgttaagaaatcattttatgaaacaggtttcactatactatattgtcccaggatgtcatttgcatgtttactatttggttttctaaatacatttatcggtacaagttattgtacttagttgatctgcttcctctactcatcaaggtggtttatcatttgtggtgcataggtgagcaataggatctagtgtaacgcgggcttaggttcaaacccctgcatgtacagatgaaattgggttatctgcacttcttgtacctttcaatagtgggaggagagaaggaaatccatcactactggaaaatatgctctgtactctatcaactctgttgaccctcagcataaaatattttaaagcatttccctaacaaacaactctagttagacaatctgtatcataaccactacttttatctatgagacccctctgtctcttagaacatagtggtcatgggtactggtagcccatatgatgcctttaggaaaatagaaaaaaagcaaatctccaaaaccctctacttctgcctattgaaaattttcatgatttttgtcagaacaagacatttgcttgatatttcctagaaaattgtcatattaaatatgcaactccattgtgaaaacagtataaatggtgccaccttaacaagtgtacaacttgcacaaacatccatggcatccttttagtaagatgtaggaaatgattaggttttgggttaagacggagactcaacacatttggaccctgttgttctattggaatacaaccacactcctcagagggagaaaatgcaagagacacacaaaagaaccataattcctattcaatcactttttttaatgcaaagcaaacaccgatgacaaaagaagttcaagctttttttttttccgttttttttttttttttttttgaaagaagccgtcttacagagttgaaataagattagtcacagacctaacctgtagaaatgaaatttctgaaaaggaagacagtatcagagcagtgttaatccaagatgtatgaagaactaaaccatagcagcttaagccatatatttgaagcacagatttcagcaagacaaaactgtgacttgaaaaacgagacactcaaaatcctcaggagatcagtctcttctcctgttcctctacggctcctccaaagtacagattcaattttgagtcaggttaaattgggggctgaagtgggaatatatggttaatgaattttgtacagtcttccttcttttcaattgaaaaagaacagagaaaaaaaatccctcaaaaagacttcatgggttttactaagtctttccaacatttccccccagattgatttcagatcatgtagagacaaccagactgctaattaaactattaactctttcttctaaattgcaaatctttgagcatttacactgtagaagccacctcactaactctgaagccccgaggaatatagactttccatagattgggagggaagtaacatacacattaccctaggccaaatttgaccctgaaaatgaagtcatatgcactaactctcaaaatatttaattatttttcccagactttgcttaacaagtgtatataacaaggaaagcctctaaggtacgctcagagagattcattttctcctggagttaaattgaaaggtgacacaatgaaagctctgttatgattcttttgaaagcagcaagattatgttctcagccaatgtaatgtatagctgacacagaataaagtgttggccaaaacagaggaaatgtgctgaagtccaaagcctccatagacttaagtcacaagacataaatatacttatggaactctaatgccctaggttattgtataaaagtgatatgtgtgttaaatttttaaataaaccaaccaaaacagtgtagcaaattcagctccaaaatagattcctttaattttgaaagatatgttaacaatatagaaatatgtaaaaatactatttcttttatataaagtgaattctttacctcttccatcagagcagtgtctacactctaaattcattaataaattctccttgtcctatgtgaaaatgagtaaaaaataagattgcaaatgtggaagttctcaaccttgaatcaggaaactatagatctagtcctaattccttgctttgtgactttgccaaagttattgaaactatacaataatcctcattttcttcttctgaaaataaaggagtttttccaggtaatttatatgggcatctccagctctattctgagtttaaaatgtcactccaccaaagccggcgttaaccttgaacttgattccagagtacactgagcatgaagtagaaagttaaatttatcagtgaggcaattcagcagacaacatgcaatgacttctttggtttatatttatttcattcttatttgactttcaacaaaattgcacagaatgttttctgtattttatggctgtgaaacaacacagtagaggacattttattttgcctagcaattctttctatgattaaaattaagacataaatacagaagaattgaatagtgtatgggataagcactgctagcagttaactttttaattttctaaaatcatataccctacatggctgttctagcaactccacccaaaatcaatataatacaaaatccatagaaatagtagtctaaaaccagttccaggtttattagaacctagttatgtaattactgaggtcttctctttttaaatctataattactactgttatactaaaaaggttgggttaaatgttattaggcaaaaccaccctggctgatttgttttgtgaatacatgttaagataattcctacttagaagaacagaatcattccaagctgaaattcttatgagccttagtaggttctattgtcataaatatgactcagatccagaaagggattcattaccctattctagcagtcaattttagttgtgaaaatataaggaaaagtcaaagcatattctctacagatgtagctgcagtggtgtcattttcctccatgcttctggttgagaaaaaccaggcatcgcctcaatggtccacagattattaattcccattgtaagataatcctgccaatgttcaccaaaattatagccatttcttcttttgcatgtgttcttatgtgttggagtttttggcaaagaatttaaagtccttcatagatacccagttaaataatcctattactcattccctggtagattaataccttttgaaatgcccttagacctttcacatcatggaatagaaactcatgttttcttctgagttacatgacagtactccacacactggctgaattttgtctatcatctcactttttctttaaagcactaattggagactacatggcaaggtgatgatcatttttaccaagaggaaaacacacatacacacacacacacacacacacacacacacacacacatacacaaacagcaaatgacctgttcagtgtcataaagttggtgagcaggaggaacacataggtgttccttctgttatttattcctcagatttgaaagttctgcccttcatataactgtcccatactgaagcagtagaaccaatgtacttatggtaaggtggcactgtgtgtactctcaacaaatgttaattaaatggacttagggcaatctcccctctcacctatttgagaggtccaaatgacacaaattattatttttatataggtagctattaggtcttcaaacacatatgaacaattctgattgggatcattcatatgttatatataacaaataggcttaattacagttggtcattaaataatatatctactgcagaaactgtggaaagtacaaaattaaaaacatagggacttaaaacaggtgagaaaatttttaagtgatttgaccactgaaggtgaaggaaaataaataaagagaagaataaaaacaataagaacaataacattggttcaagaaatcagagtatgcatccttttagaggtctccaagctgtctgtgccttccatcttaacacctagttcaataacacgcctgtttagagggtggcagctacattcaaaggagtcaacataactttgtatcactctattgattggctatttggcttgggaccagcatagaccagaattggtctagaggttgctctcttgctttggagatcatttagcaagtgacatcgtgtgaaatcaatggcctgttactgctttcatcattctcaagttcagtatcataagggtccttaagatttaatgaacctagtctgttgagtgaagctttcaacctgctatatttcttctaacataccaaaatggcttgtatgggaaatgattactatcttatgcagtaggactgtgcaatctaagacttatcaattaaggataatacggcagtaagataaacatttaaattagtttttcaataagatgtgtatttatatattttccttaaagaaaaacagtgaaacagctctctactggctaaaaaaaaagaaacaaagaaaatcagtcacaattgaacgcacacatacgcacatagaaacagaatagataacattgtagaacagtcgctaggtctctggagattcattaacatttcatatccaaggagactagccattcattccttctaaaacagaaagcattttcaaagcaatatccatgtacaggtaaacgacaaagcaatcattttgaaagaaggtaaattacggtcagatgggtagagaaacaaggaggaaatgtcagacattctcatcagcagaaagaggcaacaaacagcaaaatatatatcatatatatgttaaatatatgtattatatatctatgtataataaatcaatgcaagaggtgaatgagaagtaggctgtcatgttctccagcacaaggatgatctccctaagtggtacaatgaaatgaagaaactcccccagaatattataacacagttatatgtcaattttcttaacagatttttgagtgttctgtacacacggcaggaagaacattgtggaaacatttcagtaaagagttataatctaggcctctgtctcttggagacaagaagtgggaacaagaccatgagtctcatatcaagaccacacatctattttctttggaataatgtcatcactaggaccagcagaagcttgactaatcacatgtgaaattaagtcaggggtcctagattttttcaagaaaacaacaataacaaaataggagtttaaaataattgatgggtatagcgcccaaagcattaattacatgtagaaaggttttttaaagaaaacctttaaaatttccagatgccagaaaattctttttttccaaaaacatttgatatgggagtttaatagtatcatatgaagaagtatagaaacttctccatttctgggggacttttcatagagataggccaactcaccaattctaggtttcctcatggtgggaatatatttgcttactggtaaaaaagtcttgggcaaggacaacaaacaccgaaaaaaaatgtgtactctgatctgatcttgaattcccagaaacaagcaacttcctgttaattaatcctagcaaggccagagactcaggaaagggcagctcttttctacgtgagattaaaactctctctacatatattataggtgcaccatcagaagagactggtctaagggcttatcataaagaggggagagtaactgcactgctaatctctccaacaaaagtgctactgtgattacatcatgacactataaagacctggataagtgttactgtattaccacatgagttactagttcctggacagaatgcccaagactgtttctgattcatttttgtgaaactacttccaatagcaacgaacaaagaagaaaaatacagaaaccaaaagcaagacatagcacaattcttcaggtaccaatttactttatcaagttttcaccttataaaaacagaggtgatatttggacacaagaccagaaaaagtcatcttccgagcatatgtcctcctcaccacactcattcacacttaagcaaatacatttcacccagggttcttggaagccagcattccacatttagaaataatttctttggcttaaagattggctattcttacatcttcaaatgcaagagaggagcaagttaaagctagaaaaacggtcacacaaagatagaggtttgaggaccaattttttattttatttatttctttgttattattattattattattattattattattatttattttttttttttttgagatagagtctcactctgttgcccaggctggagtgcagtggcacgatcttggctcactgcaacttctgcctcctgggttcaaccgactcccctgcctcagcctcccgagtagctgggattacaggcatgcaccacaacgcccaggtaatttttgtagttttagtagagacagggtttcaccatgttggccgggttggtcttgaacgcctgacctaaggtgatccacctgccttggcctcccaaaatgctgggattacaggtgtgagccaccactcctggctgaggatcaattttgagatcacttgactccagtttttccaagaaccaccctgaaatggacagtgtgaattcaacataactaaatatatattatatactataaatgtatatataatgtttataaatttttatatatgcattatattttattataattatatattatgatataactctataatatatataatttttatatatttagttacatataaaatatatttatatatgtatataaatacacacacacacacacacacacacacacacacacacatattttctttctagaagaactaaggtaaagttgcgtttgaaaatggtaataagagtgtgtggccagaaagaaggaagcagcaagttagttgtcaataacactggccaaggcaaactctgaccctgtctactttccagcttttgtctttcctcgatactgctttgcctaacagactcttccctggcattaatgactccgctgtgaagaaggatggtttctagtttagtgacacaaaaagatacgtttggtatttaagaaagcataaagggagcataactccattcacctatgtcaaaattacttggataaacaagtatagaaaacattagttattcttctttattatagaaaatggataaaactaaaactcaacttcatctctgtgtacagatagcatagctacctagggaattaattatttaatttgtgcacaccttatgatcatgcctcagaaaagaactgccagagcaatcccttgtataggctactgtgattctgtttttctgaggctaatgtgctctgtgaggttgtcagaaaagaaataataatcagttatttctttgtttaactggagaggcagatgaataaagcatataagaaaggtacaaggaaaagcagcttaaatataaatacaagctagtcccatttctgactttgtgtctacctttgaccaatggtgaatgaatttccttgtcactgtttctgcattttgaagaaagtaagctgtattcatattttttctcagaaatactatgttaaatgtattagtgtatgtccttgataaacaaaatgtaaaactcagaagaagaataatgtttatggtacatatatttcttcaaagtaagaaagaactattcatttcaataatgccacaattgaaaattgagccataaacatcctgaagggccccaaagttgaaaacaaaaatgaataagactaccaactttttaactttttcagaaggatgaagctgcttgcattctttggggagcaaatgttaggcttttttcctatttaaattaccacaacattgtcacgatctgacattcgatttataacaactaatcaagaaatatttacctaatgcccatagcatatgaggtattatagggaacgaaaatcttacacactggatatttaagacccctattgagggtaagccaaattagaagtaaccgttgtataaataatgctcacattttaaaagcactttatgattttcaaaatatgtttcacattggtcacttcatttaacagacattatcttatttgaagtccaagaagagagagatccagaggtggaagtgattaaaaaaaaaaatctgtgaatttaaggccaggcacagcggctcacacctgtaatcctagcaatttgggaggcagaggcaggtggattgcctgagctcaggagtttgcgaccagcctgggtaacatggcgaaacctcgtctctaccaaaatacaaaaaatcagctgggtgtggtaacgtgcacttgtaaacccagctacttgggaggctgaggcacaagatttgcttgaacccggaaggcagaggttgcagtgagcagagattgtgccacttcacttcagcatgggtgacagtgagactctgactcaaaataataaaataaaaataaaataaaattctgtgaatttaaacctgagctggcatttgaaagaagagttgggcttgaataagaaagagaagaagccaattatgactgaaaattgctttgttctttaattttcataaacacataatttactagttccttaagtacacaaatatatgctttcttattatcctacttaggcttagtactacacccaacagtgacctggggagcacatactgaattaaccaatagggaggatttgtccttctgtatctattttgatcattaacaggacactttacaaagtagctggggagttcagagtatagctcatggctatggaatataattgagctcacagactcagggagtcaatcccttcacttaaggttcattagcctgggttccaaggatcccagggggcgattccttccttttctgaatccccatagcacacatcacccagacaatgtctgtaggacaactttagcacttcaaatgaaatattgtctgtgagatctttgcttttcaattgattcgtgttatctttgtcttacctcccaattaatctccagagctccttgtagataggaactatgtcatccagattctttatctaggccacatagcttctagccaattacttgacaaagcataggtgcataaccaatgtcttctttgtgcctctgagttgcaaacgcagttgtatatctacgttaatgaaacgatgcttcatgcctgtattttaaaaactgatgcctagacaggtgagtaatgccaagcagactatgcaagctcttgtggtttctgattatcagataagagtcgcttaatttggtaattgtgacattgtagatatggaaagtatagtaaaagccaactagtgcagaaccctcattttttacatggggaaacagacttagacagggaaagtgccttgcctaagatcacaactaatattgtgcaagaatctgttgtgggctcagcatatggtaggcaattatttcaatgaataaagaagtaccagatgtgggtcacatggtcccctggcactccagccgagaaggcaacttggtgttatttctatgagtccttgcaggtgtggaatactgtatactcttccctttgctgtattgtttctgccaaaataattgtattttgtagctgtattttcacttaaatataaaagcagctaaaagatagtatgcactgtatttcccaactttgtatttaagtccatgattacgtctacgtatttacacagattccttttcaaaatacttacaaggcatgcaccaaaataataacagattatatctggccaatggaattcttggtgactttaatctgactttttaaacatgtcaacatatctccaatattgtcatgaatatataaacaaacattaattttatagctagaagttaagtccagtaaaaatatgtttttaaaaagaaagacactacttctacacctgccaaaagcctgccgttttgcaaactagtcgagttttctcatgatatataaattagcgcaattttgaaaatgtaaatatcaattattgtgttacaaaaaaacaacttttaggatgtgggaagcagaggttctgctaacatagagtttaacattgagccttaaagaggcggaaaggtctaatttgggaaaagactcgttccttaaattttactctagtttttctttctatttccctccataaggaatttataaactcagactttaaattccattatttggacttacaaaaagcacattctgttaaaacaaaattaaattaaattaaattaaattattagattaaattaaaaagccctatctgcatgataactatcccctccgtttctgaccaaagtctcacagaacttcccccattatgtgttgaaggaaatttgtatttcaaggtacaaatgagaatgactcaaaaccatgtgggagaatcccagatgcattatatagattaagtgggtgtggtgataaaaaagattaggggttaaataaaatggttgctggtcaccatgagcctcttattttgtattactaaaattcaacctaccatcatttgtaacatgagcgtggggaaagtaaattgtgaattgcagactattttgtatacatatgaaactttaataattatagatccactagctagactgagaaacactaagtacttctagaaaatattgagcgttgtgagaatttgcttaccttaagtagtattactatttgtatttggagtcctctaaactatgcaaaaggatttaaaattggagatctttactaattaaattgtttattcatcctttctccagaaaaataaaaggtatgtctcagctcaatatatttcagaactatcagaattttgaattctaaaacagatttttcccattatacacacagtttatcgacaccgtgaaagtataacgtacaagcaaattatatatttatatgtaaaatgcatatagatatagtttttttttttttttgaaacagagtctcatttgttgcccaggctggagtgcagtggtgcgatctcagctcactgcaacctccacctcccgggttcaagcaattctcctgcctcagcttaccaagtagctgcggctacaccacacctggctaattgttgtatttttagtagagacgggttttcaccacgttggccaggctggtggcgaactcctaacctcaaatgattcacctgctttggcctcccaaagtgctgggattacaggcatgagccactatgcccggccatatacagatataggtttttgaataattgtctttcaaatactcatgccatttatgggtatgtatgcaattatatgcacaactgcatagttacaatgatataacataaatgaaaacaattcagaatactaaaaagtgttactcataagtaatatagtaaagtagtgtgaacactactggacaatattgatacaaaacacaaaaatgcagtatttcacattagcttttaggctacctgattgaaatgaccttttaaaactcttgtggagtctgataattgaacttagctaccaataatggaaagtatcatgatttaaagaggacagaatgttgtattttgtctacaagaaaaaatatattttctgtctacagaggagtataattaagatttagtagaggaaaaaccagtgataattgtcatattcctctctttcactctcagcatccaaatgatcactcaaaatggtcattttttaaattggtgcagtgcaactaagagctattttaggaatggttatttccataaaattctattctattttcttcagtcttactgaaaatggtgctttctgtctaaaccatcaaggtgttaaaacatattaggacaggttgaaacccaatgagagcaagtgacacattttaacaagattttataggtcactgtcttgcaaaaatgtaactcaaagtacatttatgggcacacaggaaaattttaacaactgagaaacctattcataaatcttgtacttattttaaattaatttattagattatatacatgactggcattgctaaaaaatgtaaacttgcctattttggtgaataacagtacaataatggtactttccttttccttcataaacaaaattttttaaaaagacaagagaaaaaaaatcaaataaaactaaagaacagccaatctatgaagaagtatttcctatggactgcactgaaacttggacctaggtaaaggacgaagcactaggtcaaaagccacccgagaggtaatggactatgcagtctgagttcctccaagggggggtcacacaatcccaaggatagacttaatatttatttacagaactcaaagtgcttggaattggggaaatgggtgtgaggacaaattgcaggagggtccctgaccttggggagcaggtctgactcagagaacacacaggctggctgttttgcatgaaatagatgatgatttagcaatgtggcggagaaaacgtagaaaacaagaagttctgtaactctccattttggtcaaccaaagagaagtacattctatcaccacaggtcagacctatgacaccagttcactatagacctaccatctgcaagtggagacagccacaggaaaaggtgttttggtaagggtggagaaagagacagtaggagaaacgtagctgactgcttctttagtttaccactactatattagcattcaataaaacttgatactgaaaacaacagctcccattgaacaactggaggtagaaaaaagtggcaaacagaaaataaataccaaaaatttttccaagatttagccagaaaatattgagaatctagtttcaatgaagtcaaaagaaaacacagattctctgaaacaagagtctgaagaagagatgaagaaagtaaaagtagactaaaagcaggaaaaaatggaagagtaaataaaactatggcataaataaaatccactccaacagttaattcttcctctttcaatagaggctcaatagatacagcataaagtgataatctccccaaaagggaacttaaatatacaaattacaagaaataaaaggaaggatcataaattttccagatttagaataaaactgcaaaaacacacagattgccacataaacacattctaaaaatgcatgctacttattaaaagagaaatttaaaaagaaacccttaatgaaaaaaaatgaatttgtaatacataaagaatttttacaaccaataagataaaacccaaaaattcaattaaaaactgggcaagtctgcataggaagttcatgaatttaagaaattgaagaaacatcttaaaaaacacataaaaattttaaaagaagtggctctaaacatacaaaaacatgtccaaccacctagtaaagaaagatcaatgaaaacgacattgaggtaccattggcaaatattgaaaagattgacagagagcgttgggcaactctcaacactgttcaaaggaagggaagtttggattcaaatacattggaggaaaatttggcaatctaccaaaatgaaaactgcacaacattttccccccaataattacatttttaggactttatcatacaaatgaactgaaacctgtttatataaatagccagtttaattaggccaagcctgcattaaagttagttctcaaatgagttaaacagtttccattttccactttcttttatttgtctatgtcttaacccaaaactcatgcaaaattttccagcatgatctctccccaaaatgtgagtagatgaaagatctggatggtttgtgttttcgagtgctattggtaaatcagaaattttttaactttaatgtgcaaatctcatttttacagtcccttattaaatttaaatttggtataaattgaaggagctcactatatttaaaataacaatagaattgaaaacctgacataggaagggcctgatacatcttaagaaaaatttagtcaagtataaccttaatatttatatacacaacccaaagtccatgttaattccacttggtattactatataaaagagattattatttatgcagccaaaaaacatatgaaaaaaagctcatcatcactgcttattagagaaatgcaaatcaaaaccacaatgacataccatctcatgtcagttagaatggcgatcattaaaaagtcaggaaacaacagatgctggagaggatgtgtagaaatgggaaggcttttatactgttggtgggagtgtaaattagttcagccattgtggaagacagtgtggctattcctcaaggatctagatctagaaataccatttgacccagcaatcccattactgggtatatacccaaaggattataaatcattctactatgaggacacatgcacatgtatgtttattgcgacactatttacaatagcaaagacttggcaccaaccgaaatgtccatcaatgacagactggataaagaagatgtggcacatatacaccatggaatactatgcagccataaaaaaagatgagttcatgcccttcacagggacatggatgaagctggaaaccatcattctcagctaactaacatcattctcagctaactaacacaggaacaggaaaccaaacactgcatgttctcactcttaagtgggattgaacaatgagaacacatggacacagggaggggaacatcatccaccagggcctgctgggggttggggggctacgggagggatagcattaggagaagtacctaatgcatgccgggcttaaaacctagatgatgggttgatgcgtgcagcaaatcaccatggcacgtgtatacctatgtaacaaatctgcacattctgcacatgtatcccagaacttagagtataatttaaaaaaagagactattgcggagactgaaaaagagatagaaggaagaaaaataaactaaaatctgtaaaaatagacatcacttttcaatataaaatgtatctcaaactttctgaagatattgcctccattttttaatctctaaaatgagcataggctggctgccaaagtccacaatgtaaatgttaacaaattatagtcaaaaatgcctttcaactacttaaaaaaaaacccataaaaatgtagttagtagtcgatgttgcctaaatagagtctcgaagcctacaatctgtaggctgtagaagtgaaccaagtcaaaatttaaaaacaggcttctgtacaacagattttctctgtatacttaactcacattagaagtgtggcatgtgttacaaaattgatgtcagatagcttagaagacttcatatgttttgaatgacaaggtattgaccatggtttctgcaaaagaaactaagcatcataaaaacagatactttaaacaccaagaatatcatcactccatttgttctgctcctttagaggtcctgtgtaattggaagtgaggctactggactacaatgttatcttttacaatgaactaccaaatttagatgtcagagtgacagttgaagaaaattgcttgaatgggaaataaatgaacagtcacagaataaaccaagtctacttgcccaggccttgtgttattaactagagggatgattactgcagcaagaagtgatagcttataaaaattctatgaaaatcaatatagatttgcagattgtaacttcaacaaagatttgatttgtcaaatattagtctaacttgctttattcagcacatgcatttctaaaattattaaagacaaatattcatgattgaaatctaaatgcaatattttttagaactcttgtttttaaatatttaaagtttcagacagaaaaaaaaaaatctattcatgggtagttgtcttcacttactatagtcccagaacataattgttgccccttgacttttattcgaagatttggcttccccacacaaaatttgtctttgtctaacacagtaacactttatgatgtcaattaataattattgattcattgagtcccttctaattcacttacattaccaatcagtagttcattttggtagaattcattccttatgtttaggtaaatgtggaaactttcttccaaatacagctccttcaaatttaaaagaaaagtgcctaatctttgtctcctggatttttggcacgtagttatcaatagaacatagtaaacatagcagtgaattgctgtataactatagtgtcaaaagccatgtttgtttaatgtgcctgcattctgccaaataaattaaattgttcaatcactgtttttgatgataataattatcatattattacccattcctaccttgcaaaaaaaaaaaaaaagcccagtctgcaattttgctggttaatttaaaccagaaactaaactgcaaaatggaaatatttaaaggaaagtagcctttgtattcaagcagggcttactcaaccatagaaacgtgagaaactcaagaacaaccacaacaaaaaaaggcttcttgatgcttcttttgattctaagggggaggtttctttagcttaattttttatattattgcagggaatccttcaccttatcaaaaccacacagctgttaaaaaataataaaaaataagaataaaaagcctaacactcattgtgcttgctgtctctttggaccaataaaaagcggaaagtatgagatgaacatgatacaagtatgtttatataacgggaagaacattaaaaggtagagtttctgcaaaaatgaaaatacctcaaacaattaagtttgttgctttaaagcaagattatagtgtagggcttgagataggaattcattagatatttaaaatgcagcaattattaagtctgtgctaggatcaagttttgcaatgggaatacttacccttggatctcagaggagaaagaaatacatccttctccattagagacctcagctacatgatagtaacttttatttaaaattttaaaaagaagagtgaccaaggtgttatacttattgtcaaaggcactttgcttccctagcgaaaacttgacaacattgtaatctttctctaacagacatgttgcaaagctgcttgccatcttgtagtcctatatgatttccttgcatttccagttctttaggaaatcccctgttttaatgatctttaagaggggaaaagacccttcaatagagaacttgctatttatgccaaatttgaaaaagtagccaaataaaaatgggctataaatgaggtctctttggccatttcaatccaatatagtcttacttctagcccccctgctttgactagggctctcatttcatgtaagcatcatggatttgatatttacctgtatgacaaacagttctacagaaggatagccttaccttttaattaacacagttagctacactatgaaagtagaaatattcgttcagaatgtaagaatgtttttaaaatattataactctctctgtataaataaatggagtttaaaacaacaacaacaaaaaaagcctaacatttgtatttagaagatacaaataactcaggagccacaaaacaacagtcgcctgttaagaatcctattaagaattctgactttttctttactttaaataagtaaataaataaatgttaaaaaatggagtataacactctactctgctgcttgctggctttcctaacaatgtgagcagttgacattgcttggccaagaggaactcaaaaaggtccgtccttccttccttccttcctccctccttcccttccttccttcctccctcccttcctccttccctctctccctcccttccttccttcccttctttttccttcctttcttcccttctttttccttccttccttcctttttccttccttcctttctcttcttctctctccctctttctctttctttctttcttagccaggagattttaaggagtcagtgtctagaccatctttgttttgatcaccaagctcagtagtcaatccatagatgaactattttagaaaaatattttcatgtcagtttgtagctggactgctttggtagcacacccattaaagcacaaactcctttaaattcacagtgctttgtgtctgtttatacaattcccaaagcataaaaatttcaggattggagctgaagggtgcacccatctttatttttctgcttttgatgcacccttcaaattgcttcacacccttctatacaatctaccttgatcagaaatatgtatttatcatactattaggggaaaaaagaaacatatgttctgagtggcaattaagttaccagcactgttaaggtcctggttattttatgtaatctaccatataactcaaaacatccaacaatattggccaaagacattgaccatagatagtgctttcttatcttttcctttctctctctctttttttttttttttttttgagatgaagtctcactctgttacccaggctggagggcagtggcaggatcttggctcaccacctgccaggtttaagtgatcttcccaagtcagcatcccaagtagctgggatcacagacaccacccaccaccacacctggcttttatatatatataatatatatatatattatatatattatatatgtattatatatataatacatatataatatatattttatatatatattatatatatatatatttagtagagatggggtttcaccatgttagccaggctggtgaacacctgacctcaagtgctccgccccccttggcctcccaaagtgctgggattacagatgtgagacactgtgcctggccattgatcatagatagtacctttaaaaacgtatctcaatctaccacttctaatctgagtgaaaccgtttgaattgggtccaaaggttaatcaagggcccctgtattttgttaatatgaactctctaaagggctttatatttacgatttgttttaagctgcttactaaagcatggtggaacatattttacctgctaaaaaatattctacaaaagcatcaaaactgaaagatgaaaattaggccttactgagaaaagaacccctttatgtccaaaacggtccaggataggctggaattcaattatagtatggcaaaatattgtgaacaggctgagataagcaacagctcgaagacttcttgggttgattctagtaaaaaattatttaaactacaaaataacttaatgatgtgtcactggcctgacaaaccattaaaataatctagaagtagagatttaattacaaataaagcacctcttaaaatattaattcctaaaataaaaatgacatgcttatccaattatatcacaatccactcatttcctcttcccaccaggctgaagtttctctttttatattttaaggcttaaaataacatgggtttaaacattttgatatctgtggcatcatttgtcagggactatcctattttgtgggaaccactcttcaaatcattggcctgtacaaaatacaaataatggtgttagtgttactacttgtaccttttccaccaaatgacccaccagttgcttatcagctgatacagttatctataaaacagccctaaggtactggtcatcatcaaatttataataatatcactgtcaacattttctgttaaagaggaaaatagatcaatctaaataataacagcttaaaagttacaaaatgcatcactataatgtgtatcttaataatgattagaatttcacataacatgctagcaaaatacttttgacatgaggaaaaaatgtttaaaactgaataagaatgtcctaaaatactgtatgcatttggcctcctttttcaccaaaatttaacttttttggttgtctgccccaggatcataatgaccatgatgattatcctagtttaggtaatttattaataaggtaatgactcattaattacaatgtttacataaataacatatcaaacaactctgatgaagctttataagtaaatcaaactgaaaatgtgctctgtgattttactaaagacagccacaaagctttaaatagtgcttgtttatagaccactttgaaagaaaaaaaattcacttcgtatctcttgttgacaaaatgccaagaatcattttcaaattagtagcgataaaatattaagtgattcataaatcataatggaaaacagaaaagttgaagtaaatataggcttgaaaatattatctcagaggggtacaaaataatttcaaatggcagtaacactaagccacttacttgaattttaaatgtgaatttgtcttgaaattgtagttcaggtttccctccaattaagaaaaagtattctattaaaaagctaagcagggcttgcataacagatatattaacgcctgtaatcccagcaatttgggaggtcgaggcgggtggatcacgaggtcaagaaatcgagaccaccctggctaacacggtgagccctcgtctctactaaaaatacaaaaaagtagcagggcgtggtggcgggcgcctgtagtcccagctacttgggaatctgaggcaggagaatggcgtgaacacgggaggcggagcttgcagtgagccgagatcacaccactgcactccagcctgggtcacagagcaagaatcagtctcaaaaaaaaaaaaaaaaacagatatattagaagtcaactattcactttaaaaatgcattattaatttatgaaatgattattaataagattgttttaaataaatgggatttcaagttgaaaatctcctgagattttctgaggttaccccatatcagaagcacacccccatatagccatgtggcatggatcctgatgaacctcagtctttggagtttaacaggctggggttggaatcccagctctgtcacttgttggccaaatattgtatttcatctattggaagctcagcctcctcatctgtaaagcgggagtaacaaaggcctaccttaaaaacgctttgaggatagcctgagacaactatggcacatcataggtagttaagtggtgattacattggttaacattaaatcagagaaaatactatgattcaggctctgacggcgctctaattgatagcttgggatctccctcccaatattctcccaagtccaaagtggacataggatgctcctattgagcctttcctgagggaagaatatgattaatgaaagggaggttttcctgtttttgtttggtttggttgttgttgttttgtttgtttgtttctgttttaaagtactggagatttgtaatttattttgaacaatgtttcaaaagggtgaaaaaatatacatttcagggaccatgttaaatggaggccaaggaaaactgtatttttattattttttattaaaaaatccataataggccgggcgcggtggctcatgcctgtaatcccagcactttgggaggccgaggcgggcagatcacgaggtcagaagatcgagaccatcctggctaacacggtgaaaccccgtctctactaaaaatacaaaaaaaaaaaaaaaaaaaattagctgggcatggtggcggcgcctgtggtcccagctactcgggaggctgaggcaggagaatggcatgaacccgggaggcggagcttgcagtgagccgagatcgcgccgctgcactccagcctcggtgacagagcaagactccgtctcaaaaacaataataataataataatccataatagtagaacaatggcaacatcacaactttgttctgtcctttttgtttgaaacatgaatgtgctatggagagccttagtgagtgaacaaaaccctctgcttggattcaaattctacctttccataactataataaagtcgcttaactttttttttgtgggattgttgaggctcaaatgagaaaacacattagaaaatatctggtgacttgacaaacatataaatatgagatactgttattattaatgataaagatgtgttcctggtccctgcactaaggaaggaagtgaggaggtccccttccacaaaccaagagctcaaagatgataaactgttcccaattaattcacaaattcagataagtaaggatcgcaaaaatgagacccagtcatctcagatttatttgttggtgcaaaatcttttagaatctgaatctgtactatgatcttgaagtttcagtgctcaagaacaaaagcaaaagtggtttctattagcagtagaaaacttgaactccttcccaaacatctttaaagactcatcatccttaaaataaacatatcaataagacagagttttaaactctatatatttggtcttgagaaaaaattttattaatattgagaaattaattccattgttaccataaaattagtcatttcccaaaagcaaagccctacttcatgcctgcagtatgaggcattgatacatttaatcaaaatgtcttacagttattgctttttagttttatggtctttgctgtgtgtgttatataacaacagttttggagcactacgtcagaagtaggaagcagaagatgtggctggaaagataggtagagcctgtatcataaagagctttatatgccatgctaaggattttgaaatttaccacttaagtgatgaggatctaccaaacagttttaagccaaggagagatgtagttctatttaattttaggcaggtcactcagtcagcaatgtagagtatttttaagacattaatcacagcctcaaactaagatattacagttgacccttgagcaatacaagttggaattgtgcaggtccacttaaatacaaatctttttcaaccaaattctgttggaaaatacaatattcacaggatataaaatctgagtgtatggagggaacacttctcgtatacctgggttccacgggaccaacagtgaaacttgaatatgcactgatttgggtatgatgatgaagaaagaggtcctagaactaatccccccaaaattctgagggactattataattaagtttgacataaatggtatagtttgggtcatactgttgacttcaagtatttctatttttatattatacttcctttcataatgggaaatcagatgaattctttgaaaatatgactcaattccaaagaaaatccaagttaaaatttttttccacaatttgttgactaattggagcagcaaaataattttgagtagtcgaggcaaacagatatccatgtgctttgagtgttggcaatatgtatcaattaacaatattatcaactctaatctcactttgaagtcaaagagtaatcaaattaaaatctttggcacaagttaagaacatagatctcttttaccatggatacttgcttaaactctttgagtcatgaataatttatctgtataatgggaacaataagatatttcacctatctccttttatttttgagacttgtaagctctgtgaaggaacactgtatgccttcttcattgttgattgtcaagctcccatgcctcctggcacacagtaggaatgaatcaagtgaatataaaaaagtattaccaaatgaaataagaatgtgaaattgttctgtaaaccttagaagtatcatacaagcattagtgctattgtttttgtttcacctattctgttattagcctccaactttttaagatgtactaaaaagacaataatctttcttcaacaaaatttaaaactaccatctctgaagatgcatttatgtgttaaaagtatttttatgcaaatgcttaagaaataatgaggagttctttaaaaattgaatctgctgcctttctaaatatctttcttgtttaaaacacaaaatacatatgccaaaatgaatcaataacttccttgtctggtacagaatgttaaggcttgaatttgaacaaagaagctgaacttagctttggatatctattataaaagatatccaaatgaagaacgcattgacacaatcgttaattagtattcattatactactcctcaaatagaacgatatcaggtctcctatatatcagtgattatttctcttagcttatccaagtttttccttttctactgcacataactgttacacatttgaatctgtaaccaggttttatgatttaatatatgctctgactgtaacacctatattttctgactaaatgcctcctgtatttcaatggacatctcctgtagcccctattaaaagtccctctccctatatccattcttctcagaaacaggctcatttcttctcaaggctagatttggagaactctaggtaaatgccaaaacaaaacaaaacaaaacgtaaaacatctttctctctctccttccctcattctctttccatgctatacttttcctaaccagagtaaagttccttgggagaagtgcttattttcttcaccttgccacatcagcaaaagcaaagtgatgcatcacaaatggtattacagattcctatgattctgagtcttcaatgcacattcatgattgagacactgctttctcttggaaattatggtgattctctgacataacactggtacagtgacctttgaggattctctgtcaacagtcattgatgaaagataacaataacatttcagttccttaaaagtggtatttctcttcatgtcttaatccaaggccgatactgtaccatctacttggaatctcttactcatcccttctcctccctttgcctaatgaacactgttcactcagcaaatgacagtccaaatgatgttcccctatggaggcctttgctggcctccctcactaggtcagggtttcccattatgtgacatcacagcatcctaattcttcttctatgacacttaggatggttttaaaattacaacaccttggggattcttttaataatggctgcctcccacaacgacatataatcttcatatggaaaaaggctatattttgctttccatcatccacgtaggggagtgtctaccacagaatatattgtagtcagtaaatgctttctcttctgtttatccttactcaccaaaccaattctagcctcctcccactcttatctacttaatgtagaaaaatcagtggggctaggcaagagattgttcttgatattttctgtttcttttcaaatttatttatttaaaaaattgtcatacaaaatttatatatttatcacatacaccacaatgttatgaagcatattcagtaacaccttgcttaacctcatggataaattactggaaactgcaactttcagcaaaaagatttataacaaaaccattttaccacaggctaattgattaaaaaaagagttaagttcctggtcacaaaaacatcaccaaacttctgtataaagactcaaaacacttctaatattaaacattgaattaaatgtgaaatatatatacatttaagaaagattaataaaaagataattatttatccaatttttggtgaatcaatgagtgatggcagttgtagttgtagtgggttaaatcaaggaataaatgtttgcaatgcaaaaattctaacgagcaccttctaaaacaaacaagaacaaacatggtgtgcccactgagtgctttcaaactgcattccttattgttgtgcatttgaaagattattgcaagctttatgaattttttattttacaataatttgtatttatttattcattcattcattttccaatccactcattctagttcagagtttgggatggttcaagcctatcccagcagctcagggtgcaaggtagaaaccaagcctggacaggaggccattccatagcagggcgcagtcacacacaaccccccacacacactcactcagactgggacagtttagacacaacaatgaacctaatgtgcacttgtttggaatgtgggaggagattggaatacccagagcaaacccctgcaaatatggggaaaacatgcaagctccacacagtggtcctgaccaagaatcattttttttccctcactaatgttataactaaaagactgagagaaacattattcaaggacctgttgtatagattgtaaaatggtcagatgagaagtatatattttttagatttttacttaaataaaaagacagcaggtagtaatttaaatgtttcagtatgcctacaatctttcagaaataacttcatgaaattcaactttacgaaatgatcttcaaaatacccatacagcacacctttcaataaacggagtttcatttgacagtgtataaaagagtttttttgaaaaacaaaaaaaaaacttgaaaaaatagcaatgcatgatggaataaggtattctcaactttcaactgttatagagaataatagaaaattttaacaaacagctacctaagaaaagatatatctctcaggtagatttttaaatatttttaaaattaacagataaaattgtatgtgtttaacacatacaacatattcttttgaagtatatatacattgcagaatgactaaatctagccaatttacatgttacctcacatagttatcatttttgtgatgaaaacacttcacatccactgtcttagcatttttcaagaacacaatgtattgttaactgcagtcaccatgtacaatagatctcttgaacttacttctcctatctaactgaaatttggtagtctttgaccaatatctcccaaactccaccaacaccacctcactcctaccccctagtaatcacaattctactctctacttctgagatcaacttttttcgaatcaacatatgagtgagatcatgtagtattcttctttttgtgcatagctatttcaattcacataatgtcccccagtttttccacattgttgcaattgacagaatttccatctttattatggctggatagtagtctgttgtgtatatatacctttttaaaaaatattcattcatccattgacaggtagaaaatttatgtaaagcagttaactagcaaaagcagttaacaataacatcttaatgtgccacagatattatgtgaagaggtagaatgataaaccaaaacaaacagccaattcatcaaatcaacaaaactagaaaaatctctgacatcctattattgatgtgagtacattaaaaaattgtgaggcaaagtgactgctacaaagttgaaaaaatacttcacataactcataaatatatagaaattcatattatcgcagaataagcattaagataaaattagaatttgcaattaagtgttcttttgataaatgggaaattatttttagctcctaagatacagcctggctttttgtaataataccattgctgctgcttcttcctcttcttcctgttatcattattttacaatatagacatgttgattttggcatttaagtgtaaattattgatgaatagaacttatattttgttgaaggtgctttgtaatttttaatattgtaaacatcatgatcatcaataagtacaggcttgcaaattacttccctacatgacttaactgagcttaatattttttcaacaagtatataaaaaataataatccagggaactatgtgctaaagctacttacgttcagtgctttacatgttttgtgtacctaggtctcacatttaatatcatttcctataatttcctggattgaaaattaatcagacagtgtcttctctttctacattcttcttctcaaaataataggacaaaaatgtttaatccttctttatggattttaacatgccattagtgctggaaagcatgaaaaatattacaggggaaggtaaccacaaatggataggagactaaaaattgacattgttgtcttccaaatgttcatataatttccattttaatgcttttgttttttagatatatttaaaggtatgttctcttctttacactgcccagagatcacattgtctgaatattagcaagtcttatttccctaagatggaaagtgcaacagagggaagatgactaaaaatagcacgtctctcaagatgtttgctttctatcacctgactctaggatgcagtcttcattagggtacaaatgtattataatggaatggtctgatttctgtttccatattttatgattctcatagtctaccacttgttaaatttaaaagtacattttaaacagatgaaaataagtgttagttgcttgctgataagaagatttaatttcccatatgttgcagcacgcttaattcatttaagaggtgatattcaaaaatattacttagtatgtattaaatttttatctttaataacctaggaagtttgctagcctattatttcctgatacatgaatttataaataatctggttatttgaatttggaatacaaagcaccctactgttgaggaaaggacctcgagggcatgtatagacacaacaaagagggaggtgaccaaaataaaagtatgtattattgatgcacaacctaaatacatctttgaggctttatccagtggaaaaaaaactcaaataaatttttctcttggatgttcaaacagcatgtaattatgttgtatcatatgaataactttccatcaaacatttactgaacaccaattttctaggagttttatttaacaatgaagctaaagcagtggttgtcaattggagaagattttacttccagggacatttgacgatgttgagagatagttttgattgccatgactaagaaagaagtgccactagcatctagtaggtaaaggccagggatgctgctaaccatcctacaatgcacaagacagcctacacagcaaagaattacccaccccaaaatgtcagtaatgccacagttgagaaactctcagataaagacataaggatgacttaaagggagataaaaatgaagaaagaataccttttgtattagtctattctcatgctgctaataaagacatacccaagatggggtaatttataaaggaaagaggtttaattgaatcacagttccacatggctggtgaggcctcacaatcatggcagaaggtgaatgaggagcaaaatcacatcttacatggtagcaggcaagagagaacatgcagggaactcccatttataaaaccatattatctcatgagacttattcactatcactaaaaatcacgggaaggacatgtccccatgattcaatcacctcccaccagtccttctcaggacacgtgggaattatgggatgtacacttcaagatgagatttgggtggggacaaagccaaaccatatctccttttaaagaggtgactgtactaaccctaactagaagagatagctccatgaattaaataatggttgaaatgagacgaaaagtcagatgcagagattgtagggaaagagcatagacaggatacaacaattgagcggctataagagaagctcgtaagaaaggtgaggaatctagggcaattcccgggtttctgcttttgatgacctagtagcaactcacagtatattgagatagggaacgtataaggagaaatagaactggatgggaagttagcttggtttgggaaatgacttagaggagaatgaataacatgtaaatggagccagttgcaaagaatataattatatatgggaatgtgtaaatctgtagagccccaaggttaatattaaaaagacaagaactagccatcaaataagttgaaattttacaccatagatattactattgactaaaagaggtagctgttaggtgcccttctcacaatgcaaatgaggagtgtggatctgggtagctgtgattacccccataatggtgaagttcccctctaagtcacttatgcaaattttagtagtaatgcttcccccatctaatattattctccacagaaatatccacttattcactgccttttcatatgaatgtgtggtataaagctggactgacagaaaaggtaccttaatagaaaccagaaactgatatatttgctaaagctctgtattatttggcttctttcctgctacatgaagtaaaggccatttcactgtattcctaaaggcaatttactattagctatgaattttcaggtaggcttaattaatcaaggtcttaaattaaattgaagtatttattacaagtatatgcatcacaaacatatttatataatttataaatagatttgtgtataatttacttgtctgcaaaacacacagtaccttactgctattgatttcaagtagaatcaagacacttggattcagtgcacaggaaggaaatatgatatctgtccattccataatcagctaacctttagcaaattcattaattttttaaaaggaaaaatataatatttagaattccaaacctcaagtggtaatcacatttcctgagacaacccagttattgttagcacttatatgctaagaaacaattagaaattaattttttagtgaaattagaatccaattaagcaagacagtaagttataatagtgagaaaatggctttcagatttgttcagaataaacgataccagacattttatctacttcagacacatgatgaaagtacaaactctgaaagttcacatttaaaaccaagaaaggagaaatcaacaggtgaagctcatttgcgcaaaataattaacgacaaatgagtagtatttctttcccataaaagaaaagattcatgtggcacttaattatttcatttacccaatacttcgcctgaaattgaagaagctctttttcaccagctgctaaacaaaagcaatttattcaattgggtttgctttgcatgagttgttctgtatataataagggaggaagaaaataaaaatgtgtaagtgccacacttccttccaaacatttttgaaagttatttgtggttccttgatacaagtcataggcataacaccaggcctgcactttattgtaatcattaaatttgtgtgatttgagtattctttcttattaataaactgagaaaataatgtctggaggaagagaaataagacagtgctagtttcctacgttctctagccagctaggcaacaagctctccatgaaggaggccaagccactggaaccacactcccactgtacagcagagaggactggagggggctgttctgtgggttcccaatcacctgttgctttggagttagaatgctggtttaggccaacatagaaatggaatttggttttaaagaaataaacaacagtggtaaaatgtccagatctcttctggacaaaacatggggccaagaaaggaatgtagctgttctagaaggcactctgctgcatgtggctgacagtctgactgaataatgagagctttcgtcaaatgcgactggcaaaggaaccctttccaaactgcattttttctcagggcctatttgcctgcagttgaggtgcaattacccgtcaaatgtggatgtaatgtagccacgtgacaccagcatatttctatttctagaaagatagcagagaaaaatcccctagtgtaatcatgttagtgtatgcttactgtcggaaggaaagggattttttattttgctcctggagttgaaccacagaagttgaaaaaaaaaaaaggctctgaattaaggggaaaaatctgatgttaggaaacattggctcacgtgcttcccactttcaggaactgaacagtttcaacaaataacctggtttatttttttcccagatgcatgcatctattaaagcatttctcttcctccaagtacataaatgaaatacgcataactattttaaaacgagttaagagtttaagcttaagattttatccttaactgcttaattgggcacccactctacactagatatcaaagggcatttgggccagatttgtaagaatatgttcaacaggcgatactttgccaggctgagaaatcaaggtggccagatgttcagcagtgcatttgcaacccatgaacccagctctagagaagcattcatccctggaactgagactccctgaaaaagccatcctcccatggatcacaagggaatttccccaataccagctagaaacaatttaacgaagcccgaagcctgccgaattttcaggagatgagtgtcctgctctctcagacatactgttctgctatttttccctaaggacaaagtccctaaataaatccaaactgacttttatttgaaaagagcaagtgtagattggtatgtccaggaacttaagtcacaggagcaataaattctagcaccctgtttcctctaaacaaaggggcctgcaaaggactattggtatttacgaggactgcagaggcttgagtaagcattttcacagcagccctgtaaggttctaatgcacagcagtactactctatagccagcttattaaaccttaatggcactcttttagtgttgtacaccaggacggtagataactcacccacagcgtggcttctggaagctgccacagcactgcaaccattctgcaggttaccacccttcaacttgaaattcctagatactggtttcttcattaaaatcaggagtcagcaaaccaaggtgcttggccaaatctgacccactgcctctttttgcattgctattagtaaaggaggttttttacattttaaaacagttgacaagaaatcaaaaaagaataatattttgtgacatatgacaactatataaaattgacatttcactgtccataattaagttatattggcaagccaccacacccattcatttaaatattgtctagggctgtttttgtagtataacaggtagttgaggggttatgacagagacttatcaccccaaatcctacttcctggctctttggagaaaaagtttgatccctgatttgaaagtactatcagtcattttcatcctttaacaggttctgaaatgcattactatcaacttaaaggaagactccatgtcagcctctttaaccactggtcaaaatgaatcatttcccaacagtcagatccattgtccccacttaagaaaagcatgcaagagctctgggtgggctaagcaaggatcaagactaaaatagtacctttagaaagctctggagttgctccagcaacatatagctgaaaagtagtatcactgatatttttttcaaactaacataatagaacttgttctcttcaaaggagtaactttgaaatttgttgcaaagaatctgccaatgttcaaaacatatttggagtgcacctttgatgctgcctttagaggctctttttaaattatcttttaaacaatctcaataatgccaaatcttgattcattatacttgagcttgattcatatttttaatcttaagtcattcagaactacaatcagtgaataaaagggagaagtacattgcctggaatagatggcgacctcaataaatattagtgaaacgaattgagctggttcgatataaagtgacactaatgcaacttaaaggaataaaaacctactgaagacatacatatccatccattatctgtgcccctaagcgtacataccccaagtctttctgattctacatttagttttcaaatattgctggctttctgggaatctgcatgattttatctgattctccactgccttcttccattcccaagcctgcctcattgtcctgcatagaactcgtctcagcccctgcttgacatctgactgctcgctctggacttcagttgtcacatctcttttccatctctcagaccacttctgatcaacatgcccatatagttatatacaccagtgatagttctcggcccaaagtgcctttcatattcacatacttctctgagggaagtagtcataggtttccacatgcatgatatggcaagccttacatcatgctaccctgtccatgatagactacacggatgcatatcgaaggtagccctgcatagggaagaagcgggggagacagggatctatgaagctatgtagcaaatgcctaaaagaacaaaattcaatactgcttcgtagatccctgtctcccctgttttcccacagcagggctacctttacatggaactcaagtagaacttttcttaggaagacatgatacactggtataagtaaaggagaaaggaaggagacataggaaatgagcggtctgtagaaatacacactgctattagaaagagcagtgcaccctcagaaatcagtcaagacagaaaggtgagccacagaatgatgccttcctggaggcagggggagatagtaaacttgcgagttcaatgaatttgctataatatcccaagtagtgtaaccatgttctagttctttaggatgcctggctgtgtgactgcaaggaaggtttcctgtgttttctcacattcctatttttcacagtaacctaaatgggtctcttcattgtaacctgaataaatctgtattcacagaaatgaaagtggttttctgttcacttactaacttggctatgacttcaggagcagagaattctaaaactgctttgagtaacatcagtgtctgtgcactaagtgtatataatcccagatgacttactaaaagaaccaaattccaatgaaacctttggtaaacttttccaaatagagcttcatgactttaaagctgcttctactggatgtgtcaatttatggagtaaaataaagtaagagcaaaaaattaatttacaatactttagggaatgataagacagcctaaattgccaggtagttatctgtatagcagtgtacattgtgtctaagtcttattttttaggaattgctcaatgtttctgctatgcttaaacaaaaataacaaattatttatttacagtatctgaaaacagtaacaacagagacatttatagatttatgatactttgtattctgttataaaaataaaataaatcagaaatagcaaatagtaatttattcatttatgtgtttattaaaaaagcatttactatatgctaagaactgaagacaggttgtataaaatgacttctctgttctggtgaagttcattgtgaaggagaatgacacctaaatcagcgatacaacaaagcatcaaggagggacacctgatccagcctggggtggagaggaggtagagtttaggaaagattttctggagaaggaatggtatttgatccaaccctgaaggatgaggtacatcctgccttgttgggacaggctgatccatgttgtttgatgagtaaaatatcagaacttgctggccaaaggtgcatcatcactcatcactgaagacacaggaataatggatctgttttatttccagagttactttattaaaatactaaactctcctgggaaagtttaaattacaagtctgtccaggtaaaaccttatccctatcagtcgatggaggaacagacgagacagaataaagagggaagaggaatggtttcttaggaattactgtttggtccagccctggctatggacatgtaagaatttgatttgggcaaactatattaactattggaaacactctgtttgcatgttaaatgcctagaaaggatgaatcatacatatttcctatgttccattttctgactctgttctttttcctgtttctgctttctatgccctggccttcctccctaccctccattgagggtacaatagcatgtggtatcaattaatgttaagttttgaaacttaagtttcagtaaactttgggtcagcactacaaagaacatctttatatctacatcttttaaattcaacctttgattataaggaaccaagagagtttggataggtcaatgaaaatctatcccaagtcctacaaatgtgacacaaggtaaattttttatgaaagatcattagacaatattgttcatgttttctatttttcttctactcaatattaaatgggaatatcacaaaatattgaggaagagtaaataattgtttaatattaccatctttagcaaaaaaaatcatttactactgtaatctctgaatagaaggaatatgagcaataaaataaatctgaatttacactccaatattgttgaattcaatcttgttcaatcttgttctataaaacatctttcacaaatgtgggctctgaattttattttatcctgtcattgcttaatttaccagattctgaaccagtcttttgggacatttgcagactgatttctaaggcaatctgacaaaaataacttgaaatttcaatgaggatgaagaattgctctttaaagaatgaggaagtcagtaggcataagggaatttctcacaaaaccgcaatgcagaccacttcacaaataactgggaaaattctaaatttttactgcactgaaagacaattgggagagaggacaaaccactacttacctgtaaaagcttcaccagtttattacagtaatttccctagaattcaccctaaagttttttgaatagagcagcacctttaaatctgtcttaattatcagcatatgcaaaatatagaatgattgctttacaaaagccattactccagatgtgcagactaggtgaatttcctctgtgggcacggcatttctaggcagacaatgttaatattcactatgactatataaagatgaatggaatgcttaggtttcacgcctacttgataagtaatcattttagataaattatagattgattacatttaattacagaactacaatgctcatacagtattctaagcctttgtcacttatccatctgactctctacacaaaggaatccctgaaaggataagtgagagaagcaaatgcttcaaaagctacagatttcatgcaattgccacaagagttgtgaacaacatcttttttgttctttcttttttaaaatacagatcatggggatacgagtgcagatttgttaaatggatatattgtataatggttgggcttctagcgtgcccatcacctgaatagttcccagtgtctgtcacttccctctgcatatccatgtgtacccattgcttagcttctattattattattattatcattattattattacttgaactcctgggttcacacaattttcccacctcagcttcttgagtagttggaacaacaggcatgcactactggctggctatttttaaaatacatttgtagagacagaatctcactatgttgcccaggctggtcttgaactcctggcttcaaatgattctcccacctcagactctgaaagtgctgggattacaggtattagccacgctgctcagccagctgccacttataagtgagaacatgcagtatgaattttctgtttctgagttacttagaatattggcctccacctccatctatgttgctgtaaaagacacagtttctttctttctttttttttttttttttttgagatggagtctcgctctttcatccaggctggagtgcagtggcacaaccctggctcactgcaacctccgtctcccgggttcaagcaattctactgcctcaggctcccaagtagctgggactacagatgagtgccaccacacccagctaattattttgtatttttattttttagtagagatgggtttcaccataatggtcaggctggtctcaaactcccgaccttgtgatgcacccgcctcagcctcccaaagtgctgggattacaggcgtgagccaccgcacccggctggtttgattctttttaatggctgtatagtattctgtggtgtacatgtaccatatatttttattcagtcacctattgatggacacttaggttgattatgtggttaacatcttcgatgatgaagaaccatggagttggcaatttggctatgaatacaaataagaagtagtgctcatcaggtaactatagcttgcttttttaattcacagaactacctttaaatatattttattgcctgtaccttacaagcatcagaactaaagctcataaagattataggtaacttgtacaaagctaacaggttgagaatccaagttcaaaaaaagctttactactttgtcataggaaattactatggacttcaccctaaagttaattcagctctgccctatttcaacgtttgcattctcttttcactctgccataatatttcacaacagaagtctcaagtgtaaagactcaagagaaacaccgggtggtaatttaatcaagacaaagttcctgggataactgtttatattaaaataattaaaactctaaaactctaaagtgtaatgaccatacaggtgatataaaatgtgcagctgagtagagaagagagatgtaacttttttcttagtgttgaggaagtctttccaaagagataattttaaaatgggttttaaaggatgcataggagttcaaccatgtataagggcaacatgggtgacctgagcaaaggattagataaaacaaaatccgggcacttgacatgctcagggatcaaatagtccaatgtggctcagggtttgtatcctccttaccttcctctttttgtgatcagcacatctcaatattttagctttccctaatcggcttaattttaatattaaaatattcaatattaatattaagattaataaaaagacaaaattttgaaatgacagcaaattcaatgatgaaattgccgtaagtgctaaagcaccaaagaactaaactaaaaacagttgcacctcttcttggctccctttcttcagggtcccaatatctttaccactgaaaattatttttttaaggcacagatttttcaggaaggaaaggaataaaattaacacaaattgaatagaaatatgaatagttcaaaattagacttttactctcttttagactttctaattccaagcaacactatccgacaggttatgatgcctcagtttgatgacagcttttttcttgaacacttgccaggatgaggaaacccagggaaattttcatgaaagacctcctaaaaattatgtgaaaattcaggcaagtatttgaggcccctgctagacttttttagtacatctgtaaatttacagattttttttttttatagaacaagcaaaatcaccaacttaaaacatccatgaacctgaacaagatattttatccaccacttctttccttcccaagagggagattctctctaatctcaggaaacaaatattttcctattgtgtggttcctcagacctggcttttgaaatttctgctaagtacacagttgtaatcatttattacataatctatttctaatgtcttattctacacataatgtttgtgaaatgcatgtagcttagttgtctgtggatatattccttgcctcttgcaagattcttaaaacagatttttatgattaataggtgtctctgttgctaacctcaagtcactcaaactctccttttgaaatgaacatttatttcagatagtacatgctctctgcggatagcctgtccacttttcaaatgtaatgtcctgtcttccatagatacgaaattttcaaaagatattggcataatgcaggagaaaatgccatccttttattatgttcaaaattgatctgacccctgaggtagcactttggggaattgggctacataatcatgtagaccctttcaggaaatggcttatttatggatttattttttatatacagaagatttcacacttctggctttatacaattgcatcctctcttcctttccaatatgtttccaaagtaggaaagctatatatggcaggagaactgaatttctatatcagctagaaatctgtcatctgctatatattggctctaatgataatgctttaagaatacatttatcccatatatgcatccagtcctctccagcagaacttttgcagttctcatttactgaataaagtaatgctaaagatagtgctatatcctggtcattgtccaatttttttttttttttaaaactgacttctaaatttattttttaaatgtctttttccccctgaagaattgatgtattttacactcttagataataaaagtttagtaagtctgcatgtgttttttctcactgcttagtttacatttagtaggtcatctttattgtattaaaatttaaggaaataaatcatattaagtacatattaaaaacatagtataaatatcaagcccttgttttgtctgaactttttattattcaaattgttctttatttttaaaagttaaaggaagaaatgtagttaatctgtatatccacataaagcaacacaagtagtccaactaaacccgctgatcttggttccagtcctttcgaaatggctatgttttaaataaaacctatttccttaggctaacaaacagtctataatccattaagtctttatgaacaaatccaaggcttttgaaattagtgcttggggaagaaagagtcaagtaatgaatttcaaagaattatgaaggtgattaaagaggaacaaaggatcaaactcccatcaccatgatttctagaacagagcctatcaaatgggcatttgggaattttatttatcatctaatcctgaatatgaaatagaaggtagagggaagaaggcaagaaacagtgttaatttagaaaggaggtgggatagagaaatagaaaaaagaatatgagagcaatttttctttaatggacatttgtaagctaaagagcaaccaggaaaaggtaataatactgacaaaaagagccgttgtttctgaagtttcaaaatgtcattttaactttttaagctggactgagtaaattgggtaagaccaccctgatcctagtgatgccagagatatcttagttacaaacaatggtttgagttatacttgttgtcacagaactgaaaattgcaaaactaattttctcttatgtactcaagtgtactatggaaaaacagagatactacaaagccaccaactccagtgggaaagtcatctctgtgctggctccaggagggtttatctgtggcagagacttaaaattgtcccattaataagctttctcattggcttccctgtctaggcagaattctgagctggccacaaggccatacaatataaagaaggaatttttcagtctcccttgcagctaagtgtgaccatgtgactaactctggccaataggatgtgagcagacgtgatgaggtccacttctaagccatgctcttaaaggggaatgtggtctttccctatgagaatggccatcttgtttttgtttttgttttgagacagagtcttgctctgtcacccaggctggagtgcaatggcactatcttggctcactgcaatctccgcctcccaggttctagcgattatcctgcctcagcctcctgagtagccgggattacaggcgcctggcaccacgcctggctaatttttgtctttgtattagagagggggtttcaccatgttggccaggctggtctcgaactcctgacctcaggtgatccacccttcttggcttcccaaagtgttgggattacaagcatgagccaccacgatcagctgagtagccatctttgaccaagcagataaggatgcctcatagggttagtgaacaaaaatacaaaaagagctggaactcctaaaaattctccagaaaagagccatctcacttgttcagatctggttattcagactctacatgagaagttagatgtaaacttctattttgcttaaatcatttaaatttcagcctcttttcctgcatcagaacttttacaataatagcaaacacactatagcccttaccatgtgccaggcagtgtcctgagtgcttttactatattaactcattacataagactataatttaaaacataacattattatttgtgtctacagacacagaattcaagcactgagaggttatatggttgatccagggtctgaatccagaaaatctgactccagagtccatatacttggtcataccatttagcacaacatcatacatttaacatatattaagggaacatttgtttaataagttaacaggtaatctgtctgtttaaaattgcataactgtgtttagaagtctcaacatcaacagattttttatgtgatctctgattttcttcttcaacaagggaaaagtcatcaatttagatggtaagcaatgtcctgtagggtactctgtaccctgcaaccttttatgtagccagtttctagcatctctgagaataccctggcatgtcagctactgctgagcaaagatgtgctctgacaatacaggaacacaagagaattgaaaaggagcacagatgaacagcatgaagaatcaagatgaggcccattgcctatttgttttccattctattagcatggtgcctactaagtgccagggaccaaatgtttggtgacagtggaagaggtatacaaatgaatgagacattctttccctcaaagaattaaaatccagcctcctttgagtacaaagtctttccaaagatctcttttgtgttcttcccttaactaataggcctctcgaggataagtcccagcaaatcatttttcagtggaatggaaaaaggggaatactgacaaacatgaagaaatatttttttaaaaaatttcttttaagaaccagaagttgttggggcaatgaagatatgtaggaaaaaaaatgagaaaaaaatataatgaagttagttttgaaactaagttttgtggcaattttatgacaaagattagggccatctctttgagatttttttcttctttccccaagtatcaaggaatgaatccttgaagtttcttttttgcagagatttaagttttcaacttttcaataatgaatagccactttgctttagataactttaattaaagtttcataaatgcaccaagagccatagggctttttgtattcttgaaataatgaataatttaatcaattaatacataatgggagcaaatgactaattgcagattcaagatacattttgtcaatcatctttattgacagttatagattacaaagtccaccataccaaaagtcaagaatgccttgattgacaattaattgctaagaccaattccattatcatgacttctgccctctattttccaatttggaaagcgtgttgcagtttcgatttatacactgggaagttgtattagtatcaactttagctcttatataaatgtggcattttaaaataaacattctcccaaattaatactttgtttctgcaaacatgagcaccaagcacatggctgaaaacatctttcattacgctagtttcaagaaaaaacactccttttcactgaaatttaatttgtaagacatttagggtatccctacactatatttttaattgaattttaaaggaaggatggagaaataacagttccgaatttgttggatatttattattttgaaaaataaatctgcattcatttatttgccatagtctaccaggccatccatccatccatccatccatccacccatccatctattcatttgttcatccatcaacgcatacatagatactttatcttttaagagtcaaaaaaaagtttttgaactaaagtccaaaaggaccttccgaactcagtctgcctagaacaccacgcttgagtcaaaaattctggaaatgtgttgctgtaaactcatcttctcatctggatctcattggagtaacataatccacattttcttcttttaagcatatacaaccccagaacacatccaatttgttcacagctatctgcataattaatcagtagtctttaggttcactccacacttaaattttcacatatctatgcatgcattggatacatacctcacaggatataatttctggacaaaagaatgttacttagaatgatgagcgtctgataaaactatggctatgctctcaatatcaagacagtttggctggtatggaacagacaaattaattgaaactcatgtaagttttattaatcacatttcagagtggccacatttctcttctttggctttatagtctttacagccaacttaagtcattatcatgcattactcatgacttgtgtatcatgtctatatacttccacacttggttatccctctgattgagagcactttgaaatcagtccctaaacactctgtgttataaatattctctgtaaacctttcatgtgtatttgcatgtaaataatgaaatatttgataagcagaatacaccacaaaaaattacatcaagacaaaatttattgaaaagcatcctgatttttgtcgttaaaactcataaaactagagcttaatcacctctagattctttttacaaaagttaggtaaaaacaatttccatttacattttttctacttactatcctatgacctacatagttcagcataattaataactggaaatttttgacctcctctgtgtatttgcaaaatgtaatattcccaagtataccttagcagagtcttctgtggcaaaaaaatattcactaagaattataatctagaaagcctttgtctatctatatagcttcagacaaaatagcattttatagatcataatggtaatgtaaacattcataacttaccccaattagctgaaagtcttgacatataagattacagccatagatcgatgaagatgcagcagaaaaggtatggcatatttagaaggctagttacactcatcataacaacagaaactaaaatatgtattcttttggttatctattctgggcacaccgaaataaattgtgaaccaaaccctataaagacaaacccaaaatgtacccagaactgtgcacattaggtaaatttttattagaatacaataggaattgaggacaatgcggtcttattaaataaactattaataaaaaggctgaaagggttgaagattttctgggctctctggagatttgaactatctttgattaaatgtgagctaaaaatactccagatatcaaaaacaaaaacttgtagtggtagcaacgaactataggtatatgtagtacttattcattccataccacaataattcaaaaattcctaggagccagctaatcccttttcagcatttgtgctcagggacttcttcactttttatagctgggtaatatataaacacaaatgtccctcctttttacttgaaccccagaggaaagcagttttacagagctatggaagcagatcttattaattaaagtctattttttgttcctctaaatttatcttttactatcagtgtgttgtgtgctaaggaatggattctaagacttatgaaatgggaagcatctatcacagtgttcaatgcatgctaaataaatgttcatcctccattaatataaaggtactcactgagaccgagtgtggtggctcacgctataatcccagcactttgagaggccaaggtgggcggatcagaaggtcaggagttcgagaccagcctggccaacatgttgaaaccccgtgtctactaaaaatacaaaaatcagccgggtgtggtggcgggtgcctgtaatcccagctactcgggaggctcaggcaggggaattgcttgaacgtgggaggcagagggtgtagtgagccaagattgctccactgcactccagcctgggtgacagagccagactgtcttgtagggggtgggatggggcggaaaaggtactcactagtttattaacttggtaaaattaaattgtatccacattaccagcaggcaaaacaagtgaagacttttaaaaaatgattttacagactcaagggctgattccttttcagaaacagaaacgagttacagagctttcaacttttatttatataatattatccccgtaaggtttaaccaagaagataaagtagatgtgattggcaaatcttttaaaacttgatgtacaaatgtttgttaaatatccagggtcctaaaaatcaaatagccatttaattttgtaaacatgtttttaatatagtcttgtaattccaatgatgatccaataactagatttaaaatttaaaaattcagtaaacacataccagaaacaagaaaaattttatttgttaaatttaagatttaagtcacaatttcaggccaatggattcaaaatactttaaatcttaacttgagtcattaacaattaatactaaatatccaatgccccaaatctcctttggtcctagattagctgatgacaaatgacaagttgattgctaataagcatagatcacaattttatgagaaagtctatttgtggcttgatattctcattaatattatcaaagtccacacttccaaaaattcaaattgcttttctgtaagaaacacaagacagagtctgctctaaattggtattcccaatgttcctgcccttgggagttataaagaaggtaaaaagctatcccttcttttccctgccaattctccgtccttccatgtgagaacagactttcagaaaataacattttccttctttcatgatcaatttagccctaccttattttttcttggctgaattggcccccacctgttgcctcctggttttgttaattaaaatgagacaagtgaaaagcactgacaacctagaccttgtgtgattattaaagaatgacaggtgctttggaaatcaaacctaacaccaaacataaagaagcctttagacctctatcttacaagataattacattaatcagtgaaaaactagattaatctattggggagttaagtaactgaaaatgggacaccctaaaaaattacttggtacaaaataagaaacaaatgtcagtgaattcattgagtagtctgggacttctttttaagtcactatggtattggtcttttactaataaaatagatgacttattaaagcaatatttacactgattaattcacaacggcagtacctgagacccctaagaaaacaactattcctttaaaatccagcctgaaagtagtgctcaggtgtacacactgagccttttgtctttaacttagcaaacactcagttcaaaaataattttgtcattcagaggagaagctattttatagataaaagattatgaatttcacagctgacttgagctctactcaggtcaacaacattggtttctactttgcaagtaggatttgttctgtcaatgcagatttctcagtaagtactttcccctttcaaagaaacatttacatttttttatataaatcaagtcactgattatattagctcagattcacatttgatgcacccttgtgcccctcctcctacacttcagctaaaatggaaacagactttgtttctaacttttaatactgacatttttgagtgtaatcaaaattccagagtgttggcttagatggagttctaaactgaagaaaggagtaagggctaaggtggctttttgtttttgttgtatgtattttcctattttataaatagttcttcagtttcctgtatgatactaacaatatgcatgtcatatattaaacaatatatgcattaaaaatgaggaactgtctgccctaatatgagcatttttttgtgagttttgttttgtttttttctgagatggagtcttgctctgttgcccaggctggagtgcagtggcgtgatcttggcttactgcaacctctgcctcccgggttcaagcaattctcctgcctcagcctcctgagcatctgggactacaggtgtgcaccaccacgcccagctaatttttgtatttttagtagagacggagttttacattttggccaggctggtctcgaactcctgacctcgtgattcacccacctcagcctcccaaagtgctgggatcacaggtgtgagccactgcacccggcctcttccttttatttagtttatgatttatccttattatatattttgaaagcttagagacatgtcaaattaggaaggatcaagaaggagcttaactttttgtagggggaggctctgattctgaatatctctaaagcctgaaaagcaatttaattagtcactaagtgggaaggctccatttgatgacaggctgtaaatggcattactcttggtcatctgagtagaatgcagaaaggttgcaaatgaaatggtaatggatttaattgcttattctgatattcataaaaatctgagatgtttctcaagccctgtttagactctaaacaattttatttttccttatattaataattagtgatcaggtcgaatacactgaagccttgtctatgtaaaaacaccatcaagtgactattttcatgactcctgacttactctcaactgcctccataatgactttatttaaaccatgatccattgaaatgactcatgaatttcagaggttccctttatcttttccgtggatttatacccaaagctctggaatagttgtatgaacactagaaaaaaagaaacagaaatgacaggttccaggtaatcaatgataaaactactttgaaaaccaagaagaaataatttcatttatggagttttatgagcactgtatttaagctgacattcaacttttaaaaattgtacgtatttaatgtgtacaacatgatgttttgacatatgtaatgaaatatttactgcagtcaagcaaattaacataaccatctagtcacagtcacagttaccagttacggttacctttttttgttgttgttgttggtagggagagaacttgtctcctgactactgtcttagcagttttcagtgtacaatataatatcattaactttaataatcaagctgtacattagatcactagacttatcctgaaaaacgtcaattgtgtatacttttactaatatctctccatctccccccacctccctgaccctgctaactacctttctactgtttctatatattcaattttttaaattattttttattttttacgtttttagagtcagagtgttactcttttgcccaggctggagtgcagtggtgctccttgcttactgctgccttgaatttctgggctcaggcagtcttcctgcctcagcctcccaagcaactaggactacaggcacatgccgcaacttccacgtaagtttttatttttttttaattttttatttttttccagttttttgagatgggagtcttgctatgttgcccaggcagctgtctaacgcctggcatcaagggatccttccacctcagcctcccaagtcttcaggagtacaggcttgagctactactacaatcagtgtattaaacatttttagattccacatgtaagtgagaccatgcaatatttttctttctgcgtccggcttatttcacttagtgttacgctttccagacattcattttcattgacaggcatcatacatgatgctaaagagcatggtagacagggagtcagacagatttgggttaatgatctgagcccaccactcatccaacgatgtgacctttaaatgggttaatttatcctagtcttgtgttcctcagctaaaaaatggggataggttgataatcgttaaggttttgtaagggttaaacgagacatgtttgtaaagcacttaatgaggtcagacacgcaggagctgcccagtaaatattagctacaaatttaggacctaacataaagggatctctcaagaaaatcactgaatgcaaagacaagtattttcttaatactttacagctgagtatttgatccaaggttctttcccatttatagatttgttatttgatgcatttcattttactttttatgcagatgggttggttagcccggcctcagttatcatttgaaactcaaaagggcagaatgtaaaacaagatattcttatgattccaaattgaaaaatacacaaacatcaatgtcttcaaaactatagagtttttactaggacacagtttttcctctaacttgatgaaaaatcaggagttctggcttccattggtatctctgacactaattaattgtgaaggccttggtctcctttatttgggatatgagagttttgacaaaatgacctcttaggtcccttcagtatgtctgaaaactaattcagaatgtaaccctaatgccgtttgtgaggaaaataaaagagacttttcccctgtatgtcataaatcccaacctgtgacaagttcttcacatgtgtaaaattctgtcctggttttctatggcagtccccatgatggaaactcttttagttatgcataaaatcaggccagtttatcacccagaaaaggaagagaggcgacatgcttccagcctatatcgtctagactaattttcttgttctctctgatgccactatgggacccttgccagctgcctcctaggaaataattattaattgcacttactcaaattagcctcctcctaagtccccttcaagatcacactacagagatgtcctgagagcctagcggaagcagagaaactaaaaaaaatgttcacaatctttcttcttccaaagaggttcctgcaaatagactcatgattaaaatggacctcataacatgtcagcttcttggaatggaccctccttccaaggctagaggcctgaggattgcttctaaataaaagaaagcttgctatgttttcagttccagatggtatatgtgcactaatagacagcaaattctaaaacgacatgcctctggcttcatcctggagtctcagaagcagagaagaaatgcattagaaaaggaaagagagagtatcttgctcttgtttgtgttgggatataccaaggcaacatttcaggcagcttacactgctcatagattattttgatcaaaattgttattgctcacttctttcatttcttggataagttaactgaccacttggaaccattccccttaaaatgggtaacaggaaatcctaggtcctctaactctcagcacatattcatagaaaaccaaagttgcaatactgtaaaaggagcagaaataactaactacaattcaatatatttcattcagaacgaggctttgaaaaaagcaatgatcctttgtgcccagggctgctcaatttgattactgcatcccctactttgtgaagtgatattttgtttctattttgattccaaactgctcaaatagagtcctcctcaggcaagtgtataagaatatagcatattttggcctcaaatgactcttattaaagaataataaatcaatttaaacattattattacttcaaaaatcaaatctgtaacaaatattaatcaatctgatacttctactgttattggagaacatttagtctataaactacattatggatgtcatggtcccatttcttaaaatatgtctaggtatatgcttatactgatgcataattagatatgtttatatcatatatatactgattcaacagaggagaaaatattcgtgaagacgagattaacacagcagacagaaagcatcacatcttaccttataagactgcatttataattaccatgtggtagaataatggatgatctttttcattattatgtttcttaataattttcaaattaaaatatttgaagaaaacaaatgcaatatcctataatttgtataacataaattccattttttccctagataatggcaaaggccgcatgactattaaaactttagataagtatgtacatatacacacaaagtagccttttttattttaatgtgggagaaataagctaagaagagtaatgctatctattcttctattagatagggttttatataatacatgcttacaaaaggatcatgttgtcaagggtacctcgtcttctctttaaaacaaaactaatttcaaaggttgcttaatcaaatcacaatgaagtttcatacttttcaatttaacaaaatatcacagaaaagcatgcatcatagaaaatcatatcttcctagataatgaatttccaacaggtaattttggagagtctctatttataagctaagaatgatgatttgaatatttaaagatatgcactgctgacaaataggagtgtatttatggagtacaagttttagttatctaaggtttctaaatccccaggagctcaagaatgaagaaaccatgcactgataatccgaacctggatagatgaattctagacagcaacttgtgtactcccctcacagccacagaggtaggtggaatgtataatacattgtcttgtggaaatcataagctcaaaaggaccctagaattatcttcattgctatctcatgatgaccttttcataatatgcagccactgatcttcacgtctcaaattataatagtcaataaagaatcactttatataaaaagtatttgacttatttcacttatttgaattccagggtagggagactgtttgcagggatatttagcttagctttcaaactatctgtggttcctaactgtcacaacattcaggagtatcctaaatatataatgaaatgtctgtaaacctaaataaatgttagtataaataataaatacctacacaattggaggaatagtgtcatattgaggaattaagtcaaaatggtttaatcatgaaaagctatggtagacactggggaatgaatggcaaaaataacagaatatagttagtgtccctcctggctttgagtaatatatgctgatgtaaaaatttttgattgttagtgttaaccactgtatttattcactaatctgtaaatttgacacaatggatttattaatgtaatttaatttacttggcatttcttctcctgagaaagactcctaatagatttaccctttaccagtccaaccaaattatgagatttctcccctatttctacctcacaggaggaacctggatatgcatagattcaggatcttagttttttacttttaatgaagaattatgctattggaagttgaacaaagatatgcagagttggaggacagtcatagtatgcaggggttaaaaaaagaaaacaattttgcaggcacttgatgtgggcatgacggtggtgtgtctatgagatggctgttctttgtgggtttttttttttcttttaatcttgggaaactttgcagtttttacacatgttcatagaaccatgatctaaatttcaatatagctagttttgacagtgcttttacattttcaacgcatttttattttcccctctgacaattcagcttattctattaagtgtacttccaacctctctctctccaggctctcatcctacacacatgttaaacctgaggtatgttttggaagtaggggatctcagacagtccatctgattttttgtcacatcctctcatctagtcactagaaaatgcttctatcagatttgtgtcataggtaagccaaatacatatgttgcaatttcagctacttcatttatcaccagctaaaaataaacaaaaacaaacaatggtaaaattaaaccaccctccatttcctgatcatataattttaagttttgatagaggcaggcagtgcttgagcactacataagcaacttgttagggcatgccacagaattctgatggagttcttggggctttcttgggagtcacttccttagaaagagagaatggaacatagatggctgtagacactaataatatatatcaagaaataagttaaagtatataacaacattatatatgggtaaatgctacaaaaaataaatcaagaagagagtgatatttctatgggaagatttaggtcaggaatttttttctgatgaagtcgactttgaatagagctccaaaactatagtacatattctaatatgtctagaattatctcatcagtatctattaatcaaggatggtgaataactacagtctcattctttttgccttatattctgctcactcttacttccctagttcccaccctaagctctcacgattatactattatgatttgattcttcactgacactaatattgctcctctgagtgcctaggatgagtgtttatttagtttatttatgcatttatgatgctcttgagtattttgacaatcaggaaccacagaaatgtgaggaaagccaagccaaatgcacttcaagcagtctccctgccatgaaagctgtgagccctgaagtcatttacctgataatctgttctatgggtgctagcaagcattagaccccgtagacatgtggtgctggggaggctgtaagccaaggaatctgggcaggtataacaggaaccgaagacttaagcagaaagctgacaagaacaccataccgctacttctctgaggtcaccaacagcatctcagtccaagagtagccagacccattaaacaaaagcataaatgatgggaatcagatccttttttggaagacatcaggattgctaggatatttagtgtctttagggaagaaaaagtatgaagaaaggcagctaaggacactggagacaaatgtctcgtgttttcatgattttacttgttaactttccactcggcagacagaatctgggcacagggactttgcctgcagctgtcatggggagctctgctgtaaatatattagcatataagcacagtatacaaggaatttgttagtctgacagcacataatgtagtttaatcaatataattattgaaaaaaataatttacacacaattgctcattcactcgagtatctgggaacctcaaagagaaaaagaaatggtttttctatgctgaagatgagagcttcagaataggtagattctggttgtaaggcagtcttaatcttaataatggaagatcttaatctttgatggtagacgctagtcctcctctcacataaatactgaggaatgctaagaaatgctagtttctgcagacatctttcctgcttcaaaaagacaagcttcactttgatctgtttcccatgtggactctgtatgatttctttcagagggggaaaaatgaagagagtcctgccactttaaaaaacaaaaacaacatgaaacaaacaaaacacctctctctaaaatctctagaaaacactccatccggcctttccctttcctcctcagctcaaatcagaagcaactcaccacaattaaaacaaagagtttccttctcatctttcatcactcaaaaggccagaagagctctaatccctcagagaaaaaaaaatcattccatataattatgggtgcattgacatcaatgattttctgagtttattttttaaatgccattgtttggtaaatgccatttctaaaatgtcattatttttttaatgccactaaaccacattaagagtggtttagtagcattgaagtgcaaatgaaaaaaaagaatatattttttgtaaatttaagagagtaagaataaaaggttcttaggactgtatactctccataagaatcatgaagagtaatgccgaagatcagagaaaactaaccagtatttataatgatgttcacttctattgtggcctgagccttggggtgtttggagcaatttttcaacccttctgagccttatttttctcacttttaaaatgagggtgttaaaggcaggtgatctcaacatcttttcccaacttacccagctttggatttttttttctggttataaaattattctgattattttttcttagaaaaaatatagataggaaaatgtatatttctgttaattctaccactcacagataaccagttcggtgtatattcttctaggtaatgcttgggttctttttttaaaagccataacgaccacaataaacacagtagaatctcttttctgctttatctctctgaagaatatgtgagcttttttttccccctgttttagtatttaagtgcttaacaattgaggttctggcaactaaaactgcacaggcagcagctccgtttttctcagaatcaagcgaaactgaacaggcaattaaaagttactgaactgcaaggtaaaattacttccctgctatgcttctgggtgactaaagaagggagacaatggaaaccatatttagaattaagatagaaggatggaacatagcagtctgctctactaaaatggaatctataagcattacacataatcagcagcacttcaatcatgctctttgctcacagttacatggaagattacacaaaacaaatgtgcaatattcaaatctgtggcattgctggttaacagaaggcacttctctcccagcccacacggtgatccaaattgtctcctgtacagtcagtgcccatctcacaaatgggctatgctccaagcatctacttgtaagctcattgttccattctctgtattaagtttctcatagaattaatgttataaattgtcctcagattcctaggctagcctatatgggccagcttattaaaaggcacattatcaaaaaataacatcaagaagactatgcaaattaaccaccatagtaatgcttcttttgaagttgtattcagaggtcaattgtggaagcacaagaatagctctcctcttctgaaaattactggtgacagtttccatccttagagacaaatggtaagacagaagaataaagtttaaagaatttcgggaattcaatcaggaggattcagggccagagatcaaggaaaaggattcacattgaactgggaaagcagtaaacggcatgagatgaaggagttggtagtatgcctgataatgcttaagaaaggagaaaatgattacagtatggagaaacagagccttcttctagggtatcttcccatgactttgagctcttatcttagttagaagcttggaggctataatatctggatgtcatctgttttccacactcagtagaaatgttgggggaagaggatttggtgaactggggtaaagataaaaatgagcagtggaagtctggggaagtattaagacatttccattccaactgaaaccttatgtctatcacctctccctccactgaggactctacctggtgacttgtattgggaatagttaagatgcctggaaaatgcagtggatcttgaaatgataatttcaaacatttaatagggtagctcaaacatcaaacaacaatgaaaataaataggaatgtggaagtcaagcaacggaagatcttgccacatgcaaccagtatagccatttgcacaataagaatcacattaaattggattaagcaatctgtgagaatctccttaggataatatttttacataacaagggaatcaacaaagcagattttataactgatgtcatgtaataaaatatgaaacccactcttaaaggttatgattctattggtacagttaagtataaatctgctggagatagtaaggtagtaagattaataagtaacaaacacatgttctgctataaaggtcacttttgatttaatgagaaatacaaatttgccgaaaatatgtcttccttctttaggaggggatggtggtactaaaatttaataaaatagggtaaaaaaatgtcaaaatatcaatcagaaaacctaaggtgaactgaaagcagttactgtggagtacagtatctactatgagatttcttttaggtaacttttttatgtcgtccaacctcaattatcaattttcctcaaaattacaattcgaaaataccaaaagaaaaaataataactgtttttgggatccacgaggacattattaaagagtattttggagttatatttgctgccaatatcatgtactgaatgttcagagaaatattttctgctctgcgtttaaaaatgacaaataactatgaaagacatgttactagacatggaggagataatcaaaagaccaaaatacatgtaatcactgttccagaaggagaggggaaagagaatggacaaaagactcacaattctacataattgattaattagacaaatcctaatatcaggaagcccagtgaatccaaagcaagaataataaaaagaaacccttaccaagacagacagacacatgagcaagaaataattgaaaatgcaaggaaagagatctttaaaacagtcaggaagaatgaaacagtagttagaaataaatgataactagatttacaactaacttttcaacacttacaatggaagctagagggcaatgggataatatctccaaaatataagagacaacagctgttctattacaattgctatacccagtggaaaaaaaaattcaaaatgaggttaaaataaagctatttcaaacaattaaaaaatgaaagaatgtactaacaaaagaccttcacgaatgaaacatctaaataatgtatataaaacaaaggaaaataatcacagaaaaaaacgtctaagatgaaagaagaaaagtaaaaccatggcaaacatctcagtaaatctaaagaaagccttactttgtaaaaatattaacagtgtttaatttatagagttcatacaacaaaagtcaaagccaccaacaacatgtcattccaaaaagatcatgaaaggaattgaaacattcaaaggtccttttattgtctgagaggaaaatattagttaacattagatgttgtaacctcagctattcatgttttatatttaatgatttcaaggtagaggtagaaaagtatatcttaaacaggatattaaaatacaaactataaagggaaatactgataatttaactatatcaaattttagaactccattcaccaaaatataccataaaaagactgaaaattccagtcacatactagaagaataaacataacaaaatataatgaattctaagcatcaataaagaaatgataaataatctaataggaaaaaaatggactaaaaatgtgaacagatatttcacagaaggggaaacacaaataacccagaaacatatgaagacatgtacaacatcattagtaatcaggagaattcaaattaaatcacaatgaaataccattgtacaatcaccgcactggcaaaaaatttaaaagtttagatgagaacacagagcaataggaagtcatcatcccccagtggacagcaggtgaatggtaagtaattttactaggaacgttacatgtgcatcctgtatgcattatatgtactgcaacaatactgctcctgagtctatgccctagagaaattcttgtgcatgatccagagtcacatgaaacagggttcaaggagcactgtttgtaagagcaaacactcaaaaccacccaaatatccatgagcatagagtgggttacaatattgtgattttttttcactcagtagaatgatacacagtggtaagaatgattaaattaaatgctataataaaccccaaacaagtttgacagacaaaaatgaaggaataaaactactattattccatttatataaaattcaaaaacaggcaaaagtaaacagtatatcatttactgatacatgcatatatgataaaactattttaaaaagtaagaagattataaacacaaaattcagaaggtagctagctatctcaggataaataagaggggcatacacagtgcttcagataggtactgctgtatttatgtcatgtgctggccacaaagtttttcaatttttaattacattttagtagacacacatgaattatataagttttaaaggtaaattattatcacaataaagaaatatttaatattgttaattgcagtttaataaacataataagtttaaattaagaagaaaagcttttcttttaaactaaatgtttaaaatttgggatttttattaaaaaatcacatttaaagaaacatggcaaaactggagtttaaatgggggttcttttctgagtcatatatttgcatagtgtcagtggaataataatgactctagttattctgactgaaagttgaaaatgtttgtttgtttaattattttagtttgtacttcatttttatagcattccctcacattaattatatattgtagttgcattatgcaaaatgaaaacaaataaagttagaaatactatgcttcataaaacgtagcataaagttacactggctgatactcacagtcatttgtatagccattgccttgaaatatactgatcacaagctcctttatctccaaaatgtctgaatgctgttaacatgagaaaaagacacctgactaacttgactgacctgcagcaaaattatttgttttcatcgaaaaggaaggtgccctcctctctgttactcacttttttcctttctgaactaatttctgagaaaattactcaattaatagcactaatttataaaattaattgtgtaatttgcctagattccaggcattcattagctctcatggaagcacctgtgtggagaaaactatcaggactctttggaaagaagacagtggcagacagtggcagacagtggcagacagtggcaccgtagcacctcaaataatgcaacaaagacccctacgcgagcttgcatcctgtcaaagaagctgttttctgctctattgaaatctttggcttcaagcactaacctcctctcatattcctttgtcccttaagctccaacttcactatgcaatcgtcctctctattcttgcctcctccagttctaactcaagtttcagtcttattagaaataggacatgctcactttggcaagacatggctccttttttacccagagggtaaagcactatagcaacaagaggtacacaggtaaaggacagtgttatcgaaacctaacatttccctaactatgcccaccctcactcctcatcagtgagcttctcctgtaacctggaccattccaaacactaacaatgactgagaagcaaaaagtttccacagccttctaacatcatcaattcaagtgcctaacaattctaatgagaagggtcttgaatgataatatttaaagctattttttcttattttatcagataaataatcaattttttaaaaaggtattcatttattcttatacctcaatcatatatatatatatatatatatatatatatatatatatatatatagtatatgattagcatcaggttagtctgggagtaggaatgggtttgtttgattaagaaataaaaaataagcatagtatcttactataaaaatgttatacttagaagagaatgtatacatttaaagagaattaaaatgaaaatgttttcatttctatatgttaatataatacagtgccaaacgatttggcaatggcattaagtgacacagaagttcaaagcacagacaaataccaatgtgagcaggagtcataaaggcttccaagaggaactagaaagagagctaggatttagggaattgatgaatggacaggagctaaaaacacagaggggaaggaggagggtatttctggcattggaaatcgaatatgaaattcagctcaagcatgtgaagataagtaggggctatgaccgtgaggtatggagggggctgatgccagtagctgctctgatgagaatatgaagagaagtaccacaaacactttgaagtctggctgtttcattcattgaactattggaatgtgcattgaatgccatctgattcaacagcaatggtttgtactcttctatcctctgataatttgctggcagcacacaccttctgtcatgccaaattactgcagcctgaaagttgtgtaggaaaatctgtggtggcaaattaagtccttgccatcctgaaagaatccaggcattcaggattgattattaacaactggaaagctgaggaagcaaagagaaaatcatcaccgtctacagccaaagtcccaaagccagtaaccatatagatattaacattaggtagcctcactggaacaaaagcattctttggtctctaaccacatataattcagagagatagcacagtatgcagaaaaaccagactaagtatcctggaatgcatgactctacaccaaagcgatatataaagtatccagagatacctagtatgacactgtcactggtccaacacattgtctgtattcctaaatctaagaaatcatagaactaacagggattatgttgttgaatgcagtatgtcccattagaacaaggagtgaagtgatattcactcactgggagaaataaactgcagttcgtgtctaagatatagaaagattcaccttttccatcctatggaccagtaacataatgtatacctttgaactttaaagagtttaaacagtgcatagctttataaatttgtagtgagaatcagggagacataaagttacaaaatgaacatttttttttcctaagtagcagtacttttcgagaaacggaaggtattgaatattcactaccttttaaaagatagcaaatgagagaggcaaggtgctttttgtttggttttgttttaaattggggaaaatgacaaaaattagcagttattaacttcacttttcattagatttaatactatcttccattctacaatattgtataatatcccattctacattgcactccattctaataataataaaataataaaacaattaaccagaagtagctaactagtatctatgaaaatacttacatgccagatatgacattaaatgatctagaaacattatctcatttaatttttatatttactgtaatatgtattatctgcccattttgtagatgagaattagctgagttatcattgatgcttagattagcaaagtggtctacctgtgatcacagacgtaaaaaattacaacatcaaaaaaaaaaaaaaaaaacagtctgtcatgtgcacttcaagcctgaaatggattaaatctagggactaaacacctactacctggtcagatgttacaatcaaagaaggttcctggagacaagggctaactagaaggttaacacaaggaccacgaaggccaattcctttttatcaccttagctatgtaaccgtaggagttgcctcaaaacaatcatttataaaggtgagaacaaacaacaacaacaaaaacccagaaacctccaaatacttcgtgattggaagagtgctgttgtggggtatgagcaagctggttgcatttaataatctgaccatcaagaaccattctgttcacttctgtattaattacagtaaaatgtgtgtaatatatctgatccctagaagatacctttttaaaagtatgcaaacacattttaaacaaggaattgacaacaatgatttcttagacaaggaatttttcaggtgataactgttttagaatgatgctactctgtaagtatgaaagttctctaatctatcactagattggctaactaatgaggatgagtagagacagaatatgaatttaaatacgcattcattccttgccttcaccaagatttatttgtaaatcaatgttattttattttcccattagttatatttgaagtaattcattccaaatatagaaaataattaattcttgaaaaattaaattcaaaagctacaatttaaaaattaagtttcatggagttaagtattaaaagacattagtcctaaacacagtctattccttgacaccagtgttttctctgtaagccattctgtataataagccgactaacattctaacacctactctaaaatgatgatctctctcctaactgtaaaataattctagtattatttttcattattaactatgattttgaaaagttgaaatgatttagttgtatgacagtatatattagaatttagtggaatgtaagcataaaaaactatttaacaacgttcttctaagagtcagctcataggtcatatccttcataaaacttatcggaagctttcttccacccaattaacaaatccctgaggggtcaactgtaccctatatggttgttcagagtctgtcattccttgagtaatacattataatagtagctctaaaactttaacatacagcagaatcttctggagtgctggttaaactacaaattgcagagcctcacagtcagagttcctgatttatgaggtctgggtggaacaaaataatttgcatttctgtacaatcctaaggtgaagctgatgctgtcagtctggggaccacattttgagaaccactgctttcagagtgtttcattttcaaaaagtctgcctcccactatgagactagaaccactaaagagcagatatggtgcctagcatgttctaggcactcaatacatatttctgaatgaaagaatgcagaggcccctgcaatgtttggaggagaaccaaatgaaaaatgagaagactgacaacgcaagtttcgggaaataaactatatatatatatatatatataacttagcagattcaaattttatttaaaccactgtgaagtcaatactctgaccttacaaatggttcagtgaaaatcttttgatgtaaagaaaaatgcgaagagtttgaaattaatacttggtctaggttcctctaagtccttttccaaaatatgcctatgtgtatctgttcattaagcaaacatttactgaatatataccataagcaatcaagctagaaaacataggaaacgacaagttgaccaaagtattacttcattttaacaaaagtggatcaaacaagtattcatcatacaattctaggaaaggggggtaccaaccgccagaaacaagagatgttctagaaactcaaagtagttcactagtgaggattttgaggtaggtagcagatagggaatcacagaaagagctggaaaactacgtaaacatataaagctggcccgaggacgggaaggctttgaatgtaagactaaggaatttgaacttacttttgtaggggtgagaagaaagcaatacttagcaaaactaaacttcaggcagggtatatgcttgagtagaaggagactagaggcagaaggactagtgagaaagctactgaaatgttctccacagaggtcagagcgacctaaaccaggtggtagcattaggagtgaaacacacagaaggcaaaatcagcagttaggcaaccgattaaatgcatggcaagagagagaaaaatgaattaaatggaaaggttttgagccttaatgacccaataaatgaagatgccacttaaaagctaaagaagccaagatgatagagtcaatatacttaaagacaattaatcataaacttcagaagcactcacttgcaggaacttctatcagagccctgggttgggggaatcctagcagtgtgttcactttgccatatacatgtgtaaagtgtgtaagtcttttattttattttattttatttgtttatttatttgagacggagtctcgctctgtcgccaggttgaagtgcagtggcgcaatctcggctcattgcaagctccgcctcccgggttcacgccattctcctgcctcagcctcccgagtagctgggactgcaggcgcccgccatcgcgcccggctaagtgtgtaagtcatttctatcttgcctgcttaagcttctccttccactcctccaacatttccttagtcacactcacctcccaccagatggccctggagaggctgtggtcatttttatttaacttttggcattctttccttaattggaactccttgaattatattagctttaagccctgaaaaatctgaatctgaccctgcaagaatagtttctggttgtgaggaagctgtgctcagttgtattcttggactttgatgcactacccagaatttcaggtggaaaaagcccaccatgggtttaaaaatctagcagaacatttgggactggggaaatacatgaggatagttgatgaaattactcaagaagagaaaacagacagaggggagaagacctaacattaaatttctgtaccctgacatcaagaacaggaagaagaaactgagaaagaagaagaggatggaacaatcagaatggatgaaaacaacaataaaacaatgtagtccagtgacataaatgccaagggaagaatgaatcttaactaagtaaagatgtagactgttccctgtgctgaaaagaccagaaaagatgagtgctgatataaagccattcctatggattggtggtcactggaagggaagatatgaatagagggagaagtttgtcatgccccccaccaggtcccatggcggagctacaggacagtttttctaacctcccttagggggatggggactaaaatttgctgctgctctagtgacaagcagtttacatatccactggaatatcgtaagatggtaagctagtatgattgacattttacaaatgagaaaacgtgtccaaagtgacaccaccaaccagagctggaactcaaattccagattttcctaactccaagtctactgtcttattctcatggccaattttaatagcaatgtacctatctatcttcactattattaacagtattattcaaataattacctggaatttagaaacagaatagccttgtctaattttaggactgttttctgaggttccacttcaattagaaatgcacacattagaaaatgcacgctattgcttcagtaatattttatatgtttgtaaccctttatttaaaaattaatctgataacatttgtgaacatgttaaaaagctaaaatgtcagcactttacttttccttcttcacagtttctaatctgtagagcctaacaaaaaaatgattaacatttcaaaagaaaacaaggaaaaacctggtagaaatatatttagcagagaaagtttctaagtatgatctgttgtttgaatatattttttaaaaagaagttcaaagtaagcattttacttcttgcattcataaagtgtttatcagttttcatcaaaacaaagaaaataagacacgattttgtttttttcatttcatgggctgatttttcatattttaaaaatattttacgtttgtagtccaatattaatatttaacacatggattaatgtacatgtgctgaaagatgaattgaataaatgccaggaattattaacaagcaatttcaactaaaactataaaacaatttcagcaacaattaccttaagtgataaattttccttcaatttaagaaataattttatccctcagctgtttattgaaattattattttgtacttgctgtatctgaagacagcaaaagacttagcccatgtaaaagtagaaagtactttttcataagtattttaatttcttacgataacacttagctattaaataaaattgcgggctggcagctgtaggctcaggcatataatggaagagaaagatggaaataccaaaggggcaggtagtcatgagcaaggacctgaaactttgatatatttgaagttttcacctgcaaccttatcttcagtttggtagtaacactactatttagtgttacttgcttatagttgtttctatccattaacttgctttgttaccttttgctatgtatataattatattctatgtacataattatatagagttgatgctatcctaaacaatgctttaaagggtatattttgtaattcctaggctgttctttgctaagggacttcagctagagcacacctatggtgcaatttactgtgttgaaactaggcagaacatcaacaataaaatttggaacacaccttaggtatggctaaaattttttaaactgacaatactaagtgtaaacaaaaaaacagaaacactgtaattctcatatattatcagtggaagtttaaaatcatgcacccaccttgagaaactgtgggacaaagtctaacaaagttaaacaaaatcctgtttcctagcctttccacttttaatatatgctcaatagaaatgactattgtgtcccaactcatttaaaaatgcttataggtataatagccccaaactggaaacaaaccaaatgttcttccacatgagaataaataatcaaatcgtggtatatgcatacaatggaatatgactcagaaataaaaaataaccaaccaatgatacatacaacatggataaatttcaaaaatatgatgatccaaagaaaccagacacaaaacagaacattctttacaatcccatttatatcaacttcaggacagggaaaatcacttatgatgatagttatcagaatagcagctgggcagaggagaactgtgactaagacgtagcttgagagtcacttcctagaattacagaaatgccctgtgtatggatgtgggtagtaaacacatgtgggtatatataggttaaaattattccactgacttatacacttaaaaacttgcacaattgtattgtatttaaattatatttcattgttaaatagaagtcaaaaccaaagaaaaccttcatcatgcttctttttcttttttcttctccctccctccctccttccctcccttccttcctttcctcctttctttctttttttttgttttgacagagtctcgctctttcacccgggctgaagtgcagtggaaaaatctcagctcactgcaacctctgcctcccacgttcaagggattctcctgcttcagcctcctgagtagctgggattacaggcatgagccaccttgcctggctaatttttgtatttttagtagagacagggtttcaccaggttggccaggctggtcgcgaactcctgacctcaagtaatctcccgccttggcctcccaaaatgctgggattacaggtgtgagccactgtgcccggccacttctttttcttacatggccacttatttttcttctttttcttatattttttatatgtgtattctgattttcctcgtaggattttttgcttgttgaaatgaagcagttaagatgtgactaatacaacagagagcatcttgaaaagaatgacatcatatagcaagcctgtccaatctgcagcctgcatatgacctagggtggctttgaatgtggcccaacacacattcgtaaacttccttaaaacatgagatatttttgtaattttttttgttttttttttagttcatcagttattgttagtgctagtgtattttatgtgtggcccaagacaattcttcttccaatgtggcccagggaagccaaaagcatggacacccctgtatagcatgagtaaacacctcagcaccaaggctagtaacagaagagatgaatgacttaataacatttaattccctcactctcccttctccaggctgcagcattctcaagaatgaattggaaacttcggttgggtgtggtggctcacacctataatcccagcactttgggaggccgaagtgggtgaatcacgaggtcaggagttcgagaccagcctggccaacagggtgaaacccatctttacgaaaaatacaaaaaaaaatagctggcatagtggtgggcacctgtaatcccagctactcaggaggccgaggcaggaaaatcgtttgaaaccaggaggcagaggttgcagtgagccgagatcgtgtcactgaactccagcccaggcaacagagtgagactccatctcaaaaacaaaaacaaaaaaagaattggaaacttttcatttcctactaattccgtcaccgctataaacttctgtcacctctcctaaattccaaaacctcactatgctagtaagagcctcatgcacttgactcctgacccagaactgcttggtcaaccttctaacacatcttgtctcttgttatttcaagcacagttatctgagtagatgctagctcaataccccctgcctgtggaaatatattaaatgcctccacatacagaatcatctccaaggggtagaagataagaaggctagaaaagaagttaacaatagagaaaaataccaatagattgattacaggaaaatattacattcctaaacattaatagcaccataaacaaaattaaaaggtatgtaattaactgagaaaaaaatgttagcaatatatataaaaatactaaaaagggctaacaacatcaataaagaattcttgcaaatcaatgtgaataaaaggaacacatcactaggtaatgcaaggtaatgaacagataatttggtgaaatacaattggcaaatccacatgtgaagatgttcaaacgcagtagaagttaaaacagtgtaaaacagttaaaacgatgagggtttttttttcttataaaatgataaggactgaaaataataattgcaatctgggaggcccattgtgctggatagtacaggaggtagtataaagaaacatacagaggaggagaactcagtttggcagtgagtattaaaaatctaaaaataactataccttctaactcatttccacacttcgtacacaatacaaatatttagattaaactatcatatataacagtagtgtgtgtgtgtgtgtgtgtgtgtgtgtgtgtgtgtgtgtatatatatatatatatatatatatatatatatatatatatatatatatatatatatttttttttttcccccccgagacggagtctcactctgtcacccaggctacagtgcggtggagcaacctcggctcactgcaacctccacctcccaggttcgaatgattctccagcctcagtctcccgagtagctaggaatataggcatgtgccaccatgcccggctaatttttttaattttaatagagacagggtttcactatgttggccaggctggtcttgaaatcctgacctcgtgacccacccgcctcggcctccaaaagtgctgggattacaggcgtgagccactgcacccggccagtgtttataaaatttttaatggaaaaaaatctatctgtccaatatcaaaaagattggtaaaataagtgcagtctagatgatatgccacgtatctctaaatatttatattatagaaggaaattaatatcaacaaaagatgtgtatgatgccatattagtttttttaaaaaggttgcaatacagtctgcacagtaggcttctatttttttttaaatgattaaatacataaaggcaaactactaaaaggaatataccaaaattttaatagtgattttctttagatacgattctggatattctattttcgttctcaaacttctgttttccaaatcttctatagcgataattataatcactaataaccaatgttatcgaaaatttccatgatctctaaatgccttaaagagttcgacagaaagaatttaaaaacataggctctcctttttcttctttcattagtgatgatgggctattaaaacaaggccacgtccttttgctttaacctcccatccccagggatttcacattagaatgtccttcctcccaatacctactcctaaccttccccaacccagaagttagtttctctccattaaaaaaatccccacagtagtataaattaagcaaggaaccattttaaactgtcagcttaatggtgcacacaggaaatatggctgctctcagtgcaagaaaattttaatgaataaagtagcttaagaaaaagatattttccaactataagtggaaaacttgttcagtttctcagaggttgtttactgccataggaattacctatttaaacttcttcacaacgttatcacttggatatggttaggttattctgcgtgtgggcgactcattaataaagctgaaggaaaagcaggacagtgctaggaaagaaatctagagctggacatttaatattcttgtgtgtcagagactacatttgtaatattaggggtgggaagtagttacttgctaaaatcccactttatactccgtttctgattctaggggtgtttttgtcatccatacaaagtcaaaaagaatgcaaaattataacccaataataatgtcattttttaaagaaaagtatagatgattcaagaccaagaaagaggcagttcataaaagatttaatgttgaaaaaccacaaacataaaaggaggctaaaattggaaaagacattataaaatctaaaactttaaaaatttgatatgataaaatatatgctggaaataatatgcaagaaagctgcatcaaagctttcttggtcaaaggaaaaagtgttaactattaagagattttttaccttaaaaaatacaaagaaacaacttagtttgcattatagactaaaataatcttttcaaaggatattgagaatagaggaccaaagagtgtttttatggaaggacaaaaggagaatgcagagtgagatttaaaagttgtgtgtgtgcatgcatataaccctcaaaagtataactccacaccaaaaacaaagaagtagctgtatctagggatgttctattccatcaaaactatgtctgtgaagctttaaagggaatcttcttgcagtctacttcctatatgaatactctctatgtataacagttcattctaagagaagagcaatagatttaaccacttgttagtatccttgttagcagtatatcaacagcaattgatcactaatgtgaaggtatcaggttttaggtaacttccaacaccattctccttgtgttcaagtgattttcctgcatcctctgaatagaaaccatcactgctaagaattgctccttagacagtacctgctggaggcttgcaaagatcttaggtaaaaagtcgtaagttgaagatattagttgataatggcataaggtcttgttcctcaagcaattgtgctaggaccgtctacattataatctcttaaagtggatatttagaaatgcaaattcttgagccctacccccagattactcaatagaatctttaaaggtacaacctaggcatgtgcagtttcagtaaactccttaggtgattctgatacagtttaaattttaagaattaaaatttaattatatctgtttgtattacatctcttcaacatacagcaaattttaataaaagctatcgaggtactaagaaatgaattgtaaatggtgaaatcacaggcaatggaaggaatatttaggtgttgcaggcaatttattatagcttgaaaatcataccatgctaactgtagctagctttaaagtaagttctgactaacagactgaacatattattgcttctgtgtgagtagaagaggttatttagaaatctttctacaaacatttgagtatctatgaaaatttacttttgcacactgagatataacaaaaaccacactttctgtcctcaggaaatttaatccaggaaaattagagctctgttttgaaagcagaggaagttaatttaaaaaacacagactggatgtatcttaacatcacctcctaagctcactaatgatacctgaaagcattcaccttcacctagttggagagatctctgctgcaaggaaaatgttaaccatcttgccagctaggcatcattcttcatactataataagcaaaaggcatttccaaagtgagactctctttgtaaatttgtttgtcattcttgtgaagaatcagatgctgtaattattaagctttttacagaacatttcaattttccaattgctctttaataattcccagcaagtaattggacattttaattatatgtagcttcttgtcactgttcatctaaaaaacatcacaacattaaactaagatgctcagcctgagtgttttcttgggttgtatgcatattttttgagttatttcaacaatgatcaaaagccagtgagttcatccttcaaactggaatcctcatttcttttccaaaagacaaaaactaataagcaacaaaaaaattaaaccatcacactaacaaaatgtattaaaagtcaatcgataatactggccatcacaccaacaacctctacctttattttattttcccataaagagccactaatccattttgtttttttctactagcttagcaagtccatatggactggaccctttcagtgtttctttcccagaatccctgcagaatcattgatctccttgatctactcatctctttgatcttttgaggatagtctacaaatagcctgtgctcccctacgtgggtggcaatagcagccctggagccttcaaaccagcttatggggttatagtcccagctctgccagttacaaacatgcgactaagtcaggccaattaaagtgaccgggctgcaacgttgccctacctgcaaaatggggcaaaaatcttccatatttaatttacaggcttgtgcagatttcatatgaaataaaaagagaagccactgtgtaaaccttgaaatctctacaaatgtgaaaatgaaaatgaaccaaacatctccccaatattagcatgacatctatcaggctcctatagaaatcagtaatgaaggaggatgtgtgcccacccagccatgccatggtacaaatggggcctctggtgtgtcagaaaagcaactggaaaatggaaaagagatggttcccatctttcctgtgtctgttctaggacactgcgagtcctcccgaaggtgtctgaaagaacacaaggcaggcatgttaagtgtgaaagacagcagaatggatttgacggcctctattaggcctgaggtcttttggcagagagtgagagaatgtcctattccaagcagaaggcacctgataagcacttgattgattggtctctgcattcttggcactcagtgaaacactgatttgccagcagagtgtgtaaacacccacattttggtaataacctaaatatctgcatattgtgaatgaggaggctgactgaatgaaattgtgtaaaaacagaaagtcaactccctgcaagtcttgccttcaccattctctttgcagatgcaggacttttaacagtgaggatattaggacatccacaagtgaaggatggagccctgccctgctctttgggagctttttgcctgtgtgtgtgtgtctggccctcattcaaggatatgctcctctctggcaactcccagccaatgtctagagagcacagcactgtgttttccaacttaactaagaattaggtctctttgctactgcctttccttaagaccaggaccaaatatatatatatatatatatgtatgtagatattgtttaacgggcctcacgtctaggcaaaatacacacacatacatacacacacgtacatacaaagtcattcattcaatagtaagctgcatttgtctggaattactaacaaaaattgaattagcaattattgcactgttgttttcttttaaaagcacaagttaaagtagtgttttctgctcatgcttaataagattgcctttctctctatttaccacatacccatctttcagagcttctctaaaagcctatgtctttcttgaagcttttactgattcccttgctggaaaatgtatctctgatttctaaatacctacactgccctagcacagattgctaagtcatgttctttggaggtcctatttcccaaatggcaggcactccatcacaagggtctccaaaattctccaaaacactagggaatgtatgaatatgtgaggtgggaccgatattcatattggctccagaggagccaggcaatgctttctccagggatacttttcactattatctgttatctagaaaatcgccttcattttaagatatttagaagaaaatccaagttatgtggtttcatagattaaacttattgctggcacttacataccactaaaagttaaccttggaggaggggcgatacagactataactttaatcatatcagcttcttgtcttaaccacatcttgctttgactgaactactctgatcctaaggactcctgactgttgatatcacagcttaaaggctttcttcagactccgggagagaaagtggtgggacactctgtaaagtgattcagttccaaagtatatatatcatcccaggtgatcatagagcttaaataaagttgcttcaaactagcatgaaattttgtctaatacacagtccccaaaagaacctctttagaaagaggatgaaaacatttaaacatggatgttaagttcctattaaaacactcatttattttaagaaattcgctagttatgttttaaaaattgataattaaattacagttgctgagcattttcctttgacttggtattttgaaatgcttgtgttctgtctaaatgctagattcttagcatttggctaaggtatacgcatcaaaatggccacagtaaaggaagtgacattagtaattctgggctaggaagcactgtttctcttaccgaaatctctcgcaactgtaatccagccaggtaaagatagctttgtgtttgctgacattttcagagttgattgggcaaaaaaggtgcaatcattttcctaagtttttcctcgtcatctttaccctctccccaccaccccctgccgttattttcaaaaggcttaatctaaattctaaaggaatgttctaagagagcgaggaaaaaaatattcaacactaaactgcagcaatagccttgacagttcagttctgctgcaggtgtcctggtttaactcccacatggacaaaggggatacaaattgttgggttactacacaatatcctcttgttaacatcgtgttgtcctcttttggaagaatcagacaccaggaaaggatctcaatttcaaccctttgtcttttacttaaagaatctaccaaatcagtctagaatgataagaatgaaatgtgttttaaaaagctcagaggagtctaccttatatctaacctcagtcctttctgttttttttttttttccagagcagaaaagacccactgttggagaggggttcatctgtcacttgaggggcagcagcaatttatcagttcctgtgccagatgtttacataatatcaagtcttcacaacagtcctacagaggccctatttcactccaggcaaaaccaaggctcagaggcttaggaactgcccaaggtcagatagttagtagacgcaatgagaattataagagtaatcctttatgtcacaagggaattccagaattcctgtaatgttattttaagtggaatgtgtgaaatgccagtaaataaacaacaacaattctggtgttaaattgaagaaacaaaagaatctttaagaacaatgtagttaagagactcaaactagaaagaatttaccatcctttctgaatgttgctccaacttatagtctaatataaaaactcataagaaatgagtagtagagatgcttaaattctctatctagtctacaataccatgcatctagaaacgacacaatttgatttttaaaatcttcaaggcttcataattaagagaccataattaaaattagaatactcaaataagtttattaattgtcagtcttttctctatatcctgccttcagaattatacgattttatttaaccatttgcaggattcctttcatctcaggagagtataatcatataatcagactcatcaccactgttcccttttaattgtaaatcatgactgcgcttgcaaattagtctattatcacagcagattatcaatttggtagggaaagtatttgccatctagaatgaaagtagttaataaacattaataaacatcttaaatcaatcactcctttactcttggtgtgccgacagatgtcatttgagattaataaatcagtcagaacaaataaagtgatgaggaagcgaagcacaaggaagcctctcgatgccctgtgtacttaagaatcacaatgcctaaaaactaattggaagataaagataaggcattaaaccttcagagaaatgacttgttggaaattagacaaagtaaatccagatagccattctctgtgggtctgttatgaaccactggcaataaaagctagaggagaaacaaaatgctcagtcagaataaattatgtttattgacagcataatgtagaggttaaaagcatggactttcttttttctttttctttttttttttttttttgagacggagtttagctcttgttgcccaggctggagtgtgcaatggcttgatctcggctcactgcaacctctgcctcccaggttcaagcgattcttctgcctgaccctcctgagtagctgggattacaggcaaaggccaccatgcccagctaattttgtatttttagtacggatggggtttctctatgttggtcaggctggtctcgaactcccgacctcaaatgatctgctcgcctcagcctcccaaagtgctgggactacaggcgtgagccaccgcacctggccaaaagcatggactttctaattggcctgcttgggtttgaatccagggcccacaacttccgtttcagtgacttaactatttcttaattttgctgtgcctcaatatccttatgggtaaaatgggagagtaaagtacctatctcataaagttgttgtaaggattaaatgaatcaatattttgttaagagtttaaaacagcacctggcatataacaagcactgagtgattgttcaataactaaatgatataattggccatttactaccattttatgtgctctagttctttctctgcacaggcttttatgagggagaattggggttgtgaagtaatcccacaatattttaatcacttcctcactataagccaagagttgaattaattcattttgtaaaaataattaaaatttaattaattctattaaaaagaaaaaaacacaaatttttcatttaaaaataagattactgaggcaaaatgttaacagtacaaatagactgttgttgtatagtccagtcattaattaaaggcatccagatatcaataccttgtgtattaacacaagacttttgtataaagatgtttaccagaagcccatcaggagtgttccacttttagttatggcacaaaacgttatccactagcatcatcaacaactcctctatatctcacctaggactagtcccaagaaaaagaatgagtagggaaaccaaatacattatttgcatatttaacagcatgtccaattagccactttgctgacagagactaatttattattcatcttattccagcatatgttactactttgacatccacgtgacaaatgactgatacagcacattgtgattttgaaaatgttaactgtggacttcaagaaaatgtagcttagactattgaggaaagtttctctgcttcaccttcagaaatatggaatctagaaaatgatcaatttttctactatgtaggcacaaatggtccaatatgacataattttcagaaatgagtatgaaataaaaggaaataagctatcaaatggtgccctgaaaaccaaatagaaggttcaatctctacgtacatcctctaggcaaaaattctcagaggtatttaaattagacatgttccagtattatttctctatactagattgtaatatattttataattgaaaaggataactatacataaaatgatatagatgcatagataggaactaaatcattcattcaattaacaaagacagaatcttgaaaaatttgaaagccaagttcctcagaaaaaccacatacttctttcaaatgtgcttggatagttttatattagaaagagaaaaaaaaaaaaaagataaaacaatgtgttgctgcatgccccttcaaaatgtgctcatcggttactgtgagagtactgtgtcacggggctaccacacttttcctgaatgtattttttagaacagcatcacagtcaactcctagtgaagtactttatgctctgtaactatccacactttagatttttcagtcttaacataaaattaaaaatttcagaatctaaaattatctgttttaagtagcattaaaaataccacttctctttaagcagctctgaaacctgaagtcatctagaaaaatatgccatgatgaccaaatggtaactaattgccaagacagactaaaccacataaataattacatgtaccatcgttagtccaatggcaacccagataatcaaaaaaaccatgattatcatggcatcatggcagaagtgttgtccaaataagtaaatttcactgccttgtattttaccacatattaaaaagcactcttttacaatctgttaattttttttctttctttatagttgctgattttcagagatatatcataatgcttttaccaattttaattatttgacaaacaagtcaccaaatatatacaggaacatttaaaagttcacaaccttggtttaaaaaatgtaggtcacattatgcaatacatttaaactggggatctcagagcccaaagggttctatattctgaatttcacaacaaaaatgactacaagattcaaagaaagttcatagaaaacaacatatacataaccacataccttgaaaatacactggagaaacacctttctatactgcctcagttaaaattcacaaatctcaccgatattaagttcccacaattaatgcagcaggttcttcttatctacttgtatatttagtgattaaaaggaagtctgtacaggaatcatcatcttctagtgttaaagctttttagtatagtggttactatttaataaataacattccttatcactacctgagcataacccttcaagtcaaatttgagaacagtcctcatttattaatccatctccatcttcctacttactgactaagtaccacaaggtaatattagataaaattccttccactgaaatgcagacataaatttcacatctatattgacttgaaattcttaataactatgagttagctactcttttgtggctaattttattgttaatgaagaacattttttgagacatgaattggaaagtaccaatgctgggacaaatttcaggtcttctaatttaaatccagtgggttttgtttgttagtcttttccaaaaccctgccttttatattgtcatggaaaagcaaatgtacagtggctatatattaattaggtgaacctgacataatcatcacctctttaaatttgtttccttgtcagcaaaatgatgatcataagccctgccgtggttgtgatgatgattaaatgagacactttatatgaaggcactgtggaaatatatacttaaaagatagctgttttcactcagttctgtcaaaagcttgagggaatgcattgttatgtgatcaacactgaacaatcttgtattttgtgagagaatggaatattttaaaaggccattacaagcttctatgtggagagatattctacaccctacatagaccagaaagggctgggcaaaaagaccaaatgaaagaagcgggtgcttttctaagaggaaatccttgagacctcagttgcgagacaagtactaggccaaatgcaccttgagcctgaccaccacgccatggctcctgtgcacctaagtaagccactcccagaataatcatgaggacaattagatggcttaagggacctgaatataatctttgcaaaaatatctccagttacaatatgtttagaatcaatacgtccctgggaaaagacaacaagaccatgaggattttaagaaatccttatgatcaaaggaaacttagaattggaaatgatcttagaggtctgctagtccaatttaaaaaaaagagagagagaaacagagaaaaacgaaacaagaatatgaatgacaaaacagtataaaaagtcatgctcattattattgagattgttaacatctcaaaacataaattgtgtttttttctttaaaagaggcacacactgtagcataaatgagtcatcgagggctgactgtggtgatggtcaacagtaaaggaaagctggttttctctgtatgaaccaagtttggttgctctattctcttctcaaagaccaagcctctaatcccagttaattgtctaaaaaggactgcttttggtcatacagtatacaggtgagagtgtagatgaattagtgcaggctttcccttctattggagtacaggctttatggaagagtattccataggaggaggaagatgagttagaagatatgggtcctgcctccatctctgctgctgatttgctgtgaccctatgagtgtagttcacttaaattatttagatctctgttgtcacatctgtaaaatgaaaggaatatactcctcaaactttagaactgaaagaaatgatgttcaaagtggtaactgaattccataagtcactgagttaataactggctgaactgggacaggaactcaggtcttctgattttaaggtctagatttcccctacatgtgctctaaagtctcttttaagtatttcttaaaaaaaaaaaaaaatcattgggaacctactatagtctgggcacttttcaaattcatggtctcatttattcttcacttattgtattttcattttataaatggagaaaacattcttagtaaagataagcagcttcgtacatttacacagtgctagtaaatggcaatggccaaatttttacacagatatgtttctgagaagtatttagtcagaccagtctgcattaattattcattattagtgtaaatttaaatcactgaattcctatcttaactacatttacaaaacaagacttatatctgttcgaaaagtagaaattgttatgttttgttagaaaaaatatatgcagcaacttggtggaaaacaactgtataaagagctctttctagaacattaataatgaagggcaatagaaagtggtgtagataaaatttactattttgatgtttttatcagatcatttcatggtgagtcccagatgattgctacatatacataaactttatgttttttgcatttatgcttggaaactatgtatttttaaggaaaaaattgaatttgcctctttaaggattaactctttccaacaatagcttggatttttagaactaagttgtaaacttcttgatggttctgcctccgatatcttgcctcctccaacctcaactctactctcatccttattattctctggtcctccatggtacctggtacacaaatacaaacacatgctcatagtaggaatttatgatatatttagtgaataaatgaatgcatgaatgaacaatctaagaaataaatctattaaagttttgggcaaccaaaaaattattctaaagtgccagggttacttggatcatcattgattcaaagattcttccaaaaatagtagctggccatcttgttgaaaacagcatttaagtgatataacattttgtccaagaatccaaagtaaggaaaaggtgtggaacaccagtgtctgtttcagcagaacagtcatagccaaaaacattctgggtcacacatatgaattcattaccagctaattaatattaaacattaaagctaaatatttccccaatgtagagaatattgtcaaaggttttgctagctctcttggttgccacacaaaagagtaaagggattactctatgaaacattaacctcctgcctcctggaaaaacagagaaacaaaaacctcctcagcagaatcaatgaagtaatctgcaggactccagtgaggtaccaacagctttctaacagtgtgcattattgttaaaacatgcttgaagcaaaacgctggaccatgtatcttgtaattatttcttaagagatcaaccattaaacggcatagaggaccctcttagtttaagtttaagtttaaaaacctctgagctcatagaattgctctgggctatgggccataggccttgattctaattcctctttgactctgatcagacatctggctccgtcttttggcccatttatggtatgcctcagtatccctacaggaaaatcacattcaaactcactctgaaacctacctatcctcttagaagtttggtatgtgtactgaaagtgtctcagaaacagaaacattataaattcaagatataattattatccttatataacaccattaagcaacttcaattacaaaccacacttttaaaatctgttaacacttccttctgggaaagcccttttgccctttaatagtgtaagctaatcatggcaatataatttccagagctcatatttgtgggaggagaaaggatggcactggtggctttctccttcctttatctcctgaaattattgagagactctaagctaattttctaaagtatgcagaggcacttaggaaagccgggagctgagatgggaacctaagcatttcactgacatcattccatgctccccacatatggcacatcacataagcagtactggctgagcacactggtctattctggactcttgttggcgttaagtagcattcttaattacaagcaggcttgctttttgtcatttacagtcacacagttctccctctatttaactagaaaaaaaaaacacaatttttctatggaggtagtttcaccatttatgtttttgagccaatgcaaaatataaaaggaccctgcagtgttctcaaaacctgcttctcacaggcccttaaaaaaaatcctcatcataatctctgcaactgggtcagcttgcacaaagatactcgggtagccatgagcgctctctgcgccctgcaaaccttgtaagtgacacctcataatagtgcaaatgaagcatggcaagatgagaaaatgaagaagaatgaacctggatagtcagcccagcagctttcaaaacataggggactcaattttattccttaaactataccataaatgaatttttattttacacattcaagcatatacatgcattctctattatgaaagaaaatgtcttacgattcacagaaattctaatacaaccaaacagcctagttcatttgttcatctagccaaataaatttgcaatagtctcagattttgaactaaacctcattttcacttgtcttgactttcagctatgaatttatcatattgtcattaacgtttgtgctttcctttcaccctcatctattaggctcaagggttctttacttgtgggtcctttgtcccaacaactagcgaaatattcagagagctattgacccaacaaattcaacatcacctctttcttattaggtttctctttaagccatcaccctgcctgccgtgttctcagtccctctgcactcacacctcaccccatttctccatcccccaccctgagaggcttattttttatcctaatgttccttgattgttctctataaagttaatattattttcaaaagagagaaaggatgaagtatgagaaattcacacctggcttttatttggcaggggttggttactgacatgtaagtttgcgcctctgattgaaaaaaacaaagaatcagaagaggagcagcctcttccaaaagagtaagcatgaaggagagtgggcagaaatccaaaaatacacaaacacgaccatacaacagaaccttcgaaggaaacagaaagttctttgacccaaaagaataataccaaccactatacacacaacaattttctctactatcctattctttctctttttcgatgacagacacctctgatttttcattcacatgcagagacaatcactgtattctggagggaaagaaatgtttgtaaaggccagcagacggcgcctgactggggcagaagcttgcagcggagaggaaaaaggagtgccccactctgcggcagggccccttggtcttctcctctcccacgtccccagcagccttatccctctggagagaggccgagacacagaaaaggagaagttgcatatgagattattagccaagtgcttcccactggcacaattaggtgttccacctgctccatacacccatctgcctcaccacacccacctacccacactctgcccttcctgcaccctggcttgcctccgtccctcaggactcacacaattctgcacaaaggcagggcagtggttgagaactgcacccaggtaaagggaacaacaagctcctagaatactgtgggcttgtggtgagatcaccagaaactccttattctttcagagagatctaatctctgttacttataaaaataatccctagcttgggacatcactctcgtctccatactagacactcttaactggagagaatttctgggagagaactaggagaaggagaaaggaacaaattcctagaacccacagggatgtgttttttctagtatgctcccaaagagggcttgctaggggacttggtctctcttcagttagattatgctatagtttttcatatctaaccagaattgtccccaggtgggaaacccccaccccaccctgcatccatggaataaagggccatcctggtagcaccagcagctgctcagggcagagcaaactcataaggagtggggcaaaggattctgagctgaaacaagtctgaaaggtgacgggtcctgcaagaaagaggtggaaaatggatataaaaaaagtgcccacaactttcactctgctttctaaacaagtgcattttacaccggggtagaataaaaattgggagtggggaacgactcacaaaaacagattgatgttttaatttttggcaattcggggaatctggaatagatatttatctgaaaattagaggaatctggcctcacagtgctggtcactctggaggagaaagctgccaaccaaggcttttctctacactctgctgttttcaaagggacagggcattaggagaatagtttcccttagctctaacttcttctccaggcagacctccgggcttagcccagccagcattgactgacttgcccttcctggaaagcattaatcactgaaggaggaagtaagacctccctggttccaatagccttcacacgtgatcctccgggagatgggtatgtgtagtcaagcctctctctgttccatttagaaaagaactcagcctaattaccaagaaaaagacatatatttatgtgcagagtggatggaaggggaatggtgtccagaggtcccctccatgcctgcgaagggctggcccgcattaaaggggatgactcggttgccctcctagcttttctaattaagggaaggcgtgggggcaaaagtaattggcctcctgttgagtgagtcccaggactgcttcgctgtcactgcagtctgggcgcactttggaggaatgtgcgggctggaatctctccctccccgccccccggggccagggaagatgggcaggaggtggggcagcatatacagcacagacaaaaggttctgcagagccctcttctctctggtgctcaggtcccttagctgagcgcggcgccccatccggccactgagtgaccttctggcaactgacgcccccttcccgcggggcccagccgcgcgaccagggctggtcctttagtaggtgtccacatctctctcccagtacctcgacaaggaacgcccctcccacccctcaccaccaacacccgcgacgccttcccccatcccctttctattgtcttcaaagagataagtggctcgcaccaagcacacccaaatgcacctcccttttgtcgagctcccatttctctgagccttaggagcccaggagcgagtgcagggtagaaagaggggagcgaggggataacccgcgagaacttggcatcgcagacccaccgtgtccgcctcgcaaggatgccggtgacctgtagattgcaataggcactgaatgatgcttgctgctgccatggaaatggtggatgtggtgcgctcccaaactggatgccccccacgccactcctaggaggccgctgagggtgagcgggactatccaaagcagggccaggcgcccccctgcgccgccgccgccgccgccgccgccgccgcccccgggcgagcccagctcggcgccgcaccggagcatcctctggtacatggcggggcgcccgccgaggggcagccgccgcgggaggcaaagtttggggcgcggggagaggagagggcgcaggggagcgggcggcgcggagtgggctgaggggccggccgcctcaccgcgccagggcacccatcctctccctccttcggacagtcttctcggggtcctggagtccgccgtgcctagcaccccaaacaatccgaaacatagccgaggcgaatgcagctggagaggggcttgtccggaaaggcagccccgggaacagcaagcgcggagcgggtggctgctcccagatttccagggctccaggttctcgagagatactcccaaagagtttcgggcgagagtgcgtgccggcgggtggggggccgagaaattgtttaaagctcctcctggaaggtcctcacttctacatgacagacatccaccgcgaatccactaggtaaatccatttagctttgtgtgcggggactagggaggccacttcgccggcccaacctcctttcaagacagaagcagaccccatggaatccaggcgccccttccctccattcagccccggccggctcgcccgctagcgccagcctcccccgggcagcgcgcggagcagcggcgcgcatcgcctgctcccgaggcaatctccgcgtccgccgcctcctgacacttacgcccggcgaggggttcagagggaagagtgcgcccttctgaaggaagtgggaatcgaacggcggaaaggcagctgagaagaagatgcagacgaaggagtaagggagagaaacagaaaaagaaaaagaaaaagaaaaaaagaaaagaaaaaccacacacgctggtgaagcaaggggctctatgcaaatctgcagtctccaaacagcaaatcactgaagctcggatgcaatgcagaggacgagcctatgtaacgagggaggctggtctagcttcccacgaaaatcgccctgctttgcctctcccttgcattctccacgcatcaaagggacacgtgtaaggcgaaacgggaacacctaaaaagcaactctccctccaccaggtgatccctccatctgaactacaatggcaaatggcacccttcccctacccaatggtttagatgtaaccagtgtctttagagatcttaaaagggagagaattcgggtctttttattggaccaaacttgttctaccaggtgtttaaactcaatctgctaaatatggcttgataccttgtactcaagcatcagtcgcgatgatctgttaatcacatatgttactcataacaaggattcttcttcccattaccatattatatctcatataaggcagtggaagttcaggggaccaaaactcacaaggagggaaaaggatgcattaatttggcagctgcagaagaggcagaaagtggaagaatgggaagagaggaagagaagggtcaggagagaaacaggaagaaagcagaaaagaaagaaatggcatgaataaaattgcttgtatttcagtcaatattttaggaatatttaagatcttccaagatctctatagaagccccgctgtgatgatctttgctaacagtggaactcctcctttctctcatcctgtcttataaagaaaatagcatcaggaaatgaaaattcctaaatctagtgcccccaagggaaataggacatttatatgcttttgatgaaatacagcatctttaactgaaagctgtgtgtcctagatgaaagaccagcaaagccagcataaatttaagagtagaaatctagcaatgcaagtgaacttggctaggaggaccacaggcactggatgctggtgattaagacttgggactatgatttaaacatttccctgatttccaaaagatgataaaaaactatgacatgtccagtggctggacttttttttttttgtctttatttctatttaaagccaaaagaaagcaacattgaacaggaatgatttctcactagcttctcaccatctacataattgttatcaacaaatataaagtccagtattttttaaaaaatgtaattctgggaagatttgattcaaatcagctactaacccaagtggccatttagacttgtatattgcttcctagtccaaagattcaaccatgggactctgatgcccactatataaatagtgtccagtggcccccaaatcacacctgtagcaatcacacatgtcacattcctgtcaaaagtttattttatgatactaaaagataattcttcagtagtatattgattgaaacagttcagccttgctaaacatgatgcttttatctatttaaatatgccgtgtctcccaaccttccacagctgctcgaaggccagcagacgcaaaatctatcattttccactgtgaactgtttctgcccttgcccccagtcatttcttactcattttgttattttgcaacatatgtattttaattcactaacaagagtcgtgattattcgttttaaaaatatcaagtagagcttcaaaaagaaaaggaaaatcatccacacagtatgttttcaggactgcaggtccatattctgaatttgacatttcatagtgttagcatggaaagagcactggattaggagttaggaaatccgtactgcatttttgatgccaccatttactggttacatcacattagttactgagtctttccctgaggcactgtggcttcctttataaaatactcatgtttctatctttcctaacaatcccacagggtagaaaggatatcatgcaatatttaatgttggtgttctttaaaatatgtcaactgctccctgacatgaaggcgttatgtctcttctctcatacaggtctaacatattcaagctgatcaccatgcacaatacattcagttgccttccatctaaaagatacgtagaacattgcattgttttccaataccctcatatattgtgttaatctatcctttcctccccaaataaatggtagatgcctgaaggggacaagagtcaagtcttcattcctacttcctctagtgtccagcatatgtgaaacatatctagtctcttagtacttacagtcagttctcattattcacagtagctgtggcaaataaagtccctgtgaacactgaattagcaaatactgaaccattgctcccatggggaaatacagggctatgttcctgcaaacctctgatcacattttcatcactgaatcaatccattgccttgttttatgtgtttctgaatgataatgacaccttccttaatacataatgttgattcatcaacattgaactcatgaccagcagcactctaactcatgcctaaaagaaacatatctaatatgtattttctccataaggcacatcacatctttcttgcatttaggaacattagacagccctttagtattatgcttgagggccattttaaacagcaaagtcaccaacgtaaaacacaaaaacgtggtgctaaaaagacctaaaatagcgcacttgtttacagtgtgagagctgaaacaagaaggaagccaatagtcttgttcaacttcagccaggaacatgtgcattgggaacacaaacgtttgccattctctgcgtgtttgctaaggatcatcaaagtgccagggctacaaataaataacaaggatcaactgtatttgttattctcttgattgctaggaatggataaggctgggactttggagagcgatttgtataaggaaaagccatagaaatagaataagcgtagaagattgtgaataaccttcccaagagcattcaattaggaagatgcttcccctcctccctcactcccctgcctgtcttatattgtctggggccttgggagataaaggcagggttagagaaaggatgggccagaaatcttagttttacaggagtctcaagagctaaagagaaaatatttatggctgcctcaaaagaagaaattgtagctgtagtcttccaggcagatgtctagggcacctttgcaatacttaggaggttctagggtgtatgctgtgatacggatacagcaatatttgttataaatgattgtaattttgtggaacaaggagcaattctctgtctagatagtgtagaaaaagtattgtgggcaaaaacatgagtaatctggatgaagcaaataaagcttgtgtgtacccattaatttgtgtctcttcagctactcagtctttgggcttgcaattttgttatctaagggaaactgaggcagaatctcacaaattgttctcaggtgattgaagaactggttggaggaaacatggtttttggctaactgtaatgtattctaaaaaaattcagcacagacagtgcgatgtaagtgtttcttaacgctgtctgtaccccaagagtgtcagtgcctttatcaggaatttatgccccaacacctcagtcagaattacagcagacagaggtggcttctagaagccttgtgctactatcatctctaattatgatgtggctgtgctcattagttataatatctgttgaaaataagttatcactgatgaaattaagggcttgttaattggtccaacgaaagttaggaggaagttaatcctttgtgaaattattaataggcaagatgcgtgaattaactaaattttacctgaacacgcctcacttctacataaacagagtatgtgactctaagaggcttttcaccctttattatgaggaatggttccataataatagtaataataaaaactaacacttatttctagcacactactctgagtgatttaaatgaattaattcatataatcattacaaaatgatatgaggtaggtactattgttgatccctaacagttcttagtcacttaattctgagagatggtgaggtgggtgctgtcgttgaaatactgtcatatttgcttcaggaaaaccatttttggaagacatttttttcaggtacttaaaagaatgaagagctggaacttcaccaagcttctagaataggctacaaaattttgtgcctactcattaataaatgtctagatctgtagcagaagttggtcttggtgttgaattcattatgagctgtacttgtgtgaactcttggaaacggggttcacactcagttgccgccaacaaccatggctactgagatctacctaaaagaacctaaggactgtatgtgctaagctgtcctaagcccactcacgcctgatgatttatcatgaacaagaatacagggagcctacgttgaacaacagttaagaaatgagacatggatttgaaagttgagaggaaaacacaaaagaaatagaaagagatggaagaggagagtgagtggaagagggagattctggagaaatgggaaaggacaggccatttcaagttatttcttcatattacaaaaatcaacctttttgtctcaaaaaacaggatggttgtcaggcagacactttcattcttttcatattttccttaagcttaattggaaacccttaaagctcagtattaagctttttaaatagaaaagtagacactaaaatcagcagaggggaaatatattaaaacccacaggcagcactaatattttaaaaattaaaaatgagaagagtgtcggtcttgcattttgcatttctaccagtatccccataaagtaaagataagcagaccccacatatccatctacctacttttctgagtttgaactgagcgtcagtaaaaagggacagactcagaagagggtttgttctggagagctgtaaagctaaacccctgatcctgttacccctctggattattgcaggtccctaagagtaagatcagaaaatgagagtaagagcattgataataataataataataataatattataataataataataataataataataatgccaggctaaaagcatctctggagatttactgcaatctttttattattcagatgataaacttgtgttacagaaaagtcaggtttatttatgaagtgtttatttatcttgaggaacactttcacctccaaccaccgatagtccagtcatagatatagattggtgaattcagtcaacttagctattacctagcacctccccaatgatataacaaatcagagggagtgctggggatcaagatgagccaatgcggtactcaagtcactcaaattgaattaaagcctagatgtgcagtttgacttggaaacgtgactagatttattcaagtcaagattggttgtgtttagctctgaaatattctgtaatctctatcttgtctttcattcgatttaataaaaatttcatgtttggtggcttgcatacaacttggtgcttaagtaccaagtcagggtcatagagatttcactataactgcaagttcaagtgttgcaggcatcacaggagcaccaaccaataatatgccatcttttaatcactgtcagcttatatagtttgtagaattgtttcaaccgatttctgttggtgacaaacacttcctaggctcatgctctttcagtttcaatgtgttcataatgtagcgtgacaacatgagactggagtgcctgactgtgagtatgaatccaagcttcattgtttttattcatgtgacattgagtttaagggccccttgtcccagtttcctcatctggaaaatgattataacgctaaatgtaatgaaattggaaccatttctaaaatctattaaacacacaataaatatgttattattctttattcatgtgtacttagtttagcttatttattctttattcataggtactttatgccaaagacataaagataatgagctgcgatgtggtttttaatttggccatattctaaagtcttcccactcagtctatagtcaagctcagccacttcttaatttattaccatagcctctgtttctctaaatctgtgttgctcaaactttagtgtgcatagaacatacactagaggggctagaagggctgttaaatcacagattgctttgcttttgatttccttaatctttggaggaccctgataatttgcatttctaacaagctcccaggtgatgctgaagctgctagtccaggggaatgccaaggtccttatttcaggttttattaactaacacatggagagctttctcattaagctccttaccaatgatctcacctcccgttagttgatccaatataactacaggcagatcagtgttccctaagcatagatcatagtgctgttcccagttctcttctttaaagcattctttaaaaacttcaagatgtctattatataaacctatttgttctcatctcacaccatgtaactataaattctctttactacagttagaaaaaaatattctattttccttctcatcttttgtatttgagctcttttatttgttgccttaccagtggctatgagcaggaactcagacactacactagggttcaattcttgcttctacaaacttgctagctatgtggccttgggcaggttatttaagctcagttttcccatctgtaaaaaaggttaattgtagggttgttgtgaggattaaatgagtcgacaaatttaaagcatttaaaatacaatagtgcctagagtatatgtgtgtgtatctatatatacactaccttagcgtctagagtgcatacatatatatatatatatatatatatatatatatacacacacacactagctttttgctgttgttttctgaaatgggttttttttccccttgttttatggtagggagaaaataaatcagaatttatgataatattgttacatataattcctaatactggtcatccaaatagtcaccataacaaaactaaactaaacaagaacaaaaattaaaaagtcccttccaggtctgggcatattaggcctccagtccaaccagcatcagctagagaaaagatcaatgccatgaactggcaacctgggatctgtgtgcctgaattccaagacactgtctgtcatacacatctaccactgcagaaagaagcatgagattgttgagaacaactagaagtggaaggacaactctaaggcaatttagggtaatattaagactaaagcataatttccaaattctttggtaaacacagatactcaaaccaggaaccagaaatcatgtaccatatgtttaatttcctgaatgtccaaggactcagagcataaaacaatttgatttatctttgtgaatatatgttgtagagcatatactacaatttgaatgcactgagaggaacttaatcatgcgattcaaattgagtctctatctgggatctataatctaatccccacccaattcagaaattcaggatatataaattatatatatatacatatatatacacatatatacaatatttatatatacatatatatatatttgttaggttacacattttgtcagagatattctgatgtcaatactatagataagttggtatgactattctactatcaagacctttttaccaggtaaaattaaaattctgtagcatgttatattaagccctttaaaatgtgcctccatgcctcttgttttacctccatttcaacttctgccactttccccacaaacaccccaggctccagccacatgaatttctcactcttccataaaacacactgcacactttttgttgttgttgtttttactttgacatatcccatgctattctctctgtaaaactatcttttctacttccttcgtctcttagtattgcattaattgttctatcaaatgttaatatatatttccccattggaaaaatttctgaactctgtcatttttttgctaccttctcaagtgtagaatattacaaatacctaaaaaaagagtgaggatatgtaacagtgtattcacattactattgtgcagaataaatgatgatcaaagcaactggttaagtctatcaccatgtttagtggttaaaatcaccaaagccaacagagaaatgaaacaaatcctcttcaacttacccttataggtttattggtgagttatttttattatctaaaatatataagaagtttaggcttaattttaatttgaatgctaagtaagctggttataaagaatgatggaattcattgtcatattttcctactcatgttataaacagatgtctttcttttccatacttcaaaaaaaaaaagaaagtactgccaagctaagatgcttgctgccaagttgaattacagaacaaacatttatagccaacttataaattcttaactgtagggttttataatggaaatactgtcaccattttcactataaccattcaaataatattactatagcaaaacttatcatctaatatttttttctgggatggatgagggaagactagctataagagttggaaaaacttctagtagctcaattcaaattgcacaattattccaatagttcaagtctcttagaatattgattttaaagtaagaagtatatgctccaaaacatttattcttaaaagataggaaattttttgatacctgtataagaaatatatgacctctgaggcattttgaaaaattattaatcaatgttgcttttctaaaactgtcttattttccttttgtaaaagaattactttccctcacattttctctgttctattgctgagatgattcccccggagaactgtgtgtttatcttgacaggtgttagtagatccaaagacctctgtggaattgttcctggttgcgttcaagtacagtagaaaacattatgcctgcaaagcaatgaacttaccttattgccttctaaataaaataaaccacacagcaagtggaattaatctactaatgtcttcctaatgaagctttcattagacatatggtgtggtcttcaatatttaacacgacaggtattaaaacaaagcatatctgatgatttttttaaagcatacttgatgactgcctcttacgttatttttaaatgaactagtttaccttcagattgctttaggcacctaatcaaagagatacaagaaaatatctagacttaagatttttttttaatcaaatagaagaaacaaatgcctcactaccaatgcccttaaatgatgaaaactgggccaggtgctcaggcctgaaatcttagcactttggaaggcgaagacagaaggatcactggagactaccagtttgagaccagcttgagcaacataaggagaccccatctctacaaaaaatttaaaaaaattttgtagaggcatggtggtatatatctgtggtgctagctaacataggaggatcactttaacccagttcaaggcagcagtgagtaatgataaggccactgtgctccagcctgggtgacagagagatcccatctctacataaacaaataaataatacatttatttatttatttatttttttttttatttattattttgagacaaagtttcactcttgttgcccaggatggagtgcaatggggcaatctcagctcaccacaacctctgcctcctgggttcagacgattctcctgcctcagcctcctgagtagctgggattacaagcatgtgccaccatgcccggctaattttgtatttttagtagagatggggtttctccatgttagtcaggctgatctcgaactcccaacctcaggtgatccactcacctcggcctcccaaagtgctgggattacaggcatgagctaccgcgcccaggcatatttttatttatttatgtgctattctcatattgaagggagaggcaaatttccgattttctgtgcagtgtaaaatttcatgcattaataaaatttataaggcaaatattaagaatgaaattgttttagcccaattcacagtggtttgcttcagaagtagcaaacactggattcccaggcaagatggccaaataggaacagctctggtctgcagctcctagcaagaccaattcagaaggcaggtgatttctgcattttcaactaaggtacctggttcatctcactgggactggttagacagtgggtgcagcccacggagagcgagccaaagcagggtggggcgtcacatgacccaggaagcacaaggagatggggaactccctctcctagccaagggaagccggtgagggactgtgccatgagggatggtgctatccagcccacgcactaggcttttcccatggtcttcaccaccgacagaccaggagattccctctggtgcctacaccacaagggacctgggtttcaagcacaaaactaggtggctgcttgggcagacaccaagctagctgcaggagtttttctttctaccccagtagtgcctcgaacgtcagcgagacagaaccattcactcccctggaaagggggatgaagccaggaagccaagtggtcttgctcagcgaatcccacccccctggagtccagcaagctaagatccactggcttgaaattcttgctgccagcacagcagcctgaagtcgacctgggatgctcaagcttggtgtggggagggacgtccaccattactgaggcttgagtaggtggttttcccctcacaatgtaaacaaagctcgtgggaagtttggactgggcagagcccaccacagcaccacaaagccgctatagccagactgcctctctagattcctgccctctgggcaggacatctctgaaaaaaagacagcagccccagtcaggaacttatagataaaactcccatctccctgggatagaacacatgggggaaggagcggctgttggcacagcttcagccaacttacccactcctgcctgctggctctgaaaagagcagcagatcttgcagcacatcgctggagctctgctaagggacagactgccttctcaagtgggtccctgatccccatgtctcctgatggggagacacctcccagcatgggttaacagacaactcatacaggagagctccagctggcatctggcaggtgtcccactgggacgaagcttccagaggtggaagcaagcagcaacctttactgttccacagcctccactggtgatacccaggcaaacagggtctggagcggaccccccagcaaactccagcagaactgcagaagactgttagaaggaaaagtaacagaaaggaaaacaaacagcaggaaaactaacaaacagaaagcaatagcatcaacatcaacagaaagaacgaccacgcaaaaactccatctgaagtttaccaacagcaaagaccaaaggtagacaaatccacaaagatgaagaaaaaccagtgcaaagaggctgagaatttcaaaaaccagaattcctcttctccttcaaaggaccacagccccctgcaagcaagggaacaaaactggacggcgaatgagtttgacgaattgacagaagtaggcttcagaaggtgggtaataacagactcctctgagctaaaggagcatgttctaacccaatgcaaggaagctaagaaccttgaaaaaaaggtagacaaattgctaattagaataaccagtttagagaagaacataaatgacctgatggagctgaaacacagagcacgagaacttcgtgaagcacacacaagtatcaatagccgaactatcaagcagaagaagggatatcagagattgacaatcaacttaacaaaataaagcatggagacaagattagagaaaaaagaatgaaaaggaacgaacaaagcctccaagatatatgggattatatgaaaagaccaaacctacatttgattggtctacctgaaagtgaaggggataatggaaccaagttggaaaacacacttcaggatattatccaggagaacttgcccaacccgcaagacaggcccacattcagattcaggaaatacagagaacaccacaaagatactcctcaagaagagcaaccccaaaacacataatcatcagattcaccaaggttgaaatgaaggaaaaaatgtcaagggcacgcagagagaaaggttgggctacccacaaatggaagcccatcacactaacagcagctctctctgcagaaaccctccaagccagaagagagtggggatcaatattcaacattcttaaagaaaagaattttcaacccagaatttcatattcagccaaaataagcttcataagtgaaggagaaataaaatcctttacagacaagcaaatgctgagggattttgtcaccaccaggcctgccttacaagagctcctgaaggaagcactaaatatggaaaggaaaaaccagttaccagtcactgtaatgtgaaagaccaatgtgtgtaaagaccattggcactatgaagaaactgcatcaactaatgggcaaagtaaccaactagcatcataatgacaggatcatttcaaacataacaatattaaccttaaatgtaaatgggccaaatgcccaaatcgaaaggcaagactggcaaattggatagagtcaagaccaatcggtgtgctgtattcaggagacccatctcatatacacagacacatataggctcaaaataaaatgatggaggaagatttaccaagcaaatggaaagcaagaaagcaagggttgcaatcttagtctctgataaaacagactttacaccaacaccaacaaacatcagaaaagagaaagaggggcattacgtaatggtaaaggaatcaatgcaacaagaacagctaactatcctaaatatatatgcacccaatacaagagcacccagatttataaagcaagttcttagagacctacaaagagacttagactcccacacaataataatgggagactttaacaccacactgtcaatattatacagatcaatgagacagaaaattaacaaggatattcaggacttgaactcagctctggaacaagcagacctaatcgacatctccagaactctccaccccaaatcaacagaatatacattcttctcagcaccacattgcccttattctaaaatttaccacataattggaagtaaaacactcctcggcaaatgcaaaagaacagaaatcataacaaacagtctctcagaccaccgtacaatcaaattagaactcagcattaagaaactcactcaaaaccgcacaactacacggaaactgaacaacctgctcctgaatgactactgagtaaataacgaaacgaaggcagaaataaagatgttctttgaaaccagtgagaacaaagacacagcgtaccagcatctctaggacacagctaaagcagtgtttacagggaaatttatagcacataatgcccacaggagaaagcaggaaagatctaaaatcaacaccctaacatcacaattaaaagaactaaagaagcaaggtcaaacaaattcaaaagctagcagaagacaagaaataactaagatcagagcagaactgaaggagatagagacacaaaaaaaccttcaaaaaatcaatgaaaacaggaggtgttttttgaaaagatcaacaaaatagatagaccactagccagactatatataagaaaagagagaagaatcaaatagacacaataaaaaaatgataaaggggatatcaccactgatcccacagatatacaaactaccatcaaagaacactataaacacctctatgcaaataaactagaaaatctagaagaaatggatacattcctggatatatacaccctccgaagactaaatcaggaagaagtcgaatccttgaagagaccaataacaagttctgaaattgaggcagtaatttaaaaaaagcccaggaccagatggattcacagcctaattctaccagaggtacaaagaggagctggtaccattccttctgaaactaatcctaacaatagaaaaagaggcactcctccctaactcattttatgaggccagcatcatcctcatatcaaaacctggcagagacacaacagaaaaagaaaatttcaggccaatatccctgatgaacatcgatgcgaaaatcctcaataaaatactggcaaactgaatccagcagcacatcaaaaagcttatccaccacgatcaagtcagcttcatccctgggatgccaggctgattcagcatacacaaatcaataaatttaatccatcacataaacagaaccaaagacaaaaaacacatgattatctcaatagatgcagaaaaggccttcaataaaattcaacagcccttcatgctaaaagcaatcaataaactaggtattggtggaacatatttcaagataataagagctatttatgacaaacccacaacaaatatcatactgaaggggcaaaagctggaagcattccctttgaaaaccggcacaagacaaggatgccctctatcaccactcctattcaacatattattggaagttctggccagaaaaatcaggcaagagaaagaaataaagggtattcaaataggaaataggaagtcaaattggctgtttgcagatgacatgattgtatatttagaaaatcccattgtctcagaccaaaaactccttcaactgatgagcaaattcaacaaaatctcaggatacaaaatcaatgtgcaaaaatcacaagctttcctatataccagtaatagagagccaaatcatgagcaaactcccactcactcacaattgctgcaaagagaataaagtacctatgaatacaacttacaagggatacgaaggacctcttcaaggagaactacaaaccaatgctcaaggaaataagagaggacacaaacaaatggaaaaacattccatgctcatggatagagagaatcaatatcgtgaaaatggccatactgcccaaagtaatttatgcatttaatgtttttcccatcaagctaccattgacttcctttaccaaattagaaaaaagtactttaaatttcatatggaataaaaaagtaccccgtacagccaagacaatcctaagcaaaaagaataaagctagaggcatcacgctacctgacttcaaactatacaaggtcacagtaaccaaaacagcatggtactggtaccaaaacagatatatagaccaatggaatagaatagaggcctcagaaataacaccacacatctacaaccatcttttctttaacaaacctgatgaaaacaagcaatggggaaaggatcccctatttaataaatggtgttgggggaactggctagccatattcagaaaactgaaactggactccttccttatgccttatacaaaaattaacttgatatggattaaagatttaaacgtaagacctaaaaccataaaaaccttagaagaaaacctaggcaataacattcaaaacataggcatggacaaagactgcatgactaaaacaccaaaagcaatggcaacaaaagccaaaattgacaaatgggttctgattaaactaaggagcttctgcacagcaaaagaaactatcatcaaagtgaacagggaacctaaagaatgggaggaaatttttgcaatctatccatctggcaaagggctaatctctagaatccacaaggaacttaaacaaatttacaagaaaaaaacaaacaaccccatcaaaaggcgggcaaaggatatgaacagacacttttcaaaagaagacatttatgcagccaataaacacatgtaaaaaagctcatcatcactggtcattagagaaaggcaattaaaatcacaatgagataccatctcacgccagttagaatggtgatcattaaaaagtcaggaaacaacagatgctggagaggatgtggagaaaaaggaaaacttttacactgttggtgggagtataaattagttcaaccattgtggaagacagtgtggcgattcctcatagatctagaactaggaataccatttgattcagcaatcccattactgggtatatacccaaaggattataaatcattctactataaagacatatgcacatttatgtttattgcaacactattcacaatagcaaagacttgcaaccaacccaaatgcccgtcaatattagactggataaagaaaatgtgcacatatacaccatggaatactatgcagccataaaaaagaatgagttcatgttctttgcagggacagggatgtagctggaaaccatcattcttagcaaactaacacaggaacagaaaactaaacactgcatgttctcactcataagtgggagttgaacaatgagaacacatggacacagggaggggaacatcacccactggggcctgttgggggttggggagcaaggggagggatagcattaggagaaatacctaatgtagatgacaggttgatgggtgcagcaaaccaccatggcacatgtttacccatgtaacaaacctgcatgttctgcacacgtatcccagaacttaaagtataattttaaaaaattagcaaacaccagcttaaattgcagttaaaactacatagtttaatggccaggggaaaatcaactgtaaacaaacaaaatcagtatcttttcataggcagcattttgatttagcatttgttgaaaataaaattcaaagcctctcacagaaaacctgcctccttcagaaaaatcaccagttttggagcatgtgtgatcccattccagctaatatttacagtagcatataaaacagctacaaataagtcacatcttcattgctacattatgccaaatgcttaatttcccattttatgttcccttgtcaattctctcctgcttctctcctgtataatcacagttgtccaattgagacctgatgatcttatcagtcatgcacttttactattattatttaaatttgctcctttcaactattatttattgccaagctttgcagagggaagaaaacagacatggtaaaagaagagtaaaggtgggtcttttctcttttggcagtagcaaccagaaacagtatgaaagcaatggatcatgaagaaaagcaatttcctacttgagggattagatagtaccctcttttgtactgttaaatcaaagttttagttattttttccaagtaatactgattttttcaatttacataaacagtctctagggaaactgcaagagacccccaaacacataccctctcagccaatcaacagaaaagataaggaaaatgaaaaaaagaaaagaaaaaccaaacttcctttatgttgtactgctttgagcaaggctttacacagcatggcaaaaattaaactgctacacaagcaaaagataattagcttaacagggaagaatttgaactgatacatgaagctttttttttctttttttcagtaaaagtataggtgatttttattttgaagcagttcacttttgctagcattagaaaattgaaaactatgtaaatttcagcaaatgtttgctttaatgtttaggttcacattgatattaaccacagctatcagttggtaataaattcagatttgagaaaatttgtagcagaaaactactctgaaatgtcatgtgaaaatcctaatcaattttaaatgcatttacattcatggaggaataaaacctactcttaaataataaaggaaaataatagtacatgtataaaatgtgaggaaggaaaatcatgagtctattttcacagttcatttgtaaaggtttatcacttatatgacgtatgtttaagaaagttacaaattttctatagtgaattacttttatgccatataattaacaacaaaaagtcttcatagctaaataataggtttttgataaaaccttataatttatttcagcttattcctgagttgcccagtttttaatgtcttaaaatccatcacactgttgacagatacttgaggtaacattaggtgattagctgacaaagttctagctactattttaattgcctttttcccgctttgtcaaaattctgatgctattaagtcattgttgaactcatcctatatagacagtaagaacaaacaaataagtaaattaacatagcagacatttcttgctttacatataactggagtaatgttttctaaatctggtggaacaatctattgaatacactacaaattctttgcaaaaatgaaatagaataaggaactatgcagggaagccaaattagacgactgcaggtctgtagccaagtggaatataatttgtccattacaataaaataaccttagaagtaggttgaagtcatttagtatggctgaaatttggagggatgaatgttactttcacccaacataaattccttaatccaatagcagataataagaataggttagttgggtaaataaagtttgaatccactgggttttctcggctggacactttttttttttttttttacatccagagttggatttgctgacaggttagagaatgcaacgtatgttgagatttcccagattaaaaaatatataaaaatgaaataatttgtaataagactcagatccaggactaaataattcaatagtctcctatgaattactaggtagtatctatatagaaacaccaagattcatcttaaaaatcagtgactgttcagtcgtaatatttttggagtagccctgtccttggctcactagatggggctatcaacttagacaggctgttgtgacagagtaattctagtttagtattcaatatccattctgccttcttcctggcaagtagaaccatttgaaaggatgagggggaagtgcacagagtagcaatatgtcccactaaaaatacttgctttccaaaacatccttagagtgagagtgcccttgtgacccagttaatcttgaaaaaatgtaaattgaatttacataattaggacaatattttcttaaaggtaggttttggtagactgtctcccccaccccactattttttgccataaaaccttattcctgttgctctcaatgcagagtgaatgcccacgacaataccaattctgagatcatgaggtcaaaaatcacacactaaggatggagaagaaagaagacagaaggagcttaaatgtttgaggtctccctgcaggagttataccagccctgtgtcacctacctttggacttcttattcaatttgaaaactaaattatcagtttaatcctatataagtcaggtcttcaggttttggaagctaaatacacgcctaatggatataactattttcttgaaaggatgattacttagatgggtgagtacgccagctgaggcctccaggcgtctgggagagacatttatccttaaggaaagtagggaacatattatttgctttgggtttctccagatgcattttaggaaagttaaggtactttctttaatacaggagcccattagaaataataactcaaggagaataaggctatcctcgtctcttgaacagaagaaaatgtcgttgagtaaataatactatggaactaaagaaatgcacctatagtccccttcttaaacatgccataaaaaaggaaaagatatccatttcctgtagaagagaattagagcttaatgaagacacactttcaaccaggaggtatctgatgtgggcttattagtaagaaacacatcttcccaggtaatacaactacatgtgagtaagtgcagcctgccatacattctttcatccacttaattatcaatatatcaaattatttatttatctagcaaatatttattgagcacttactctgcaacaggatctgtaccaagccctggactcattcagaaataaatgattggggggtttggttctaaattgaggaaacaagtctttgggcttactgcctcctcatcctgagctgggcagatccccatcctctcttgaagtccatgaaagcatatctaccttctgacatgcagaaatggccctgcaaatggaatctaactggagctgaatgagtattcttgcctcagttaatgtattttcatacttagccagttccaaagcaacaatgtgcacaacttagacatgcttattggccaggtgcttaccacctatttggcaaatgctgtttatgaagtttttaagaaacaaatattgatccaaaatttcccttgcgtttaatattctgtcattctgcaaggccagtattaagtttgatgtacacatacaattacctgtctatctaaacagtttcaactgccctaattcttgggcaccacaccgtgattaaatgtatacaagcaacaagttcttgatttgggcagctagaaaaccactgtggcataagatcaatagttacaccacttagcaaagactgtctttgtcattgcttcctagagtcctcaaaggtcctgataaatacttaaatctagcttgttctttcttttgtgcacatgttgttcatgcaaatgaaatcaaaatttacctaggaagattccagaggacccatacaggacagaagattgtttaaattatggtagagctcatgaaacacattttcaactggtgggatatcctccttatgagactcccaaattctttagagcaagaaacattaacaagcataaatgaaaaaaaaatcctgtatgaagaattgagaaaatagcataagcacagtatgaggaagacctaattctatagttgttattacaaaaaacctggggatttttactaaacaaaaatgtaacaggcaaatttgatggaccttttagcagaaatgtttgtatgaattgaattctagtatccagatcatgagagtaataatcatttttctgaactttgcataagacacacacatgaggtatgttggacatgccatgtgctcattttaaaagatactttgaaaaacaggtgagtgaccagatggttataagagccatattcagtctaaagtaacagagagtaaaggagatagaatagacatgctcaaatctttaaggattttcatatagaagagaagtaggctaattttttattggccttgaaactataggaaaggccaacaggtagaaataggttaataaggaagcacatattgatgatactcaacatacatgaagtggagtttccagaaagcaaacgagtgggggtttggaactaacctacattcccacagggagtttttggtttttcccctgcctaagatcttgcctctgaacatttctttagataaagaaattatagcatttgtaataaataacaagatggctttaggtttaattgtcagccaagaaaacagagtaaattcacatgtaagagtggaagggaaggagcaaaacatcgacattgtgatacatttgggtgtaccctgactaggcaaataactcatcgccaagtaccttcccagggagtcaggtaaccactaataagaaaatagacttatggctataatcctatatattttcattcatatgtctagctcagagaaagaggtgagtggtgagaaaaatcacagcaactgcagacaagggtctataaaaggacatttaaaataaaccaaaaaacccgaatgaatacatttacttaatgtgtattatatatagcctatatattttttattaaacacttccacacttaacactgtatctaccaaactatcagtttcagattaagcttattaagtgtactctgtttgatcataagtataaagagttttctcagcaataattcttattcttccatgccaaatcacatggattgatcttacaggaagttaacaaatcctatatttccaaataaataggcccaaataatttataatgtgatggtgttacttgtcttctatattctggtagaatcgatggacagctaccttatgtgctttcaatctggaaaagtagccagtttgtgatgttctttttgatttctgactataatttccctccataatattccctgttgtctgaaacacctacatatctgaagctaacgggcatctttatagtaagtgatgctgaaataacttctgacctacagctccaggaagagtggctaatcgaagtaatgatcagtgtctcttctacccatttctgtgaactctgatgctttctgaatgtacggagactggtcaagatgttaatctcccagtgtagggctggaggacagtggtagagaaccactacatcaccattgggaggagactgtagtgtgaactaagcaaattagagaatgtagaagaaaggccaaaaggaaaatataaaatgaataatggccatggctaatcgcaaaggtaaatgtatctcttcataaaagaaatttactctatttattgaaagctgacctcaatttctacctcttttcattgagactccattatctactcctatactctcttcagttgttttctctgcaattttgttggcatgattttagttcccatgtattgttattctatctctgcatgtacattgtccctccaactatattgcaaatacattagggcagggtacatgtttgatgttgttttgagtctccattttgtcagcaggtgtttttcttcttcccaaaatgcagcctgccagccacttacaacattttcccataaagccatggtttaatattgtacatcaccctggacttagtgaatttgtaggatgtgcttaggaatctgcattcttaacaagaaactaagcaacaccgatgctcacaaatgtttgctagcctaaggcctaccacagaacaggtgctcgtaaatgtctggtgctgctgttagaatgatgctttctggcatgtctgtatgtatctataaaaaaaacaaagagatgttgatttgctcaaggtgtcctctctctgccactagctagtaaataccttgagggttcatgtcctttgcagacagttctctgtatctccttctaaatttttttctatagcactaagtacttcctagaatgtaccataaataattgtttatgttaaggagtagaaagggaaaggtggtggaagaggaacagaaaaagaagatgaatttatggttgggaggcatacaagggaggtgttattcagaaaactcctttgctttagcgaacacgaattcaaaagtgctaatgaagtctcttcctaatcctttctacttaattcctttgctctgctcttgctaagactgaaaattaccctcctatgatatttttgagattactaaagacagtcttgtgtgaactgaagacaggtcacaaatgactggcatacaacaaatatgtccttagtatctgagatactaaggaactgccggtacctatttttcctcctcaaattcaatcaaaggaaatcatttccatgtcaacatgcacatgcatgattgtatatatatatgtaagtataattacttcaagtggataaacttagcaatgatctttgtcgattgagggcagtgttaatgagctgtaaaatggactcaccctggtgcccaattgtcttttattacaaagggcattctttaacttccactgaggtctaactcccacacaaaccttctgtgctttcatttgattattaccaatagccaaaagtcaaaggtggaaattgagacttaagaacatgttgcttacacccaaagcaacagggaaatgaggctttattgcctctcttctttaggcttcaatactatcaatgttgagaaaacccttgctctccatttccatttgattatcctgagaatatgccttgtactcaagaatttctaacaaaaaatcaaatattttatttttaggaacagaaagacctatatacattaaagattgtctaatcactacaccttaattatggggattatgtggtcagttgagttaagtgatttattcagagttgcaaggttaattaaattatagaccagatttttatcctgggatctacgaataagtttcaagggaaggatgaaccttcaaaattttatgcaaattgtgtgtgcacagctgtgcatttttttcatctgtgcatttttatggaaagtggatccacaattttatcagaccctcaaaatgtccctcaacatagctgggacagttactgttgcaatttataagatatttttatatttataaaatatagtaaaatattaaaggtcatgtaatccaagcttacagccaataaatggattccttaaataataactctgatggatagcatgcaaactctaccttgtatcttaagataattgataaccaaccacctctcatgttatcatggttcaaagcttgaattaaaaaggtattcatatagctgaatcatattatttctttcctataccttctcacattggtctaagtactaccctttgcagccatgagaaacaaaatcactgttgcttactccaatgtctttcatacatttgaagtaaattcctgttacatttcttcttcggtcataagagccaagatccctcagtattctagtcaccactctagactcaaacttagagctggaagaaacacatttcagtttgtcagtattctctaaaatccatataacaaaaaacttaaaaacaatgttctacttgtgatctgacttgttgatgactatctccttctggtggatgtgttctctctttttgctggggaaatcatggtattttacggtctaactgggaagatcagagcctaatgatttttatataggttttccacctgaaatgcaacaaagtaaataatatgcagctggccattcagacccaactctagataatcacatttcaaactttaatagtcatgaggttcacctaaataaacactggcaatttccaaaagagaaacattaagcacttttatttagatgaataatccagtactttgcccagaggttgagtcagaaacaaagaacaaaaaacctcagatttataaaatgagtacagcaaagatgacttagagtataaagtttttctatttcaaatgtcagaaaaatgctcaccagatttacttgattacaaagttccaaaaaaccttttattttgcaatactcactcatatcgcaaactttagtgatgtagcaacaattatgcaaataatttaaacaaagtaaatggactacatgaaaaattcaatcctcatttctatattgattatttataccagcactccccaaagactgttagaagcaacattgatcctaccaaatgctcagaaaagataaaaggccaacaactgaatacacttcaaaaacacaccttaccatacctgcttcttgggactcccactgcaaatgacatattttagtctccaagaacccctctttttaatgacatccattagcactccacaacaccattgttccttataaaagacattgagcattgctataccatgttgatctaattaaccaattttctgcaaatctctactttactctgtgttttaacatctcaacaagtatgagtgtagactcttgggtaatatgatctcattctcctctatgagagcctcctctgcctggttccctgtgagccaaaccacaccccaaggaggagttaatataattacttagattagggcattgactgttttacctaaagaccaggatgtccatatcagatttattttattttattttttattattattattattattattattattattattattttgcctcagattgaggtagaagactctgagactgtgagatcaggataaaaattgttgttgatattcctcttccactcccggcagctggatctctaattgaactcttctgctccctagctcccatactctcacttgcaggaagatataagaacaagagtgacaaaaattcaaatttgcaaagaaatctctcttaaatttcaaggtcatattgggtgatttaattcaatttttatagagagccctgaatttggaaagaaagaaagagagagagaaagaaagagagagagagaaagaaaagaaagaaagaaagaaagaaagaaagaaagaaagaaagaaagaaagaaagaaaagaaagaaggaaagaaagaaagaaagaaagagaaagaaagacagacagactagtcacatattctgtattgttttctgagaatcctggggagtaggggttactgaggatggtattaaaatcatttgcaggtcttggctttaatatcatcaaattagccccaaagttatttgtgattattatttgcttttgagttcttgtattttaaacgttatcattaaaatatttgcaggtagataaggaaaagctccagatttgcttcaaaatgatgcagttggaaggtagagattgaaagggttagggttacacataaaatggtagttagaattgcacgatggaggctgggtgtgggctcacacttgtaatctcagcattttgggaggccgaggtggggaggatcacttcatctcaggactagcctgggcaatatagcaagacctcgtctctatttcaaaaagaagaaaaaaaaatagccggctgtagtgggggcacacctgtagtcccagctactccggaggctgaggcaggatgattgcttgagtccagaagttcaaggctgtagtgagcatgctattgtgctccagcatggaggacagagtgagactctgtctcaagaaaataaataaataaataaataaataaataaataaataaataaataaaattgggtgatgatttcatttggcttccttttacttgcctgttctcttacttgtgtgtgactgataaaatctgagattataattaaataataaagcaccaaaatctcacacagaactatcaaccatcataaataaactcatagacataagtggaagagttggaaagtttttgccaagtggtcaagatgttcactgctgtaactaagagcttccactgaagttactattatcaaccacagcactcataaacacatagcactcctgggcacattttctatttatttaagtgacttaccttatttgatcaaaaagaaaatattaaaatcaccataaaactatgtaattagtgattgcatggtgatctttatgtgatgaaatttttaacagttaatatctaatatagaattaagaatcctacacaatattttaaagttatattttcaaatccatattttgtggatttcaaataattccagtttgaatgcttgcaactgcaacaggtttctgtaaaagcttttgagtttcacagccttccttttgacagatttcttaagttatggaatgcagccatcagcagtctgtagaaaaatgaaatgctgcaagtctatttttatgcagctgggatcaagttactaaatggatcaaaagaaataatttctttgaagaggtggctgttgacaccagtgccctaaaaataagtgcaattttgtgggcataaaaatttgtttatatcttagtgaaagtaactatagatatattttctatatatacacttgcattcatgatatattggatgccattctaaacatcttttaatataccttagtttaacattgcttttaagaggaaagttgcatgctttctcttgaataattgatgtagctaaagacaattattcataccaggcttagcttactgggtttataataaaaacaatgatagtaatttacctaactcttactttgtgccaaataccagccaaatacttcccaacattatttcatttgattttagaattacattttattttaataactagctattattttcacaattgtatagatgaagaagctgattcttagagagtgtaacttgccaaagattacacggctagcatgcctctgagttaaaatttgaaagctagtctgtttaattctgaagctcttaatcactaaattttatactacctctttaggttggatggcatatcaactgatttgaaactatagaaaaaaattaggaaacagaataatcttttaaaatatctttgtatgtgaaagtaagcttgcttatagaaaatgtagtaaattgaaagactattactattgcaatagcaatagtcaaactgaagcctatagaactcaaatgcatgtaagtgtcaaaatagccaagtaataatgcgatatgatataattttttatcataataaaaagtcagaaaacaaaattcataaagagggctctatgatacaagaggaaaggttgatctaagggtacaaactaaaacattttaaataaagtttttggaaaaaacaattttaggctccgaaataagaaataaatacaaccccttcacagataataataaagaaataagccaataagcccttaaaatagaacgatatagtcttagctctggaggacaaaatattctctacttggaccctgactcatttagaactcctgcacataaatacatatatatatacacacacacacacacacacacatattgactatattgctgaaggggagagtaaaggaaatggtgaaaggatcatcatttttattatttcattaattcctgaagaaaacacatacacaaattgcaattgaagcttctaaaaaacctagaaaacagtataaaggacttagacacagtacaagtatttcctaccatgtaagtctgaaagagagaaaatcaatttttatgaaaacataaaacagtgatttgggttgtgaacaaaattatttgtctccatttgtgttctattggcttactgctctgccaaattttgaagcaaaatgaaaaaaaaaaaaaagagagggaaattatagcaaacctcccaaaacatatcccttaaactccgcaatgtatttaaactacccaggttctgttcatggatatactcaaacattgagaaattgtgggtgtactgggttttgatgctgtactttttgtaacaacttgatattggagtcaaaacatgtttttctatcttgtgttgctcagaaaggtatgagcaaatatatttttcccacaaatttcaattaattaagaatgattaaaatgtggatacttgcaagggaaacattaataaaaacatgaagtgtagacatagagataattttctctgtggcggatgactgatcatgtcattaggcagagctttgttcccttaggctctgtagagtcagagctaggataaagaatcacagatttagagttgaagaaactcttaacaataacttaacaaccattccaatccccttgatttatagataaggcaggttagtcttagaaagaggaaccggttctttgtgtgagactcaacaagtcacatcaccgctctgcgcttctgttcccaaattctttttctttctttctttttcttttcttttctttttttttttaaatgagtaagggatttcctttattattagtgagattgaacatcttttcacgtcattattgaccatttttatttttctctacaaactgattatccaaatctttctcccatttttttcttttaaaaaattaatttaagatccaagatacatgtgaaggatgtgcaggtttgttatgaaggcaaacatgtgcgatggtggtttgctgcacctatcaacccatcacctaggtattaagcctcccacacattagctatttatcgtgatgctctccctccttccaatccccctaacaggccccagtgtgtgttattctcctccctgtggccatgtgttctcattgtttagctcccacttataagtgagaacatgcagtgtttggttttctgttcctgtgttactgtgctgaggataatggcttccagctccatccatgtctctgcaaagggcatgatctcatcattcctttttatggctgcatagtattccatgatgtatatgtgccacatgttctttatttaatctatcattgatgggcattttgattgattccatgtcttttttattatgttctcacattcttaaaattaaagttgggactagttgatctccaaagtgcccacatactaaacgctgaatggtttcaaaagaaaagtgagttaatggcagacaataacctcagatctcagttcctaccttgttctcaccagtccagtttgtgttctgccatttgctcatatatttcactgtcactacgtacttatgaaatttgtaagtcaataaatggtgaagaaaagaaaaacaagaaaagtcatccacattttagaagggcaaaattgtgagtaaggagctgagtggttgaatccgaatattttcattaattccaaacaaaggcaatggaaagtgggaaggaggggaattgcagttctataagctatagttgctccataggagaaagggaagagccagcagtaatcaggactttttaaaagaactgtccaagttcaatgacaatatcatctagctctctgactctaggcatctgccaagaatcatggaatcttcatctcagtaaactaaaaccaggctagacaaagcaggcacaaagaagaagagaatcacattcaataggttagtcagtatatggtaagctagatcagccatggaaatatgcattagtcaataagtttgatacctaaatcaatggagacatggtctaataactgacctttcattttttggggtgattttcataggcatacatgtttacatagcaactccatgagaatttacaataagtagatgctgatattcattgactattcagatagtcttcaacttaagatggggttatctcctgataaactcatcgtaagttgaaaataagcagaaaatgcattcaatgcacttgatctatggaacacaatagcttagcctagcttcaaatgtgctcagtgatatgagcttacagttgggcaaaatcatctagcagcacagtactctgtagaatttcggttgcttaccctcgtgattaggtggtttactgggagctgtagctaccagctgctgtccagcatcttgagagcctatgaactgctttctacccacagttgcaccaccgtaaagttgaaaaatcctaagttgaactgtattaaattgggggctttttgtaatcatttaggagtattaataatatgtaaacagtaagagggagaaatatacagcaataaatgcagatggctcattcctaatttgagaaacaagataatgcagtttattctgaaaagtgattataaatttgaaatttatggaaggaattcaacatcaaacaggtaactttaagagggaaactcttcctgacccttagctagactaagttatgttcagataaagcaatctgacttcacacacatatgggttgccggacttttctctcacttacataattttgaaataatttgtggaatcatttgtttaatgtaaacattcttagattttccagagagattatggaccttgccttggtcatgggtgtagtcccagcccttagaagagtatctgtcatgcagcaggcattcaaaaaacatttgtttaatgaagaaatgtccatgctacaatatgtttgaacagaggagagggatagaaagaaaaaaaaagactggaaaagaaagagagagaaaggcattattcagaggaagaagataaaagagatgaacagagactggactatccccatgacattcaaaactgaccaactgactctttgtttcacacattgagtgacccaggtcaaagccctatcagtcagtatactcactttgtatccctgacacacatatattttcctaagaatggttgcagagaaaggctggaaaaaaaggggatggaaatgaacattaaagagactgacagggaataataacagtgaaacagacaaactctattgtgtacaactccacagtcgaacattttctacctccctgagaatcagtctcgcttgcaggtagagtattgactgctaggcagagcaccatggctataaaacagaccactgagctaggcaataaaagagagagagggagagagagagaataagaggtctaatgtcttgtttatgtcccctttatagcatctttgagaggctctgcagtcccacagctggctttagttcatatgcttttctgattaaggcaatacgtaccaaagcaatctaatattaacgtgcaatttagaaaaaaatagaagggtgtaaaaaaggaggaaatctccacaaacagtgtaactaaacaataaacagaatacaagacttgcttaattctttattaaatacatgctttattttaagtccctaaaacatttgtatctcattttaaacacccagttctaccatattgtgtttagtgacactaatccttctttatagcctaaccctttgagaaataagattatgttcccagtaaatagtagtaacaagttttattataacaatcctgatcacagatttataaaaaccttaaagaaaaaacatggaaatagaaatggctaggataatatccaatatgagaaagatctttatttaacatgaagtataaagcttggctgatgaaatgtctctaagaatatttccaagaatatatattttttacttttcattaagaacttgactactctttttaatcttagacattggttttatgctttataaccttaccattgtgaaactcagcgagcctagagaagtttgggtactgtgtgcaaatctactcaagtgtttagcttaccacattgctgagaaatgaccacatatgtgtgtgtgtgtgtgtgtgcgtgtgtgtgtgtattttttttcccaagagaatctatcttaactctgctgattatactatataacatatcatgactatcttaactgtcaaaatggtcctaaggttttgacgcaactgtttcaaataaacagttgttttcaattcttttttatatatttgtatctgatcttgagatttagattgataataatagtagagtggttaagtgaagaaatttaagagtcagagaggttataattctggctcagccacttactatctgactgagcctctgttttctcatccataaagtgggaaaaatacctagccactagggattgtgtgaggattgaataatgtgccttgtgcaaagaagacagcacgtgcccaatacataatgtgcactcaataaatgatagcaatttataactacaataagtgattgttagtattaataataaaagccacccgttatagtgcagtactgttaccataacaaagcctgatgtctatctcaattctaagaaaggctattttctacctcctgtcttctctgaatttctacttatgccatattatcatcaccaataaatatttcttgtaagcctaataagcataaggtattacattaggccctctaaagaatacagccagaatcaatcattctctcatgtgggccactaccagatctgtacttcctctatcatagcagcaatattctatatagtgatgatttatttgtctctatttaacccactggatagtgtgctttcatagataagtcttactctatattcccagcacccagcataatatcagggacataataaatgcctatccaatgcagaatgaatgaatggaacatggataagcccaaagagttcaggttgaagagagacattatggacattcaaaagcctagagaacaagacaaagtttcatatacttatgaggaaaaaaaaattgccttctctgtgtcagtgaaatgctattgttaattcataaatgaagtagtagtctcatcacgacagtcttctgggtggtttcatcttatattgtgaacaaaggaatgggtggcagaagagggaggaagaaactcttaaaggatgaattaccaaagagtacctggggaaacaatgtgattttttactgggcttacggcatgccaatcttgttagttttgcgaataaactgacaagtagaaattggaatttagtgagaagtctaaaggggactcaggcttttaaacacacacacacacacacacacacacacacacacacacacacacacacacaatctgcttttggctatgaaaaggagctagagtgatatagaatggcatccaagagagtaatgcacatcagaagaaactagctccagatactattaggttggtggaaaagtaattgtggtttttgccattactttcaatggcaaaaactgcaactgcttttgcaccatcctaatagttttaaatgcaaggtgcttaaactaattgtagaaccagccttcttggccttatcaatcaactagcaaatatgcttcagtgtaagtcaactgatcagagggacttttgccaggagtagtttcagagattctaagatctggggccatagatgcatacagtaggaatgatttaagatgggtctttagtgtagaatcctatgaattccagagaagactgttacaggacagagaagttatttagtctgaccaaccaggactgggcttgaggtagtttctgaagagggattctgcaaggcccagagtagagcagagagagttgctcaatctccgaccagaactaggagaactagtttaaaaggaagttgtaagaaagacctattactctatttatgaatgaagtaaaggaatgaagaccttacaagaaagatcagaaatccttatcactagcatacaatgtctactatacagtaggcaccaaatatcatcttgttaaattaatttgttgttgctctgatacttccccattgtattgatttatctttaaatgcttatcatgattttaatttggaaataagaatagtcttctcataatattggagtgtcaagtgagaaataacaaattgtggttagacattgacaatctctgataatctgtcaagacttttacagactttacttagtttaattatcatgggacgtcagagggaatatttacaccagtggatactagaaaaatgaaaaatactggtttcttcaaaagtatagggaaacaaagaggaaacctttctcctgggcatcatcacttatttttctttgatatttattaagtgcacacagcattccaggtctgaaatagcctatggccaggaagcttctcctcctggactggcattatttctccctagatagagagttatgaaactccaaagcggaaggaaaagttcagctgtatacgtatcatctgaagttccccatgggcagaccagttctgattcaagtcaggacgagaagagattagcgagtgggaagacagacatacggtgaatgtcagttgtctctgaatcttgattctaatgaaaagtcacagcttttactggtaatgccctgaagaccaggctaactcagagataacctttgcttaggaagacttcttgagccgcctcaggttcaccatactttttctcttgctctgaatcctcctggtacttatcctcacagtatctacctcactcatttgcattatcttgcctttttttattttagaattgttcccatcatcatatatgttcttggtcacaagcaacttgatcgtaaataatattaattttccttatgatctgattctttcagggccaatcaggttgtgcagaatgaattaatgtgaattgaaattttcctaaaactttgaatcccaacttaggtcttcctggtatactattgtgaggatttcagcagagtacaactaggacagaatatggtctggtctgatcattcagtattgaattgacctaggaaatactctagaagatacttggaacccaggtatcacgcggcctgttttccattcagattcaccatcatcagttagcgtaggagaaaaagggcagaaggaagaacaagaaagtaaacagctgctaccattaagaggaaatctccatacagtctgagatctcccaggctcaaaacacatgagatttaaaacaaaaaaaaattcttttaaagttttatttttagttaatacacaataattgtacatatttatggggcacaatgtgatgtttcagtacatgtatacattatacagtgatcaaaatatattttaaggattcccttcaattgtgcattggccacaccccctactatggctttattttcttctcagaaagaataaacctgacaaaagaaaactaggttaagagtgggaagaaaaatgggtcctggtactccctgaaaataatatacatttgacaaatcttttacattgcttctctccataactgtaaaattaaaattcttgagcggaatgatcccttacagattttttttcagccctaatagtttatgctgctatgattctagctaatcaaatctactcctgacagtttctcaccactgtggaaagtactacaaaaagaccagttgggaactggcagctaatcttccatccttctgatagctttgctgaaaagccagttcaacttaccccgtttatacatgttgaacttgcctagatgcctgacctttgtcagattttgaagagaagaaagtaaaggaaaggagaaaccttctctccatccaacttttactacacatgaagtggtaggtcagcattaaatgactttttatctgtttctgccttgtgtatcagaatatggattttcctaagtgacatcaagcttaaaaaagaaattagctagtaaatgttttcctatctattgacacaaagtaaaattatgatggctttaaacaatgcattctcagccgggtgcggtggctcatgcctgtaatcccagcactttgggaggctgaggcaggcggatcacgaggtcaggagattgagactatcctggccaacacggtgaaaccccatctctactaaaaatacaaaaagttagccaagtgtggttgtatgcgcctgtagtcccagctacttgggaggctaaggcaggcgaattgcttgaactcaagaggtggaggttgcagtgagccaggatcatgccactgcacttcagcctgaatgacagagcaagactccatctcaaaaaaaaaaaaaaaaaaaaaaaaaaaaaatgcatcctctacataaggtattgtttagggcccagtttcagttgctgattgtccccttctctactaaattcttcaggtctgtaggtagtactctttcccatgcacaaatacccaactaatcttcagacttggaaactccacttaatgggttgtcccaacattttctttaaatccatgaatttcacacttacttccttttttgttcaatacttcaaaaaaattattattacttttagagccacatacaaccctgtcttgcatctcttgtatttttctccacctacacatgggcctgttttctttgattctcccaggtctatcccagctgctccttagaatcattcacccactcaactcttggcaacttctacattgctgtcccttaatcttggaacagccttccaatcaatgtgttttgagccacctcctaacttcagaaagaaaattcctcaaactccatctgtttagagaccatctagtttcaatgatcagtctcctcaccattttgagaactcttctaacatgttgaaatgtaaatactaattgttttcacataaaaattagcaagcactttagcgtttaatccaaacacccccaagctacactttgaatgaaaatcttcaatttcccccaactttcccattttaaaaatgggattgttttatgctgaagttaagaaatgaatctccattgcagtctgtgcatcaatgcatgagtgaaggaatgtttgcattgctttgggcactgtagagcctagacactgttcatgtacacatggttaacaatttacttctctctgcagtattaaatcttctcatgtcagagactaatagatcacagcatagttaacttactcaaatgacttccttaattcagtactgccagaaagcatttgaaagcagcaaatcccagaagtcttagtgacttctacattaagctaatgaaacgcatgtattcatgctacccgggaatgttggtggcatgtggcttacacctcaaaccaacactctcagtgggtaaaccaggagtggcagcgtgccattttcgtatttcttttcctgagctgcacactaccaccactttgatttctatcacagctgattccctttctaggaaactttccaagcttgttctcacacagcctaagagctgccttttttcaaccttcatcacttagaataccaacaatcaacatcctcatgtatttcccatactggtcaacaattttatcaatggctttgataaaagtaacagaaggcatgcctcttatatttatgaatgacctcaaaataaaaaacgtcaaccttaaggtaagtaaagttcagaaatttcctaagaaaaaaataaaattatttattattaaatgtatgtaaataaaactttcttaaaatatgcactacgaaaaggtggaataaaatatatcaaactaaaatagtgatatattttatcactaaaataaataactaaatatacatgcatatatatttatagatgtataaatatctatgatatacaaatgtctacatagatctctacataaagtttttctatactttccaatttctgtttaatcatgctatagtactttgataagaaaaatatattttaacaagtcattcattattgaaatgcattttgttaaatattaaagacatcaatcatacagaactgatggttgtaagcaaaatatcattttgctatatttgacagagataaagttaaaaatttctgcacttaaggtttaaaagataaaatctgtaagtgcaaaatattggagatttgtcttaatagtaatataattgaaaattatcttagatttttttttcaaattaagagtgatctcaacacaagccaatcatgagatttggctgccaaaaaagtaatggttcataggaggtaatttcaactaatgagtcttacagaagtaggaattgagcggttgtctttttttcagcaaacccagaatgaaagagcaaagtcataataagattatagactaataagatgaatataagcaagtatgcccaacaagcaatagaacccccaaattgagaccttcaagcaaattgtgggggcaaattgacagggagctactgatggcatcttatgcccccttgcaacttcaatgattcaggataccaagttgcaatggaaatgggaatgacagttattgcatcctgtggagacaaacatatacttcccaagaatgaagtgtgatctgtgtagtgagaatactgggctacgcaggagaaatactgaattggtggccttgagcaaggcacttagcttgcagttccttaatctgcttgtatttagtgttatgctgcccaggggctggacaaggaactggatggtttataaacacaattatacctatgccttatacaatactccatgagagctaatactattttcaatttatagttgacagaacaagctgagtgatctagtgcatagtatccgaagtttttttctaaagttagcattccttgcttcattgcaaaaagaaaaattagagccacctcaagtttcaaatctgatcatatagggtctgattcacccaatggttcctcacatttttcatgtgttgtaacttttatccatgaatatacaatttgtctggtattgtaataaaacaatagactttcaggaggaatgaaaaggaggtggtgaaggaatggaaaaaagtttcctttaagtaaagctagagtaatctgcttggcattcctcacaaagtttaaaatatatcccatttataacaattataatggacttcagggtgggtggggtaaattgatgagagataagaaaacacctgaaaaggtaaaatccatttctagttaattgttatcaattaagttgtttttctctcactgggacactgttctcagtgccctcaggccccaactacttacagtgaacagaactaatagcagtcagtttcattatgtctccttaacaacacgggaacctgttgtcctttaaaaatatataactgttttaacctttacattttttatttactcatacctaaatagagaacttctgctaaggtaggagaagtgaataccaagttcagctcaattcagttagttgtgctaaaggctaaaattacaggaacagtatgaagaaataattgacagctgaagtgcatggtcctatgaagcttctcttcggggaatctgtgattgctcttaatggcattttcaaaaaaaacaggtcctgttaattttcaagatatttttaaacactcgattacttttaaaataatcagcaccattatgaactcccaggaggctgtgaattaagaaatgaatacctttattttataacattttacaaaacactcactgtggacaataaatatcaaatccactaggggcttgggtaatgaaacacacgtcttgaaaaagtaaaactgaaagatgattagataattaatcacaattaaatttctcaactgattttgaaggagctaaacacaagagagcagtccacagcttcatcttttacttgaaactttttgatgcctcaaccccttacagatttaaggtacatgctgagtaaaccattttggagaagaaccaactataccaggtagaaaaactacattttgggcaatctggggtggggagtacaggcatgattctgaattatgccattcataatacagtgaagtaaaatagactgattatgaatataccatgtacttgaattgtccttgcagtggcacagggctgatatcaaccaacacaaacaataaatataatgtacctacatttctaattgtttataatgaccatcaaatatgattctagttctaatctctttgacgatcttctagaggtcataattctgtggaggacttgccttagctcgggcaacactgagaatccagtacatgtgtactggcactttcatagccacttggaacacatacaaatgctgtatttatctttattgccctgtatacaaaccagggtttggctttcctgtatcctgacagtcaaaacatcttccggaaatgcttctcagcaggaagttggcagtaactctaaaattgggtttctgacagggcattctctaaggagtatcgttgctttggaattataattttatgctccttagattccattcaattatattgaaattcaggatatttgttgaaaccaatcctgatactctgggaatgatagggcattcttttcttatcatatttcagagataactatcaatcattcttttagtcttccatttctttgacacccttttattgaacatctcccactaaataaaggttctctgattgattttatgcaacagcaaagtaaaaaaaaaaatattgttactttgagatgtttatagtctggttaattatgtggtcactacattaaacaaaagaaaacacatcttgtggcgttagcagtatgctgacagcctgggcaacgtggtgaaacctgaagtctacaaaaaatcccaaaaatcagccaggtgtggtggtgtgcacctgtagtcccagcttcttgggaggctgaggtgggaagacagcttgagcctgggaggcagaagctgcagtgagctgagactgtaccactgtacttgctagacacagagcgaggccctgtctcaagacaacaacaacaaaacaccaaaaataaaaagtaaatatgtgtgcaagcacaacatcagaccaaaatggtgataaacagacagattcaggcatatgaataagttgacatgtccaatgtatctagtatcagtcttctttattcctaaaatatggaataaaatatgaacaccatttagtccaatgataattcttacatagagaaagaaagttagacaataagttctgagacaatgtccaccagcatacaagctatttaaccaataaacttagatttattggttaataataataactggtatcaataatatatgaacatgtcattgatacaagtaaatctcttgattagacccaaatgtatgaaattctaatactgattctttgtcttttctctcttctcttatctatgtccaattagtttttcaaggcctctcagaggttatttctttcagttcccaaactacattaggttctcctataatcttttcttggtttgaagcatcttcgataattttaagttaataaattgctattttttatcaatgtccatcttccacttttaaacttaatttcatttagctgacttgtctgcctttgccaatatacctatgaccataggagagtaactggaatgtagtggatatacatatcgttaaaaaagctgttgaaataacccaaaccccagggaaggcctcatattcaaatggaactttaaatacaccattgctggttatacttggtgatgttatggtatctaatttcttttcgtgaaaaggttaaattaacaaattaaaatttcagactggcatgtcaaactcagaattatttataccaagttaggcaatgaaatgcctacatcttatacttgattttatatactttcttcgtcttaaatagtagtattagactgtattgagtatcaaaccataagtatgcattctttctgtaaaaatggtcaaataaagacaggtaaaaagcatggattttcctgtatgtttttatagaaatttcatgtaagctaataagttataggtttgcctatttaaacaggctttcacctggaggacaatggggtgttacaggaaataggagaaattctcataaggatgattaagttttcctaacttctcctcctgccctttttttaattccatgaatcaaaagggaagtcccctttgtacattcttcttttaacttataaaatctatttgaaaacttataatttaagagaagatctttttgtgaatttaggaacttattcctgagagcaactaatttacacaggctagtgtggctcacgcaatgacttaatttttaaaatatcaatgctgtgtaactgtactattgctacaaaagttggtgacaggagaccttggtaagtgttatggtttgactgtgttccccaaagttcatgtgttagaaacttaatctcccatgcagcaatattgagaggtgaaaactctaagaggtgattaggccatatggatctttcctcataaatggattaatgtcattagtataggagtgggtttgttacaaaagaaagtttggccccctcttgctctcttgtgctcccttgacccccacctcccctcaacacacacattttaccatgggatgatgctgcaagaaggccctctccagatgctagccccttgcttttggacttcgcagccaccagaactgtaaggaataaatatctgttctttataaattatacaatctgtggtactctcttatagcaacacaaacagattaagaaaataaatcatattagtatttcacaacctagaagagcaggaattttaagaataaacccctgaagcacagagttgatgtcatttattctaatatgctctggactgattttcccagactttggaaatgttttacctttaacttccagaataactttcaagaattttggcctccctagtagagctcagagagctaaaacagcagaattaaaaggtcttgggagtgaggcagggcagatgaaaatgagaatgttgtctcagatatgttagagagtttcacaagtttgcagaaagaaaaaaaagcaagaaaagacaactgaaagatacaagtaaataagactgagataaaatgctggaataaaagagaagatccctgagttgactgtgcattaatatggaatgggaaggggaattgaaaaaaaaataaagcctatagagcaaaattttattagaatagcaatatcataagttaatgagtttggttataactaaacctaattatagtgctttaaaaataatcttcttgggaagagaatccatgtgtttcaaatttacattacatttgaaatacaataaaagcaaccctcttaaaatatagttattagggattttatcacttattttgaaaatctaatacatgatattgaagcgttgggaacactgggacaatgttggtttttgtcacaatgcagctttatggcaaggattcctattcttgtttatttaagttccaatgtactaataagataggctggcttttagcaaatggatcaatgagtcttaatcccagatctgagactctctgttggttacaaagcttctaatttacacagaagaataagaattaaaatggtcaggctgcaacaaatggcttagggatgaatgagaaacaattgaaagtaatttcctcaattatgtctcttctctttttacatgcagtttctgtacaattcagagaggtacatacagagggaccacttcatttagtaatctatgtttccgacaataaaagaaatcttatgaacaattgacttattttcatttgtaaacatctctgcagattaatttttgctgctacttaatgaggcagattatgaaacttacttattaatttatcaaagttgccatctatgataatcattgaggtgtccctctcttgaactactatctgttcatcaccaatacagccaatcatgcaattctaaaatgatgtgatcacaaggcttacatgataactagcgatgaattcatcaaaccaaacttatttaataataccagaactagcaaaaatacactaaaggagaaattaaactgcaaataccttctcaggtaggctttttatatgattgtcttactgcctttctaattcccatagcgacctcctttgttattatcctgctacataaagagttgactgagttgaaattacttacagattatcactacaggatgcattttactatactagcgttttgatagccctgactgtaaaacattgccagatgataggatcatagaagaggaatagaaatgtcaatgcatttaagtcatgagaaggtgccttagactgcaataggtaaggtgaaaaagagatgtcttttacaaagatatgcaaatattaaatatcataaatcagttctaaattttgagctaaactctcagaccagaataatttcaactttaggggaaaaggtgaattgatatacagtaatagaggacaaagagaaagctcatagtggaagtaatattctttgtaattggtcatagttggtgcttgataaatacatgtttcatacatgaataaacatgcgaaaacaaagacgtagtagagaaaagttttcaaatgggtatcctgaaagctatatcaggactgctaactagatggtttggccaaggtagtgtattaaaagcaaaatgagcttggtacagtggtgtgcacctgcagttctagctaccagggagggtaaggcaggaagattgcctgagcccaggagtccaagaccagcaaaatgtacagtgtttaaaaatcaacagattttactttaaatcttcatttctttaaaatttggatgacatggaaacattcccgggaaagaagaaaaaggggagaactataatggataaattgcaggcaacaaacccaagacattttcaaatcaacaggtgccatctcaagagagaagccattctattgtccagatgttatcaatttctaggtattgtaatttaagggccctctccataccaaaaaaaaaaataataataaaacatatgtatactggatgttttccttctttgaaacaatttatttctttaacatccaaagcgctaaacattacgtctgtttttcttatcatactgccatttattctcagaactcaatcgcctctttagacaaagtgcatttctcacggtacctggtttctttggtcatttaatttatctgcttgctgaaatttgagtcttgtgaccctccaagtagaagttcaatgaaatatttcagggagaaggattacaggatagtgtgctgttttcaaaatacacaaaacaggaaactgttaatttaagaagtaaagatattttggctgtggaaaacagaaagaacttaagaaaaatgagaaagataggtaaaattaggctgttccaaagtctggattttttgaaaacttgagatagaatgtatattgttcctcacttttatcataacaacttcatttttactagtatttttattctctgaagtttgttacatcgaagtgttcctttagcaggaatagatagatttgaaaaataggcttaatctactatttcttcaggactttctccctacatgagaatctggcaaaattactgctcacttgctgctgacacatacaattcccaggaaaaaagaaaataagaggaagaattatgcgagaaaaatcacaggcagcaaataaacccaagacattttcaaatcaacaggtgtcatctccagagagaagccactttgttgtctccatgttgccattttctaggttttgtaattgaagaatgtttctctacactataaataaaacatctgacacggtagattattctcttttttgaaacactttattttttcagctttcaggatgtcacacgctagttctatttttcttagcttgctgaccatttattctcagtattctctgctagattctgttattttgtgacctccaaatatgagaaggctcagttttcatatctcttccccatctaaactccctttctgggtaatttcatcttgtcctgcgactacaatctatctatatgtgatgatgcttatgcttgcatctccagccacaactctccctgaaaattctgactcatgtatccatctacctacttggatgtccactaggtatatcaaaaccaaagtctaaaaacaacaacaaaacatccacttttccactccaacctcccccaaaggataaaagtcttgattttccattcgcaacaagtcttccgctaataacaccactattctcacaattaagtgggtcagaattaaagaatatatttaaattccgctttcttccactccacacctctaatctgtcggcaagtgcagtctgctctgtctctaaaatgcatgtgggattttaccacttattggcttgaacctcacaaccacctaaatctaagccaccactgtctcttttgtggacgcctgctacagcatcctaatacggttttttttcctccctcttctctgcaatctattgtccacactgcagccagagttatctttttttaaaaaataaaagtcatcctcatgatcaaatgttcccagtggctttctaacacacttagggtaaaattcagatccttttcaataacctgaatgatatgagaaggcatctggcctccttcctgctcttcctggcctcctactctttttccttcctgctcatgctcctccagttacccaggtcttcttattcttcaaacatctgcatttgctatttccatgccttgtgatcctcttcaccaagacagtcacatgactacttttcttatttcattctagggtataataaaaggtcccctttcaaagaagcctctcataatttttcctaatataatctcctattactttctagctcactttttcccatttccctgctatgcttttcttcataggtattatattatactcacatcatattatttcttttttctttgttattgatattctccaatagaaattatgttctaggaggataagaattctattttgtttacacttgcccataaagcctgacatatagttgacactcaacaaatggttgccaaataaatgaataaattaaagactacgagattgaaataccagaaaatgatcataacacttgtcctaattctttacctcacatcaaaaagtgctaaaatgtgctgtttaggaacccaacaaagatcacttaaaatattttattaaacatactcttctacaagcagaagacattataaaaaagaatttttttctacacattatttatcttgctcacatttactctgatataaaaatggattctaacgtatatatcagctctaggaaaaatcaaagcaggtcctttatatgcttgctagttttaaaatacagtctgatttcatccacttcaattgaatacgcaactaccatttccttgtactctgctgaaacttgtgaaagataacaaaatgaatcacaataactattgtttatagaacaacttaacttatgccagggaatgtgctaaaagctttacaagcactatatcatataagttcctgtgacaactccatgaggtataaggttccctatttcagagaagacaaaactaagtgagtcagacaacttgtcctacaccagacagctgttaagtggaggtgaaatttgcatccttgcctttctgatggctacattggtcatttttagtgtagaactcactgccactagcaggactcaagaacactcctggtgaccctgatgactcagttcatccaaatatgtaaatcctctgctctgtcgttagggactaaggttgttgaaggccatttacctatgtctagagtatccttaccagtagattattgaaaagttattgaattactaaaatttagttttcataaactaaaattagtacttaatagagtttactgagaattctaattcaatatcctaatgagaaagctggctgctacccaacacctgagagcaatgcaaatcgcaccctctgcaagagcacatgcaaacaggcagaactgccaaaatcttcagcacagataaaagtgtaagtggttttcaagtgccatttaaagtaacattattcctactctaaataacaaattcctgtttatttagacttcattattgtcaatttaacatgtgaaagtttctttgcttaacagtatcacatgtaatggtacttatttgaatcagaactatttgtgatctaaaattgtattatggatatatttttagatagctacacatagcaaacaatatgaatcatccacattcctgctacaaagcaaatatatacatatatcacaccctgcttgaattttactaggtagtgaattttttgttatcaagagtttgagagttttttgttttgtttttggaatgggttatgaggaattgtggtcaaaaaacgagaacttctttttggtgttaacagggctatgtctgctttgctctagtgattcctaacctactgtgcgaaggaggcatagcaaggcaagactgtttaagtataaccataaagggactcacgcactctcaggtgaagtgcaaaaatactgatcacggtgctcaaacattctggaggagtaagcattcaaattcagaaatgtaagatgatttctcaaagaaaagaggaaaaacctatcattaattttttaaaatatatcttccagagcaggtttctcaacaattttacatagaagacgagtatttttgtctccttaagatttggacttaaggtcaaagttgttgaaggttgatcggctattgtaagcttcaggtgaaacctagagaggagaagggaagaagataaatctactatcctagattctttttaagaagcagcacgttccactcctgactctcccgaagatggtctcaggtcttcaggtgaccctatgcaaggaccctactgtgcactctgctgagtgttctggctctctggtatcaggtcactgggcctactctacttttggtgtcattctggccctgtgaagaaactatgaggagaatctggtcgatgcattttgtagttaacaccgcaaaggacatgagaaacttagccagagagctattagagtggcgatcagtgacgctgctgctctacccagtctgtcttgtgtgctttaagatggaagacacctaatgctgacttagccttccctaaagtgaacagaccactcttctaaggtttctgcttgttgtcaggaagtataagcaaagaatgacaagcagaacaatggacatttgttaagtgattggcttgcatacgttggctccttcaatgctaacagcaacgagtaggtgccattattacagccatgttacagatgaacggtgggtactattattaagtccatgttacaggtgagggcgtgaagcttatcaaggagttcattggtcatttcttgaccaggacacaagctcctaatgtttctctcttttttaaatctgagttttccaacactttttgatttaagaattgatctggaaagcccttcattcacagttgttttctggctactgtcagtaaaaaggataggctcaaaggaaatctgttgtgtttagaatggtggaggtatgagagatttcttttttatctttaaaagcttcattacttgttttactggtgttagttattgactctttttcctttatagtaacagaattatttctgtatgaaaggttatttaaaaagtcacattctaatggcaatcaattaattgaccaacaaatacagtaaaattgcaaaacaaaaccttgcaatgttcttaaatacatttggacactcaaaacaagataaaatcttacagataatgtgaatacattattagttatttcacattagaaaggaagaatgttggaaaaaaacatcatatttggtttaaacattgctttccacacacacgtttcagaggctgtgacattttcaggatcatagattctttggctgtttttccccttttaagtggggatgatttattggctaagtttccacagtaactcccagcacttgtagaactgtttagcaaatctgcattattttgcatttccactaaggtcacggttttcatagattcaaacagcaaggaattttaaaatttctccctctactaaagtttactggctattgtactcattatcttagcattcttattagtttcttttgagaaagtacacctggtaaagtcgagtaactaaaaagggtatactattcaaacgcaatgttattcaagcattggaatcctactcaaataataaaagaaaagaaaactgaaaatagagtgaacaaggttattatgttaggcagagaaaaaaaacagtattgtggaaaacataagtatgtgtaggatacacatgagacctcaaacagatgcatctttgtggaaatgtaaataatttattatagcagataaaactgggaaggagcttctgctaattaacatacacagtcattttccctgtgtagagaagtccaaaaactgtttccatttgcaggcatgtggtcattagactaatgggcactgcctttggacaggatttacttataccccagctggctcaaaaaagtaatcattctctaattaagaggcttcctcatgtgttttctattgtcatttctagagttccactatatctagcttggtagtacaaaagtggtatgctatttaattatcagccagtagtggggctgagagataccctgagtttcatcatgcagtcatttgtttctattgatggtagaggataggagggtaggtatacaagcatatacatgaaagaaactttcttttcccactcagttggaataaattataacatgtctggacaaatatgtgcgtgactattttcaggactgattggaggtcataatggattttcgaaagtaaaactcaaatagagaataagcttgattattctactaaccctctgtttttatgtttttcacttagattttaaagggttgagtttttaaagggctttagtaattttttaagagacgaattcaagaacaggggaaatggccactcctaaatattgcataaaacctggttgacaccacatgaggtctggaaggatatatttcccattattaaacctagctgtccctcatataagaatgggttacttgcattattttttacttttccattcttgatcaatattttcaaatgtttctggaaatgttttccagcactgttagagggtaacacattttctctactcctgagttcatgaggaaggattttatttttcttctcggtttttccctatgcctttgattaccacagttgggaaaaataattttaggcatgttctgttcagttccatgcttcttcctattgggagagcttttataaggaagcacagggccctttgctctttcaagggctctaattcatgggtgccccttgcccagggcccatcacttgtgtgcatggagttaggcttgcctaacccaggggtccagtaagcaggttcgtgtggctctcaccactaagtcatgttgtccaaattggtctttgtgcattcaggtgtttttgaaaaaccttgttcagtattctgcaaaaacttacactattccaaatctacccagctctgtaacgagagaactggtaaaaaaaaaaaaaaaaaaaaaaaaaaaaaaaaaaaaaaaaaaaaaaaaaaaaaaaaaaaaaaattctcagaaaaatattatcattgaaaggcatttaatttttaataaataaatataataagaacaggtctttagttaaaaattaaaaggataatgttgcttgatagatgggagtccaggaaagaattgtggttaggagacatgagtaaaatgcacaaatgtcaggtagacgagtacaattaacacttgccaaacagagcttgtggcataatgcaccccaagaaagaatagtctgaacaaactgtacttggttcctctacagattgttcccttcacctatttgtatactttgcatgaaactactgttacttgctgatataaaacattaatatgctaggaaaaaaaatcacaaatgaaggaagcgatgtcgagtttcctttatactgacatatttcccatattccaatatgtgtaagattttccacattactgaaatggaaaacatagcagaacagacaaaatcaaggatgataattgtttattcatctacactttccatcttttttaaatattcaaattgtttagaactccataaggagtgctattggggggtaggggtcttcagaaacgccgttgctcatataaacataataaagtgggaacatgattaaaatacttagatttctgattgtaatgaatataataaagaaaaactagcttaaataaataatgccagagggtatcaatggctggacaagataagagtttcattagcaaaaccacaaggcactagaccagaaagtttccaggtgaaaggacattaaaaaggttccattggactaatgaaattggaatacactaacaaacatgtcagtgtggacaagtaaggttctgctcaaaatctgtaaacttatcaagaaagtatctgctagaattctgaatgctgaaactgaaaaaaagtgtgctttgggcaaacaaagaggaatgttttgcattcaagaagtgtatgttttatttttataagatttggtagaaactgaagatatgaatatgtttaagaaatatacagttgattatcaaagggcatgttgtgatgatatttcacacacctgggttgatgctccgcaagatatatctattcatgtcatagtgctgtgtgatcaccttaatgcaaaatcccagagcagaggctcttgtgaactgcactgagaagtgcccactctaataatgaaatattgtggaccttttctgatactcagaaaagtgggttaaccaatgtaacatttcaaatttaaattttcttccatgattttctcggatatttttggccctgttatcaaaatatgttcatattagataccaagcgctttgtttaggccttcaggttcctcattcacactcaatgtgggaagatgcttacattaatttttgtttctaaaatggaaatattttaaaatctataccttaagatgggaaggcctgctagtaaaattactcttaatgtatatgtgtgaatcaaataccaatatcactaatggtttgaaaaatcactgcccaggagtagcagtaactgcaggacagtcaggagatgttccagtctctccctgaaagcagacatgtgtcctttggcaaatggtttgataactggggacttggcttcttcactggtgagagcggggagggagagggcttaagtggcccataaaactaaaatttctaagattccttctagatttgattcccttccaaagtatgactaggggtaccctaagggaagacaggacactttactagatgaattcagctgggatcctacgtgagacgtctttaattggttatattaatagctaatggcaaacaaaaggcaaggcagagaaaaggatggagcaattattgcatgctgagaccattttggggtaggcaagttgccacaagagcctatggttggaattttattttattttattttttacaaacaaaacaattcatttaaaagcaacttaaaacacaaccagggtgattttcctaacagctctttctggtatttcaatatcttgctatattcaaagctggagataatcatgcaaaccagccagccttttcacttcctggaagccctagttcagattattttactcttagggaagtgacctctcttcccctattgacctgggaaggggcagaaaaatcccagtagagtgaactgaaggtttgatacaagaagttgctcaacctggacttgcctagaacagcagccttttattctgattgaatctgtggaaaataagacccagaggaactcagactagtatagcttgtcttcttttatctattactgtttggaaaataaaattaatctgtagcagaagaaaaataaaggtgacaaacatttgctctaggtacctagggatcaaagtaactgagccttcatgtctttttttccactaatttaatacatccattaattttataagtatggatacaagagaaatcatttttttgttggtttttttaaatggtagacttatttgctacatcagctataattttttccacaccccttttttaacatcaaaaaaatgtaaaaacctttgcttcaatgtaaagtatgttgaactgtttccaatgatgaatatcatctgccaatctaataaatgtgagtaaggtgaaaacggaataaatagaatgtgggggcgggaaacaacccttgaaacggtaatcagcaagtaaagctgaattcctatgccatagtgtcccctgctggtcgattacggaagtagtagctttcggagagcaagtcaaacctcttggttaggccatatcatgttttgaacaaaaaaggcacaaaaacgaaaggaatgtgtgcatattgttttttgtctatttctttttacatagtcatcattggcagtgggacgaatgggggaaggattgttttatgcgtgaagaatcccagagcccattagaactaggcttagctcagccacttctccagtgatacgtgatctggcactcacagatctttctttaagcctcaactcctccctgtaaattgcaattagtaataataataaatgatagatttactgcagagagctgttacaaaaacataagaagagaaggaggaggaggcggaaattacacacagtaaagtgtacttaaaatgatatagcgctttccaaaacaaatattaatgtaagggtgcggattgggggagacacttccattaacaattaaactaacttcccttataatcatcaaaaggtaatccaggctgggcaccccaggcatggttgctgagctatcagactttcaaattcctacaacatcacctggtttccaaggacttacttgggtacctttgaacaatgtatgttgctcagataatttatattacacagaatttactatatacttagagaggtctctactggttggtaaacagaggtgatggggtaaaggagattaaggtgctccttgtttgcttgataatcattaatgattgagtctccatcctgttgctagttgtctgaccagcagcatctgcatcacctgggagcttattagaaataaggaatcttagatttcatcccaaacctactaaatcagaatctgcatttaaaaattatcccaggtaattcttacatatgttcaggtttaagaaactccactctttcacatttgggctataagctttctctggcaatacatcagttgttatctagtacatatgtacagaatagtatttttgacttgaccttattttaaaactacttggagaaattaaattagaaggaaaaactatggctaaggataattaatttttatgagcctcaaaagagacgataataagatgactttcctaaatgtaacttagtattatgctactttaaaatttttacagctttgtaatactaattttaaggtaatctcatgtatttgtattaatatacacattttatatttgcccttagtatctgtgttgataagaattttaaaatgcagattatttcattagaagagattttagaaaatagactcaagtctaagcagacgtttgaaaaatctaagagggccgtagcttccattaaaaataccatttacccaatcttttgtcagttaatgccctctgaacataagacaatgttctgagttgttggaagtggactgctatactagcaacacctatgatcacagtttctctatagatacaattttaaaataaaccaaacttggaaaatgagtggatgggtattagaaagaaaattcattctttttcacttactccctaccccctaccacttaccctaagctccacctcacaccctctgttgtgtcttcttcctttaggaatattttgtttagtttttttttgtttgttttgttttgttgttgttgttgttgttgttgtttttggtcatagctatgctctatttaataggtgaaaagactttaatgccagtgcttcacccaggatagtttctttctaactggtccttgctataaaagtatccattctcctcctattatttagtgtcctggctataggtgaaggaagtcatctgattcaaccagtgcacactgaggtgtgtgaactctgaacattcttctttaacctccctagtggaaacccactgagtttttaggaaagacactcacacaactcagtgaaaagcttcttagcagaacttcatacaatttaagacacaaagagttttagggttgaagtgggagatatttcaggacccaggtacctttctgggtccattaagcccctccaatcttctttagcctattttctacctaaactataggctctagctagctacacaggtaatatccttgtagaagggtaacaattgtgagaaaatatggatttcagagtttgtctgatttcctttactgaacactcctttgaaagtattgaaaagtcatatgtttccaatcactaaagttggacattaaggatcaggaaaaaggcctggagggggatctttgcagtataagagttttgactccctgctctagtggtgagagacctttcagtcagagagaaaggatcttgacttgagagagtaacagggtttccaatctgttcctttcattgaacagagttcaaaagaggctcaagggtgcacctctcttaggctctttatattgacacactcttctcttgccaaaagcttggtttgcagaacaaatcaaaaacacacccttgacaaacgttctggtctagaataatcacctcttccccaacttactatgccaaagaggggagcttaaaaatgacaaggtgtgtgtgatattgtctatctctgcattcttcataaatcttcaaagtcaatatatctggactgaactaaggatatatgatgtttctcatgctttcatttaaagtaagatcttgaggatctttccacttgcagattgatatgcatcacagaaaagtttccttgttgatgttcaatgaagtcgcaggctcaacacatgagcctaccaaacacggcaaataaaaatttgttcaagattggaattaagggcaaaatatcaaataaaatgctattgcaaacaatggtgtctcttcaaatgctaggtttggcatagaaaccaacaatctccaagaggtggaaagaaaatgaagatctcttaagggcaatgcaaacttccagagacattaggatttgcttagcatatagaaaacaatgaaaataaagaaaataaaacaaaacttctttctattgtgtcacagtaatccacctgttggtagcacccaatttggggactgaaataatggtgattttcaacagagaaaattgtacatttcctttatgcatcctttcttcactatgtttctgactttttcttctacctcaacatggtacagtgggaagcaaacaaaattgggaatcagaagacttattttgctcccaggtttattactcactcacgtgactcaaacacagtgctttaatttcctgaggaattaattatatttgtatgaaagaagtattgcactctatataaataataattacaggaaaaataataatagctaattcttaatgagtatttcttattctccagtcatttttgaaggtgatttacaattgttaattcattgaaattctcacaaaactctgcaacgctagataatattattatcattgttttatagatgaggaaattcagccacagattggtaaatcatttgtccaagatcatgcagctgataaatagtgaaatcaagattaagtttaggtagttgagctccagagcttacagtttttcatgttaattctcctcctctgatacattttcaatcccctattttgatgccatatcatgcttttccaatgttttctgctttctataaaatgttgatacctctaggaataagtctttaaataatggtttcacacctattgggagaagacatgatgggaaaaccaccataaaacaagatggaacttttaagaggagacacagtcataaatctgttctaataaataaaggggaaaaaaaagaataaaaagttaaccccttaaagaaaaacatacttttaaagtctgtctggatcttttgtgaagagcaaaggaaatgctgaataaaaaaggattttgattgtcctttccaaaatattgtcccttacctcttggacattggtgacaccacccacactccacccacctttaatgacctctactttctagtaaaaaactttatctttgcataaactttgttgttttgactctgcaatcaggaagatacttcatagctatatctagccaggtgtaggtaggatctgagtggaaagacagaaaaggaagttatattcattataaattaatgacatgccaggtattaggcatgtccacatccataattaataacattgggttaagcatttccatttaatacagagagagacagacagagtttgcacagtatctttcctttggttcttatctaatgactgactctcttccatgtacctttaaaaccactaaaataaatggtctacttgggaggttgatatactagccaagctataggtctaaacttcaaatgcaatttaatctatgcagcattcctttttcatagtgaatctttaaagctcaattttttgcattgattgatcatcctgggaaacagaaaaacctcaactcacagcttcaagaacttgaaaagccctaatccagtgcctatatccatcacctctgaggacaacaggaaaattgaaaaggaagaaatttcctacagactcatgataaacttattgatagtagtaatgatatacattttttaaaaaattatcaaattgtgtattttttaaattattaaactcccatggcctcaatattctactctgccaaatgatgggaaaatttaaattgtttctacaatttcccacatctctataacattaaaagatcaacttcttaaaacatatgtaacattttctttccttgccccaagatgcttttaaaggttttataaactacccttctttggacatttttgtcatcaatttgctacttttctgttcaaaatgaataacagcttcccataggcaatgatactattatcctctctgcatatgtaaactacctcgccttcaggacacaaaattcagtcccaaatcactgtcttcagcctcattgatattgtccctctcctaaagactcctatggcttgaatatgtgtcccctccaaaactcacgttgaaattttatccccaatatggcaatattgagtagtggggcttttaagaggtgattgggtcatgagggctgtcccctcatggatgtgttaatccatctgtggattaatgggtcatcatgggagtgggggtggtagctgtataaaaagaggaagagagacctgagctagcacacccagccctctcatcatgtgatgccctgcaccacctcacctcaggactctgtagagagacctccgcagcaaaaaggccctcaccagatatggttccttgaccttggaattctcagcctccacaacggtaagaaatatattccatttctttataaattacccagtttcaagtattctgttataagtaacagaaaaaggaatatgggaaagaccacagcctttattctctgtacatggcttgggcttcatcgtcttctcactcatactattttaacatctgttgtatgtttgtttttcctatccaattaaactaaatgttaaataatgacaatgcactcaataaatacttgttgtccttccaatatttattcagtaaatgttttcagtgtatagtatctatatgcccatcttggaaatctaagaataaataagatataagcccagccctccaagatcttaccatctggaatggtaaggtctcacaagaatggcaatgtaaattcagtgaaatatttccaagggctactgtgaagaatgcaaatctgagtctacaatagattaacatgagaatttccaagtagtaatgagagtctggttaagtttattgcctggcacaagatcacactaataaagaatatttattgagcacttaccatgtccacatttagttctcactacaactctaggcagtgtttctatcttcattttgccagtgagggaattttggctttggagaccagtgttttcccaaggctgcatgatgtagctgagatagccagggcttggtggaacagtctggctttcagtcagctgtaaccactctgcactacttcctcttgcttacttggtgcttttaaaatatttgttgaaagaatgacatgatgtagcatgcatcaacagtgaaaaatatgctctgcaatagactccaaatttcgaggtccccctaatttggctgtaacattgattgtgtgtatgtgtgtgtgtatgtctgtgtgtgcgtctgtgtctgttttagaaatgaatttacattctacacctgacttccatttgcccctctgcattccctattgccacagctgaagagtagaaatgctttatggctctaactgggagcagaaatcactgcaagtcaagagttgggtgaatcaatctcaatctctctctctctctctctctctctctctctctctctcatatttatatgctctaaatctgactgcaccttttcagaacatcatgcatagtatgaggggactaaattaaaacatctgacacaaacattgagagcaggaaaaaaaattgacatgtggtaactttttggagtggcattctggttgatcctttttcaaggggaggggagggttgtttacagatgagcccaagcttgatgcatgctgcagccaagaggcagctctcccctttgatttttcctctatataatctccatgtggtccccaaatgcttaaccctctctgccaaatgctgtaaaatctgtcttttgatttcacagatggaaaagacttattagctcatgaagctcacctccttaggagacaaggaactcatcaaataccatttaccccacccttcgagtttgaagtctttatcagtttcctggccaaaactgttcaacctcctttactcatatgacatcctaagtataaagaaaacaaaacaaaacaaaaatccatctttttgtttggcttctagtggtcttgggactttcttccaaagtgtttctcttgctgtgtttttaggcagtgccctaggcaaagagaaaatgaccatttgcatctcttggttataagtaggcttgtcattctcaaaacaacaacaataaagagacatacttaagcaccctcttttgcattgggacagcatcacctggaccagtttaaacctttcaaacagtacataattatactcaagatgaggattttaaagaacactcgacttggaaaacctactttttgagttaagccctgttaccaccaaatcatttggttttccaaagtttagtttcccagatgatgaaatttcaagttcactacaatagttacatgtataagaatgtaaggtgctgtgtcaacataaacacatgatttgattatctattagaatttagtgcaacctgatagatatgattaggcaattctttataagtggacacatcttttgtaactgattttattatactcttcagttaaaaaataatcatcgttccttcattagttacaggacagagttcaaagctctcggtattattttcaagccttccctaaatctggctttaaatgtctctctgatctcatgttgacattccctacgtgaaccctttactcctgccacattgacctttttgtcctgtgtccttcccatcagtgcctgatctgacatgccccttctttctatccctcctgctcccctacatacaagcaaggatgtagaaactcgacaatcctattctccaatataaccagcaatttttaagcccttcaccaggatagagtgaagaaaaaaaaagagtacctctaaatttgtctcttttttgccaacacttaatacaatttcaaggtctggctggaatttacttcttctctaaagcttgcactgctatcagacctgtgatgctctcctctcctgaattcctattgtttttgttttctaaaacacacatgtgatacttaacatatcctaccacctatgatgagctacttttgtacctatctgcctctcagaagtatgcaggatgtcaactgcacatgtgcaatgcatgttctcatatgtgtacactcttgttgtatgttgtatattcttaactaagctcctggagcaaagaactattcacacactcattctcccaaagaccagccccatggatagtgtgtaatcagtaaaatgaatgaatgaatgaatgaacgaaagtaaactaagatgaaattttaactgctgacctttgctaacactcccatgctaactcacaaatatttcagaaaaaaaaagtataaaaaagacataatgatgagaaaagcattctaggcaggcctattgatcttgccaaaaggagatgcagagtatagatggcacagactatgaagctgctgagatgtgcctcacccactttgaagagagaccagggagcacagtacttgcattatcattccactgttggtctctgaatcaaaagagaaggaggcaagttcctagcttaaataaattatttagaatattgatttaactgcctgaactgtgttaagttatatctgaactaaaagacaaacatttgcgtgtttcctttaatggaatctgtgaattcaaacatatatttgggtttttaaaaataatctccctctccctctccccctccccgtccctctccctctcctctttgcatggtctccctctgatgccgagcggaggctggactgtactgcaacctccctgcctgattctcctgcctcagcctgcccagtgcctgggattgcaggcgcgcgcctccacgcctgactggttttcatattttttggtggagacggggtttcgccgtgttggccgggctggtctccagctcctgatggcgagtgatctgccagccttggcctcccgaggtgccgggattgcagacagagtctcgctcactcagtgctcaatgttgcccaggctggagtgcagtggcgtgatctcggctcgctacaacctccacctcccagccgcctgccttggcctcccaaagtgccgagattgcagcctctgcccggccaccaccccgtctaggaagtgaggagcgtctctgcccggccgcccatcgtctgggatgtggggagtgcctctgccccaccgccctgtctgagatgtgaagagcgcctctgcccggctgcgaccccgtctgggaactgaggagtgtctctgccccaccgccaccccttctgggaggtgaggagcgtctctgaccggccgccccgtctgagaagtgaggagcccctccgcccggcagccgccctgtctgggaggtgggggggcagcccccgcccagccgccaccctgtctgggaggtggggggcgcctctgcccggccgccccatctgggaagtgaggagcccctctgcccggctgccaccccgtcccggaggtgtacccaacagctcattgagaacgggccatgatgacgatggtggttttgtcagatagaaaagggggaaatgtggggaaaagaaagagagatcagattgttactgtgtctgtgtagaaagaagtagacataggagactccattttgttctgtactaagaaaaattcttctgccttgggatgctgttgatctataaccttacccccaaccccctgctctctgaaacatgtgctgtgtccactcagggttaaatggatgaagggcggtgcaagatgtgctttgttaaacagatgcttgaaggcagcatactcattaagtcatcaccactccctaatctcaagtacccagggacacaaacactgcagaaggcggcagggccctctgcctaggaaaaccagagacctttgttcacatgtttatctgctgaccttccctccactattgtcctatgaccctgccaaatccccctctccgagaaacacccaagaatgatcaataaatactaaaaaaataaataaaaaataaaaaaaataataaataataaaaataatcttaaagagacataattctctcccttttaaaatacatattcataagtatgtatatttataaagggttatataccagggcaaaagttactgataatgattctgcaagaactcttagtttattgccttcatttttaatttataaatgaaataatctagttcttaggttggctaatacaataatgttttgcttttttttcactctttataaaattcattttacttattttagatacatgtcataaaatcctcacttgcatttgcttatttttgtggtaagctaagaatttaatcttactgaaataattataaaaaattaaagcaatcatacaatataataaaagaacatagtctgatttttgtaaaataacactcagggtatgcagatatatgacagacataccttttttccacacatctacaatgatacaatgatcttattttcaacaaaggcaccaaaaacatatcctggggaaaagacaatctcttcaagaaatggtgctgggaatacaggatccatatgcagaagaacgaagctagaccccaatctttctccatatgtgaaaatcaaaccaaaatggattaaagtcttaaatctaagacctcaaactatgaaattactacaagaaaacactggggaaaatctccaggacatttttttgggcaaaactttcatgaggaatacactacaagcacagacaaccaaagcaaaaatgggcaaatggaatcacatcacgttaaaaagcttctgcacagaaaaggaaacaatcaacaaagtgaagagaccacccacagaatgggagaaactatttgcaaaccctctatctaacaaggaattcataacaagaatacataaggagatataacaactttacagaaaataatctaatgatccaatcaaaaaatgggcaaaagacttgaatagacatttctcaaaagaagacatacaaatggcaaacaggcatatgaaaaagtgttcaatatcacagatcatcggagaaatgcctgaatagacatttctcaaaagaagacatacaaatggcaaacaggtatatgaaaaagtgctcaatatcacagatcatcggagaaatgggagaaatgccaatcaaaactacaatgagatatcatctcactccatttaaaatggcttataaccaaaagacaggcaataacaaatgcctgtgaggatgtggagaaaagggaacccttgtacacagttggtgggaatgtaaattagtacaaccactatagagaacagtttggaggttcctcaaaaactaaagattgagctaccataagatctagcaatcccaatactgagtatataccccaaagaaaggaaatcagtatatcaaagagacatctgcactcctatgtttgttgcagcactctttacaataactaagatttgggagccacctaagttttcattaacagattaatgcataaaggaaatgtgttacatatacataatggactactgttcagacataaaaaaatgagattcagtcatttgcaacaacacagatggaactgggcattattatgttaagtgaaatagccatgcacagaaagacaaatatcacatgttctcacttatttgtgggatctgaaaatcaaaacaattgaactcatggacatagagagtagaagaatggttaccagaggctgggaagggtagtggggtggggggtgggaagaccgtgtgcaggggaggtaaggatgattaatgggtactaaaaatagaaagaatgaataagaactactgtttgatatcacaacagggttactatattcaataatagctgcattgtacattttaaaataacttaaaagagtgtaactggattgtttgtagctcaaaggataaatgctaggggggatggataccccattctttgtgatgtgtgtatttcacattgcatatctttacgccataaatatatacacctgctatgtagtccataaataccccataaatatatacctactatatactgacaaaaaaattataaaaacataccttttttgggggaatatttttcgaaatataccccataaatatactccataaatatatatacctactatatacacacaaaaatttgtataaacatacctttttttcttttgggaatattttttgaaagatgtttttttaataaaaaacaaacaagatataaaatacatgaaaatctttgagtattgtctatctttctttgggtaaaagtcttaaggttttggacactactatccttcttaattcatactaaaaatcataatcactcctaaagtgtagtaagtccctcggaaaattattaaatgataagcttaaaagaaaaatttaatgtatatactataaccatttaaaaaggagagtgttttgaggttgtataacctttaaaagtacattttgaatttctatattaattttaaagtgcatcaattttgtcatatgaacgttcgtaataccaaatatatcaataaactgtaaaaattgagaagggagactatgttgaacttaagaaaatttcatttgaaacctattaatttcagaaacaaaccatacatatataacagaaataatttacaattaaaatttttactgaagctctttcaatggacacccttcatctttcccattactctcttgtcacttcataactatgacatggatcaggcacattaaacatagttctacatgaaggagtaaagacaatgacaaaaactgtggaatggtacataggaaggacttcatagaagcagggagtaggcaatgagttttagtgcttttaaaattgaaaaaagaagataatcattactaactgaaggtctttctataaaataaaaataacaaggtagttcacattaaatacattaaattacagttaaagttatttttaactccacagattaatgcactttccctttcacagaactcattttctattaactttagcaaccagacaccagaggttgcagtgtaaggtgtatttttttatggctcaaatataatttaatcattgtattttctcttcactagattgacaaagtgcactatgaattggtggaaatgcgctgtctcatcatgtgatgatcagaagctgtgataaagatatcatttgctccaacatttctagcacacgctgcatagagtctgcaaatgttctgatgaagcatggataatgatttgaatttacacttcagatccacagcatattaggctatggtctcactggaggcatgtgaaatattagccatagagatgtcttaaccaccatttacatttgttttaacataaaatcagctagggtataaaaatgcacaagtctctctaactgtaaataaccacacatcatcataaatattgagtccaggaccaataccttatcactcgtagttacatctttttgcattaattcaagaagatcttgtgacatagtctctcacaatgtgatatgctaaattacattaaaaaaaaacagaaaaaaatagacaaactctgtagaggcttgtagtttcatcactgtgaatcactttcaaattctatattcctatttttatggccaactgttagtagttattcaacaacatacaaaaaaaaaaaaaaaaaagcttggactagtaccattgatttgttcattcaaaaagaatttgtttagtacctcctatatggtagccctatcctagccactgggaataccatggtgagcaatacagtcaacagttccttccctcaaagagcttatacttcagtggagacagatgggcaataaacagaataactaagctatataataagatcaattgtattctgtactatgggggaaaacagagcaataaagagagagaattggaagtggtggaagtgattgtaaatgttaatagggtaagaaaggcctcactgagcaaataaaatataccaagaaaggagacaggaggaaggcaggaaagtaaaaggttgggagaacaaaatgcgcaaagaaagctgagaaacactaatgtgactgctggcctctgtacctaccttaagctttgtgttccctctaccagtcccaggtgacctccccaaatatccctttggtcttatgctctatttcactcaccataaaattaataatttctatttccttctattttaggagacatatgaaaataatatattatacattttcactattgtattagtctgttctcacactcctataaagaaatgcccaagactgggtaatttataaaggaagaggtttaattgactcacagatctgcatggctgggaaggcctcaggaaatttataatcaggcagaaggggaagcaaacatgtccttcttcacatgatggcaggaaggagaagtcccaagcaaagagggaaaagccccttataaaaccatcagatcgtgtgagaactcactcactatcagtggcatgggggttaccacccccattattcaattacctcccaccaggtcccttccacgacccttgaggattacaagaactacaattaaagatgagatttcggtggggacacagccaaaccatgtaaactattgtttaggatatgtgtatacctttttcagaaagttatattttgcattagtgcagtaaatgaaactgcaatatttacacagattcattttgaaatcttaatcaaaaaacagtaacggtttcctttttacagttacataaaaaatgaagaagggacccacccattaaacctaccttgaatgaggaaagagattgagactgaatttcatttctgcctccagtcatgttttataaaagcggtcaaaccagttttccttacaagcagatgtccagttgtatctgtatctgcctgcctcctcaacccatcctccacaagattgagaaaaggaagacagtgtgctcttgatctggatacacatttcaagccaaagttttataaagaggaagttcaattcaatgtagaaatatctgaatgctgtgtactattttattgggtacagaataaaaggggcagcagagtaactttttgacttctcactgcatcttttgttttcctaaagcttctgcttcactacgaatgaagaagactaaaatttctctgaagagaaggaagccatccatgatttttgacaatgttaaaaccctgatattctgcttggtcctaggtattctgctgtatccctgacattctgcttggtagtagggatttgcactgtgcttggtccagaagacaaattccaagctcctacagagtctgatggctttacaaataacctagctatcacaattctaaataagtgtgaaaaccctgttaaagcacataggaaggggacataacttgtttggtggggagggagaaggcaaggctttcttgaggcagtaacatttgaattgaggcctggaaaaagagtaaaaattaaagaaacaaagaagaaatgtactgaaaaagcaacaaagtccaaaagaacgcacatccaagaaaccgaaaagtgcaggatcacaaagagaagtataaaatgtaaagaaggaataagggatagatggggctgcacagataagaaggctaaaatatcacatgtggattaagaaggaccatcctgaaggcaaggtggaggaacggagtactgagaagttttaagcagaaaaataaaatgaccaaatgtgcattttagaaagattactagttcttccagaggtctaaccgagaggtcaccatgatgatgacctgaaccagggtagaagctggaggaaaaataaaatcaaaaggattttatttcctttgtacttgagagttatttaggagatgaaacaagtgaccgatggaatgtagggaggggtttccttcttggttcactgagcacgtgcctcttcttatatctctaaagcaagcaggaatctccactgagtcctgaacaggctcaaaaagtttcaccaagaatgaatgtgcaactatcccaacaagtttcaccaagtataaatgtggttcagactcattcctcaacacatggtgtaccctccttgcagcctcccccaacacacacagctgttttattttagatgctgcaaatcataaatgtgtattacagatctaacaattgtaaaatctccaaataaagttatttctttgagtgactggaacggagaaagggagcggtgctttgtatttggcaggaacttagattagtgtcttttcagaaagcccagtacattttgattagctcaatcatcattcaacaattattctctctctgattttaaaattttcattaaaagcaaatttttaaaaaggcatacccttgtacaggagaactcccttggtattgagcaaattcatccagggatcaagggaaatacaaaatattttcacaccattatcaatgtttatgctgtagcagaggaatcagtctcaaacacaggcaaaatatgcatatatttttaaataccttagatgctatagtaataaaaatattaaaatatatatggcaaatccattaatctactctgagtatgtctattaacatgtttaaaggcataagtggtttatcatatttttatcatatttaagttacaaaaatcttttttattttaagctttttatcatttaaatcatatttttattgtagttaagttacaaaaatctttgactctcctttgaatattttcaaatcaattccataagtgaagacaaaatacacaattgaggaaggggccatgatttgccccaaaattgtcatcaaatgaatgaactcaatgacttctgaatcacacttttaaatcagatgttcccatttgatctgtcaatttctccaggtttgatacataggtgtaaaatcatcacactcttaaggcaatgaactgcaggcttaaataaatagtatatctgaaagagattaaggcaatcgtatctttcagaagaatcatatctttcagaagacatacttggtaatgagttttggactgcaagtatcagttcttagacacagcatgtgacagtttggttgcttggctaaagtttcacagcgaataattcatctctgcatcagctggaccctgacctgcaatctcattagattcattctagcccaatattaaaagtatttcttgctaataatgcaaatgccattatcatccaagtaataactagtgtctggtagtatactgatgaaattttgggtattcttttgcatttttgtccaattttcattatttctcagtgggaaagaaaaaagaaaggaagggaggcaataaggaagaaaatgagaaggaaggaaaaaagaaacggagataaagaaagtaggcaggtgggtgtatcttacaaatttgcatacatacaatagtttgagtaaattggaaatacttaaactttatcctttgtaatgtaaaaacattaaaacaaaaattctccaccatgaaaacagaaaatatatatttgtatctcctcccattatatgcttttatgagagatggttagtgaattttacacttaaatagacacacttctttttgaaacctcagttttacttggtaccaataacactgaaataatcctccactgtatcccagctaatgcttctgcatcccaccaaatacatctgaatgcatggctaaaacagaacacgtgatctggccagccttacacgtgtaatgaaaatctaaattaaagagaatgagacagcagagataaagaggatttggggaaggaataaaagagactaaacatagcactgagaattctcctctttttacaaaaatgacagacttaagagagggcatggaacagattaagagaattaacatggagaggagagcagaggtataaaaggtatccaagaaaagtaaaacatacaaaggcaattcaaatcaaagtgagcactgcctatatacagacagaaagcgagtcctctatgaaaccatacttggcagaaagtactcattattaatagaaagtgaaatcattttgatatctacaccagcagtcattaaataggcccacagactacccctggttttgcaaataaagttctattgtaatacacacatacatacatgtacacacacacacacacatacacacacacacacacggcaaaaaccaagcaaacaaaaatcatgagtgacatttattggcaactaaagttatcattgatttttgctgctattagtggagtgtttgcattgccctaacactggccaatggagaaacaaatgtggatgagccagctgtccctatgatacttaacatcatcaattttgtgtttaacatttgaccatatgaggtatttcacttaaaagtaccttaaggatgaggttctagcattgtgtgataaagtacagctcatgaaatccacataattttctggttgttcgtaatttccttgttcatagactgatgaatcaaagaaaaggactggtaagaattctcaaccatataaccttggtctgtgttttgctgtggtaatcctattagggtaatcataatttaccacccaggaaaggacacatgatagtggaaggtgttaatattaataattaataccagtacaacaagaatacatttggattcctctaagtaaacagatgcatctggtcctggtcaccctagtcaaaatagacctgtgtgtgtgtgtgtgtgtgtgtgtgtgtgtgtgtgtgtgtgtgtgtgtgtgtgtgtttcacattgttctatccctctggcctaccatattcttattcatatatcttgcaatggacccctgttatttgctaggtgggagaggagacattaataatgcagaaatttttttttccgggtatttttcatgtcaaaggacttttacactaacgttatgatatgctgcatttctacaaagttcaatattgtgcttgttttaagaaaaggaattatttgtggttttccactttgcatgccaaaacagcgattttcaatttcaaaactgttgtatgcatcggtaaggatataatttacatctattctcccttcccccttcactttctaaatggagcgacattaaaatataaattcatgcaatattaggtaagtgggaaagtaaggcctttcttttgactattaagcaaagaatacatcttaggaacaccataaatcatgcttgtcaggatattcaaaagaatcattctgtatagttaccattctattatttagaaagcacagacatgaaacaatataattcagctgggctgcatgtatctgatttgcatatggctgtatctttttaatctgtgttttcacaagatgaatataattagcaagatttaatttatctttaaaaccactgaactatgttgattacctgcaggatgacatcacccatatgcactagtagatttggactcctaaacagagcaattcaatgtattttgtagctaaacaaagtgcatactgcaagttaaaaagtgataaactagtcatccatgcaagatgcataattcatcatgaagagatcagaactgttgttttatcctgttttcctatttttttctcctaaagaaaccacaaatgatttgggatagtcaatttacaagtctgtgaccattgattaaaaaaatattaaataaacccttcagtggaactgcatggatatattctctgtacttctcccatctgagcccttcatccacctttccttcatatacgctttcaggttaagaatttttcacataatgaattatctctgacctaacattctcaaaggagcttatttgtgctaggatgtttgactttaaaggaacgataacaagaaatatcatgttaaacttgtcagctataaaataaaaagtataatttctaatacaatgcattatttagtcatatccaactttttaaaaaattgtacaaattcaaatctgtggttctgggatgttagaggctctaattgcacacaatgtaacatgataatcaacataatttcctctaaaacaccagtttgtgtccccatgaattctaactatagcctagagtaaaaacaaagaaaaacattttaataaggacaatgtattaccactgggctgattattttcccagagaaagacaaccatgaaaataaataaaaataaaattgtttgcattagaactggcattattagatatattttactcattatggaaagaaatatctggacatcgaagaggaaaactcaaaccacaaacctcataatgaactgcttctcaactgaagttgccatttagtctgactgacagtattttatttctagggttggctttatgttggtctaatctagattttgtattgaatacacacagacatagcagaatatttcacaactcctcatcaatctagatcaattacttatctaagtgcagatgaagatttgattcgtgatgtgctatttctcagagaattgtctgcttaaccgtagcaaccagaaccacaaatataactggtaacacaacaaaaattgagagttaggtcagctcatagaagaaatatacaaggcagttacgtggataaatctttagacatcaaacacatgcaaaattttcccaggcttcctgaccactctcagttttatatgaaagtgcactttaacttgttgactgatgtcatactgattttcctcaaatatcacttttaacccaccacattccatggaaaacgttttgctggccaaataaaacccaaagccttgaattcaaatctcatcacagtctggcataaactaacattttcagtctactagctcacaattttccacattgaatccttgacaagtgagaattatttcctcattccctggtgaaacatattcctttcctgtctatctttacttaagccttctctcacctggaattttgtcttcccttctatcatcaaacctgtggttctttcatctgatttatctaactctcatagctagaagtaagcccttaaaaacagggatatatctgtatgccccagcatgaaaaacctatttgtgattgattgattggatcccctcctatccaaactcatttttaggttttattgtacacaccctaccttgcctgacttttcccagcaataagtgctggtttgatctgccaggttacccttcaatgctgtttggctttgtgtcctcaatgggccatcttattctatctttagcaaacacaaagaagtcaccttaagaagaaaaacgactagaaaagaaaaacgagagagcatcataccagttccattgccctagaaaagagataaggaagcgagatattaatttttttcataattaattaataaaaatctttattgatcccctacatatctactaggagctgaagatacagcagtgaataaggcagataacccacccaccaagagcttccattcctgtgttggaggttataatggtgatggagagacacatgataaagcatcagatagtatcattattcactgttattcaggaaaagaaagaaagaaatttgaaaggattgccagatgtcaggaaagtgcttactatagagatgatgtttaagcaaagatctaaatatgagagggagccagccagaccagcagctgggtaatcgctggtatctgccataggcaacagcaggtccaacagccatgaggtgagatctcctttgcccacttccagaactgaaaatttacagtggagaaagaacagcatacagataggctggagccagatcctgtgaggctgtgggccacaataagaagttcattgaaatgggccacagtgggaggttctgagcaagagagcaccatgattctttaccttacatgagaaagaagaagaaggaggcggaggaggaggaggagggggggaggaggaaggggaggaggaggagggggaggaggaagagggggaggaggaggagggaagaggaggagaaggagaagaagaagaagaagaggaggaggaagaaagtgaggaagaggaggacaggggaaggggagggggaggaagaagaaggaggaggaggagggggaggaggaggaggaggagggggaggaggaggaggaaataaattttgggagagaaacaagatagggatttaagaggagaaatgtttgcaaatcagagagacggtacctggacctagaacctctgacatttatgaggactgggagacactctgcttgtctcttggtaggctggttgagtgcaccggcttagagagagtgtaaatgacagggagaatatgggtctacctaacactggctctctaacaataaatgacaaagacctaggtaagccagctctgaaaatctgtgatactaaaaatgttttcttcatatgtaacagtatcaagcacaacttaatttaattaattatatgacttctattagcactttataaataccctgttctaggctaagctttgtaaagaattcaggaattcagcacccatatctaatgagtatcagtcctggatacctatttgtactaaaaaccaaaggcttctccttctttgctctgattctaattttctgaccttgtatacactggttacttacagattaataccagtaatatcagttatttcgtattgcataatatttttctgttaaaaaataagaagcatccctttctaccaattcactgtagttcttcattctacatttagtaacaatgagaaactgctcattgaagtaaagcttctcaactatttaaaaacaagagactggacctcagaataagaaaaattgtgtgcagtgaaacaggttgtaatttataccaccacttcaggccatattgtgcattttgccagaaaaataaaaaataccaaacttgatggtgagcatgcaactgactcctgaactcttttgtgataaagtattctttcaagatcctaagatgcaacactaaaacataattgcttgtattaattgtcaatagtagctcataacaactaggaaactaagactttatactggaacaagctctgttttgttgcctttcaatcaatgtcttccctggaagtacaagcctttatttaacctacacgtctggatatctgagaagtttcaccttatgacttgtttcaattataaacatccattacaaccagcaagcttcctgtcttacaactactctccagctgctagatttgtaacctgcaagttattgtttgtgttaatggcatcctagtttttatttttatttctgaaaagctatggaggcaggtagaggcagagatggaagaggtggaacagcatttggtattaaaggccaacatgagcccataattatgtacatcttgatctttgtaaattaagatcaagtatataatgttgaaccctaaatgctttctattctaggatttgttcaggttcattttcctttgttaaatgctctggttggctccatgttatatatttaacacctctttcttcttgtgagtttgatctaagggtttccaaagaagcatgatgcctttgagatgaagaggcatgtcgtcataggttacccccgacagggcccctgttgctgcctgccacaccttctcaccttttcaagaagcttcattctttcctacgggaccttgaacgtcacttcaccggtattcttcaaaaacagaaaatacaggctactaaagaggaggcacactgggcatgccaaattgtggacatccttatcatatcccaacctctgtgtgcatctatcagtgatacttgttacagagacattttaacatcctttcaaaaggtaactacttgtacctacagcttttgtgatacctgaaatcaaatgatattatttgaaagatatgagtcatgtgcttcaaggtaaactgaccttgcctttttgatcttctaaactatcatgtggaaacttgaaatttcacttttcttagtagagaagcttaaaagaccaactctaggataaagctgcaagcgttaaagcttaaagaaccgtgaatgccaccaattgtgtttcttagttgctgtaactgtaagagattgtataggtgaatgatctaattctcccaacaaaatcagtctagatgacttttattaattaaaacaattcttatcctagtatacctcctcagaggaggacaatctttttaagcttcatttagttgagaaacattctcctaaatttgatgtattttataaatgaattttttaatagcatgcgtactgcacaaattctacagcaacacagtgtattgtattttgttttctacattcacacctcccagtacatggtgacatgtatttgagagtggagagaaacttcagaagcatatctgagttcttccaggacaatttccacatctaatgtaccaattctttagaggtcagtcttgtaaaatcatctatttcattttccctgagggatgcagttatttttgttgcattcggcccggaaaaatttcactgcaaattcagtccctgacccatgccaaagaacagaatatagctacccaaaccttaagatgtttctatggtataatacatttcaaatgaggtccctttgtcatgccaccatcataattgacaaaatatacattctctctgctccacacagtatttctttaaattcacagcctttctttcaatatttgaacatttagaattgtgttgtacactgacagcacttaatgtacctgtaaggggaatgaaagagatatttggatgtattttcaaaatttgaagacaatatatttactgccaaatttgctatgtcttagtgctgccactctttactgtcagaggaatattgacattccagtgatgtctcacaaactaaaagggtggattccaaattacaagctatcttgtttaagatactaaatcactgacatcatctaaatctatttttgtgacgataaaaatactttaattataatccattgctctcagaaagttataggacgatatccaaatgagaagccatcagcttgtaaatacataaagttgtgcaagaataagttaaattactggctatctctttaggacaaattgtcaacatgtataattatacagtagtttaactggtgaggggaaggtatgcaacatatattctgccaaaaaaaaaaaaaaagcccataacattctgacaactcatccatatctctcgcctttgctgccatatctggaaatggcagaaatgcttacatttttggttctgctcatatatcagagtatgtgtgacccattaggttggtttctctagcagatttccctaactggaagtgtcatgtaaggagacatccacaaagtgtgtggtattggtgatgtgactgctatcttcctctttctctaacaagttgtattaatgcagcaaaaatcaactggaagggcatactcttgtccagaaaatttagaatgataaaaatatctaacctaaatcaatttggcaaagttgaggtgctacctgcccttgcttcagtcagtaattgaactttcctttggttctgttgacacaataacaagacctaaaagtaacttcttcgaatacatttttaaaaatttcatgtcttatccattcccattttctttatattttgtcttctgccatgtcctgagaaaaatgcctgactttagagagaatccttagatttaccacttgaaacttaaaagatcaagtctgaaaaatggatacaaagacaagtagcctttttgttggcgaacagaagaattagaaataggtagtctaaggtcagactcactttcattttcctcttctttataggcaatcttctgatgcttgcttttcctgaaagaactcaggcccaaattctttagggggattgtcaatcaagagaagcgaggataagatgaaaaataaaggcaaggcgaggctctgtggctcacatctgtaatcccagcactttgggaggctgaggagagagaatcacttgagtccaggagttcaagaccacctgggcaacacagcaagacccccgtctctacgaaaaaataaaacatttagctgggcatagtggcacacacctgtggtctcagctactctggaggctgaggtgggaagatcacctaagcccagaaggtcgaaacagctgtgagccatgattgtaccactgcactccagcctgggcgacagagcgaaaccctgtctcacacacaaaaaaggtaaattgtaagaacaaaatatggtacacattttcattgagagacacatttagaacttggtttttaatttaagaacttttgtaaatacatttaaattgttctattctgtaaactgtcttcagtcataaggtagttagatattcgtttcattgtatctttccaagaagacataccttatgattagaggcgggacggggaagtgggagagcaaggaaagagattagctttgctaactgtctaatctggatttgtgtctctgaataacatttattagctctgggcctttagaaaaacaacagataacgatagaccttgctttagcacatatatccctatgctaagaggtttacattaattttctcatttaatgtgcacaaaaatccaatgagaaaggtactctcatgattaaatccatttgaatagaagaggaaaaataactttgccaatgtcacacagcttctaagtaccatatttatatatttaggtctgtgaacacagtatattgcttgtctgaacaatatgaaactatgtataagtaaaaaaagcatgcgggtattaaataaaacctaggtctacattctttgaccattgtttttactcatgtattttcccatgaaagaacaacatttttgccatacacattttttggaaataattttaaaattccttattttatattacatttagaattaaaagtagtcataataatgggaataataatgagagcatttcacagctctcatcgactcctaacctgagaggttgttaaaagtatatagagtgtctctaaaatatggaaatcatctctttttttaggaaaaaaaaatacttttttttcttttcttttgagacggagtcctactctgtcaccaaggctggagtgcagtggtgcgatcttggctcactacaacctccacctcccaggttcaagcaattcttgtgcctcagcctcccgagtagctgaaattacaggcacatgccatcacgcctggctaattttggtatttttagtagggagggggtttcattatgttggccaggctggtcttgcactcctgacctcaagtgatccacccacctttgcctcccaaagtggtgggattacaggcataagccagtgcgccagccaataatattctcaaaattttaattttgaagaaaataaaaatagatccaagagaaatagatcaagagtaactcacacaaaatctttctaggaaaaataatatctttttttacaaaaaaatcctactgaagaacaaattatccataattttgtatgtattacctaatatttgaggcaattgagcatcagccttcaaaaaggaaccaccccagtttctgagatcatgagttgtgccccatcaatagaacttctattgtgggcataatggaataagacgagagaagcacggtgatcagatgaagggctatagaactaaaaagtgatcaaaatacctgctgcatttgctatcacttaagcactttaattatatatctattatgaaaaattgcattgatttacatattaatattctacatttcagcatgtgccctttatattcacataaaacagaatacactctgtcacacacatttaacctacctgactcagccattaaactaaaatttgagagtgggagaaaaaagaaacagaatgaatacagtactcccattgttctattcaatgccttggattttaaatccttaactgtcactcaattgaactctatttttgtcattttgcctatcagtcatgacggggagtttaacctagggtgagccatcagtttgtctccaaaccattttttaaaatggtcttatgttcctggggtagggacctatgtgcaaattttttatatcagtctgtaatttcactttaatctcaatgactcctgggcaggtagaaaaaaacagcaagccaatttgtgcagtataccaacactatccaatagaactttctgtgatgatggaaatgcttcttgtctgaccagtcccacacaatagtcattcgccacatgtgactagtgagcacttaaaatgtggcaggtgcaactatctggtttttaattttaattaatttaaatttaaatagtcacatgaagccacagtgatgtcttggtatagtttatgtacttgcagctacattatttaataacaagcacagccctgtaccaggccccaaatttctaggtgactgtgaaagacaaaatgctggaatagtaactgtctttctctataggcttgtgtgtgaattaccagtcttagttaatgtgtttctgggtttgtttcaggaatactgctgagaacatttcaacatctgttaaattacaccaatgactacaagtcagggtatctaattcctaataggaatccttactaccatttggacaccttttgattcttctcatttgaaactcttgcattggccacagctgctgttctaaattgcctccacattcaacatttttgtcctactcttcaccttcaagctcagaaaatacactaatgcctcatccacaaaggagcccaagttcatatgatactagttctgtgaatgcatacatcactgccaccatgcctcaacctctctctactcttccatattatactcttcttgtcaacaaagatgcccatgctttttaaaatctcatcctcatacccgtgacatcttattaacccctttctacctgatctgatctcttcttcaaacattatctctgtcttctttttgtatgtccaatctttgtctacccactggcttctccacttaacataagccagcaatttttcccagttccctccactaatcacacttaacactatcataattaccatggcttacctattcgtttcccttgacatcctaggtttttcctaaatgacttctttgaccagtgacctgacaatcacctaatccaagatactttaaaaactcccttggttctttctgtagctctttaattgctcattcttatttggtatgctccatcattccattgcctgagattgggcatttttcaagataagagaaaatcaattttcagcctacaggttaagcctgctgaatttttgtatggcacaaaggctaagaacagatttgtttttgtttatttttatttttatttttttaaatttaaaagtatttcacattaaaaaaccaaaagaatattaacatttgacatcatgtaaaagtattataaaatgaaaacataattgtccaggaagtgttattataacacagccatagtactcttttacctattgtccacggctgctttcacactacaatcacagagttgaatagctgcaacagaggctgtatgatctgcaaagcttaaaatatgtattatccagtcctttacacaaaaagtttgttgacttttgcacaagatggttctcaacttttttttttctttttaaaccttctccctcacttatcattgctgttcccagcactttcatatagtaaggcaagaactaacaattgttgaatcctataagaagtcaggcactatgccaggtgcttcacaagcatcactgtatgtaatcctcaccactaaataaggcaggcaatgctactgtacagatataaaatcaggttaaataacttaaataacttgccaaaagtattgctcgatgttagctagcaatttgcggagaagacttcctagttcatttcagggagtgaatacctatgctccacacccaggctcattttctaatccctggagctccacatcattcactgcattccaacccggtcacttcctcccctagaagggcttcttttcctttgaatttccctcgccattagtttaggtcagaaaataactacctcttacctggattaggacctgttattctttaatgcctttattctcttctgccttccatttaccctgcattttcttatcaactaatccctccaaagaaatactgtctaacccatctcacgcacgtatttacatctctgcaaggatcttgtaaaatgcttctcaatttgtgatcttgccactcctctagttaaaagccctccacagatgctagttgcctaaagaataacttctatacttctttcctgttacttaagtatatttataatctggtacaccctacaacaaataaagccagtctggattgctcattgttcctcttctttctgccacttggaattcctgtcccttcatttacatctgattacttgagacaggagagtttttatccttctctccctgaaccactttcctttcatgtcatttttttctaactgcctggcaggagaattttcagtatgcatatctaatctccataactctactgtaatctcctcaaaggcatgtactcatcttattctctttgtacaaaattcctgatagcatccaatacaattcaaggtagatttttttagttgttaaccaacagctatactctcattttcctttttgccagcagaggctccatttttgtttatacagtgaaggcttcccatccccgatttccgattccccatctccagtggcttggtcataatggacctaaaccagttaaggcaaataaatggctcattgacatggaaatgagtccctcagagaaagaatttcctccttaataaaaaatgatacatagaaggaaacacccttcattgccagaaacaagcttcaactatcttaaaacagtgaggaaaagcatagttatcacactcaagctattctatggaaagatgtaaagctccttggtatttgatgacttgttttagccactgagttagtcaatcccactgcagtcttatttctagacttctcattaagaagtaatagaaattcattactgttgaagctacatttaattgtgtccattattatttgcagagtcttctgattcacatgtcaataaacatttcttgaaatttaaatatatgagtgcatgtttaaaaatacacaaacttatattgcatgtatgttctgtactcagctatgccatgtgttattattatttttcattattacataaaatactatttggtactgtttttggaagatcttcagtggaagaaacgtttcttctatatattttctcagtataaaacacattacagttgtctaacattgataggtagctagcaggaggtaataatttttttttttttttctgatttcttcccagggagttatgggcagcgaaaacgtagtagaagtatgtatcactcagattattcaaaaatgaaagagaaacataaaagagagaaaggaaagaagaagggagtgagaaagggaaggatggaaggagttggggagggagggaaggtggaagggagggaaggaggggaggagaaagggagaggggaaaggaaagaaaggaatattttgtatgcaaatgataaataggttgcagaggtcagtagcctgatactgagacaacttcagaaataaaagcagatggtagagcttttgctttttttctctcttggccacaaaactcctgctaattgaagtagcaactgaacaagctgctctttcactcccctgacaatatttatgtttcacttaggttctgactttcacattaaacactgccacacctcctgcttactccttgcttccggtatctaagccatttttttttttttttttttttttttttttttgagacggagtcttgctctgttgcccaggctggagtgcaatggctggcgcatctccgctcactgcaagctccgcctcccgggttcgcgccactctccttcctcagcctcccaagtagctgggactagaggcgcccgccaccatgcccggctaattttttgtattttttgttgttgttgttgcttttttttggtagagacagggtttcaccgtgttggccaggatggtctcgatctcctgacctcgtgatccgcctacctcggcctcccacagtgctgggattacaggcgtgagccacctcgcccggccatcttttgctttttctatgggtggattcctctcttcacatgacttcatcttgaagagaaacaaatgaataaactaccactacctctcaaagtatctcccaagactgaataaggtttcctgaaagaaggacaatgagctactgtgagtaagtgacatatcctgaatgagaaatggcagtttcctacaagctggacgccagacttgaaagaaacagcacgaaatgggaaggtcatctttaagagtctattcttatctgtgaaatatatttacagccaataaaaacaattttttaaaaaaaatttctttgttcactttttgaatcttgaaaccatggaatggaattaatgttaccagcagtaattttattgtctatcttggactgcactcttcagaactttctcactgctgctctcataagactattttttttttccctcctgcagatcagactttatttccagaaatggaaacaacatgaaaactgctgagaaatttgccaacccagcttgcccacatatttatatctgtgtcaggatacagtattgtatttaccaagattaaattatctgctgtcaaaactcaatgaaaatcatggtatacaccaaattgcactttagaaatataagcacctattttttttcaaaatgcaaataacatattgaactatgtatatttacggggttatactgtacaaaatagaaacaatataaaatacaatatataaaagcattttagagacagaaaaaagtacacggttgctaagtttagcagagagagttggatgctgaataactaagaagattctgcagaaatgggttcaagttccacatctgccactcaccatctgtgttcttatacaatcatttaagtagtcacctgcaaatcggggataattcctgccctccctgcttcatttataatgaataaatgtaaacatgtatgtgaatacattatgcaaactataaaatatatataattaaatgcaagaaactttgaaagatgacatatttgaattcccgaagtacttcaatttctgctccaaaactcaattcttctttctagaatcataagattttaaaaatgtaaagaaacttaaacattatgtagtctgcatagtattccatggtatatatgtaccacattttctttatctagtctacccttgatgggcatttaggtttattccacatctttgctattgtgaatagtgctgtgatgaatatacacaggcatgcgtctttatggtagaacaatttagattcccttgagtatatacccaataatgggattgctgggttgaatgataattctgctttgagttatttgaaaaatcaccagactgttctcactatcaagtgggagctaaacattgagaacacatggacacaaagaagggaacgacagacactggggccttcttgagggtggagggaaggaggagggtgagaattgaaaaactacctgttggttactatgcttattacctaggtggtaaaataatctgtacaccaaaaccccgtgacacacaatttacctatataggtaacctccacatgtacccctaaactaaaataaaagttataaaaatagaaaatatcatgtagtcaaactcctttattttacatataactaacataagcccagaaatttttaatcacttatccaagtttaaaaaagaaaaatctaaagaaaaagaaaattttgaaaaagaagtctagattacaatttaatctattgttcttcctggtaaccagctcccctactatttaatatagaagtgtttaacacaaggctgggcatggtagctcacgcctgtaatcccagcactttgagaggccgaggcaggcagatcaccagaggtcgggagttcgacaccagcctgaccaacatggaaaaaccgcgtctctactaaaaatacaaaattagccaggcgtggtggcacatgcctgtaatcccagctacttgggaagctgaggcagaagaatccctttgaacccatgggcagaggctgtggtgggccgagatagtgctattgcactccagcctgggcaacaagagtgaaactccgtctcaaggaaaaaaaaaaaaaatacaaagaagtgtttaacacaatttactgctttaaaaatgattttacattgatatgaaatgttttagttgtaagacatattttctaactaaaatcccattttatttttactaatcccagataggtttcagggcagatattactttcttttgaaagtgtgacttttcagaacaaggagatgagtagcagaaccagtcatggaatcaacattttgtacttcacctggtatattcttccatctttcagcaatgctcatcatattttggctagaagggattctgtttcttttaatagtgctgaatagcatatatttcaaaatgtaggacaaagtaaaattaattttgctgagggagtcttgcaataccctttgtgatgtctggagatactcaatggtatctcaaaactaggataaagaatgcttatactagattattccatctcccaaagtaatttgtctcctaataataatcataattaccttctacagtatccaaactgtagcctctttactaggcaaattatttactgcaggtaggaaacctctggtaaaaactgcttgacaatatgctgctagaaacagtctttcattttccaaatccattctgggaaaccacacaagcacacctactttcaagctcatacgtgaatataaaaggctattttatttttacaaaatgacttattacaggaaaacctagttaagtgaagtattccttgctaaagacataagtaagcagtataaatacacactagacctgctcaaatcaatatttaagcattcaacatatccacaaaatcccaagtaaaacttttgtgcccatttgtcctcttggcaccaagatttttctactctctacctacctctactgccaataaccttataggagcctttcccccatgttctcaatcagggaaggatctcgtgtcatttatatcttccaaataaatgttctaacgcaagtcccagtgttattttcacctaaagccgtatctgtttttgttagtcaagaaaagattttgctttctgtgaaaataatttcagtgtcagtgaataaattgtagcagtattacatgcttctgtgttcagtgtgtttgttgatatcatgtgttgagggggtgaggctgtggggagaagagaaggaaggaaaaggtggaggcaaactcttgtctctgatcttgaaattatgctagtcagttcctactaactacttcatgatacagggagttctggatgcatttgtgtgtgtgtgtgtgtgtgtgaaaagacaaaaagggaagattttctaaattactgacattttggttactaatacaacgctggtcaccaagaatccatggataatgtctgggtgaaatgctttgcatcctctgagccagaaactgctcaaacctattaaaattcatttgtgaatgtccattctataacaatcatcaaaacacaatttcttccaattaaacagcagaaaaatcttcctggggactgatagtgcaacaaggaaagaggatcctacaacctcagttatcacttcacagcagactcactgtggcatgttctaagttctacagccagaaacaccaaaaataaatttcctgttcttccacctggggctctattttcctactgccccaaaacctgacttctagtagaatcaaaaaaattttcccaggtcatggccaggagttaactgagtatagcacagccttctcctttctgacttccagtaggatcaaaaactcttctccaggcatggttagaagttaactgagtgtacaagaaccctgagtttttgtgtttcaatttgcctgatttgcatgtggatatacagccccagatggagaaaactaggagtgggatttatcttacatgattcactgtagacagccaaagcaaaatgtcaaccagtgaatctttgcttctagcctgtccaggaataggccctgggaaaaccttctgactgcactggaactggggggagtggacttgttctgagctgactcaaaaatgctaacagaaaatggcaggctactgcttaagcacagatgtcactttattgtgtcaacttggaaatgatcagtacaatctggcaagtgcaatttttctcacattatgagtgtgtttgagcaggtgctatgcttcactgaggtcatatattgtttccatgttttttaatttttgattcaaattataggatgaaaaagattctcaaatatagacctgtcctaagttttactggagaataaaaacgactaataaatgttttattaataatcagaaaagggtctaatgcttctccccaggggcatatttggtatatatgctttaaacttctactaaatgttgaagaaggaaaaataacagtaaggaaaaatatagaaaatattctccaaaatagatcttctggtggcttctcctatgaccacgatgcattctgttgtcattcacatattgtcttgtttggcaaaagacttgctatttctatagtcactatggaaagttgccacagctactcaaagtaagctgtcattggagggatatgcctttacataaaatagtacctcacagtcggcaggggccactgtgggttctaatggctagctttaaaaagccaaaattgtgtctgtaggatcggtggctctcttgtcctgccaaaagattgagatcagacatggtgactacaatacctccagcactaagagttgcagcttggaaacaagcaatgcaatgcagttgtagctaggttgctgggtagtatgtttagtagatgttttgtctttgaatctttctggttgcccctgaaaagttgtcacatacagtaagcataaggtagacaacagtgcactaagttttagaacatagagaaacataataaatagtcattgctttaagaaaacccttaaggaaaactacagtcaacaaaactgaatatacaaatatctgaacacaaaagtgaacattaaagacagtgttatacatgcagtagcagttctgacagacgcagagagcctgatatacaaagcaattggaaaaacagattcctagaaagttctaaaaaaggccgggcgcggtggctcacgcctgtaatcccagcaccctgggaggccgaggcgggtggatcacgaggtcaggagattgagaccatcctggctaacacggtgaaaacccatctctactaaaaaaaaaataaaaatacaaaaaattagtcgggcgtggtggcgggtacctgtagtcccagctactcgggaggctgaggcaggagaatggcgtgaacctgggaggcagagcttgcagtgaaccgaaattgtgccactgcactccagcctgggcaacagagtgagactctgtctcaaaaaaaaaaaaaagaaaagaaagattactgaaaggtcattatgtgctaggccttttccataatagatttatcttcatgttacagattaaaagaattactcaaaatatgcagactaaaaatctacattaggcactttataaaaggtatcagagctagtaaattagcagagcatggatttcaatctccacccaaagagtccaaagcccacactggatcatttatgactagaggaaaaagggaaagatttacggacacttcaactcatcctcaagagttgtcaggatttgttccgttggaagcaaggatagcaggatattccagtgaggatttcaatatgagcaatgacagcaaggcagggactagtatggcatacactgggcatgaggagataggctgattagaaagggggaaggaaaaaggagtaaagagagagtctggttccagatgacatagggtccagaatctccaaagagattcttagagctggacttaagtttggagatgggatgccgagagtatgtacaaccacttaatgtttcaaacctgacggatctagtttctgaaaccaaatctgactatagtctttattattattattattattatttagaagataaaatactataccaaactgattgtatctctgcccttatgaagtcaagatgaataataaataaatactaaaatagatggtttgatagatgtcaagtttaaatgagaaaataaggcaggaaaggaggacaaggaggataagataggaggtgtataattttatataaggtggcaagaaaaggtctcattgaagtagtaatgtttgaacaaagaactcctccttcctcagtttttttgttgcattgctgcctctctttcccccagtgtggtttaggattatcacaaacaataatcttatatttcctctaagagttattttttcctttgtgctcatatttttgatttatgaaaaggtgcacataactttcaagctatcatgatctttatgtttaagttcataccctgattttctatctgatcaaatgaaaattttcatttgtttttgatataagaagtttaaagtccatccattgtgacacaggtgaaatatgaatctttaatagatttatgtgattccacttcactctgagtcttcatcatagatactctctgtagctttttcgattaaagaaaagccagacacattaacacagattttaagcaattgaaatacagagaagattatcaaatttctagaacttctgattgttctgtatttgatgccttttcttctacagaatttttgaatttggtttttcatcagaacaccattgaagatatcacttaaggaatctagggaatttaagaaatgttaatccccgtgattcaaagtagatattttatcttaaatgtagccacttgtcttaggggtccccaaattataaattggctatataattacctatttcatggtaaatggattattagttcttttttacttctctgatttcacttcttcttcctctttttaaaattaatttatttaaaaagaaggatctgggtgtgaataagtagagatatatttcttgtatgtcttaaaatttaaaaaaattatacaactttccattgacacggaacatttaacaaggtttactttagtatgatattaaaattcaccctataattttaattgggataaatggcatttgttctttccagcagtaggtgggaaagttagaaaacagtatgtgtttcccaagagtctaataggaaaagaatggggttgtgcattttgtccaagactcctactccatagaaacaacaaatcgtctgtataacttgttctgggctttttattttgaaaatcaattattttaagtgtagtcataaatggaaggaacagggaagatgctgccatatagacataaaacagcttgatattattttggtcttaaaaatatcgaaaaaataaaaattttattgaaaatttctgaaaacttatgtaaaaaatggtcatccatcagcatctgatttggtggtttcctgcccataaggcagatacacctactattcaattctgtattgtcaaaaatcttggaaagaatcatgggatgatatgataaaccatcagctctttccaagcactgttatatgtttacagagttggatcagcatccactggtagttccttccagtgaagtctctctagtcagccttcagtacactgtcttaacatatgtccatcactgtggctatactgcatactttctatagtgaacataattgttatgaacaagtacccaagaatgagacttcatgggctcaaatctcagctctgctacttaatagctctatgatcctgggcaagtttcttgacctttgtgtgccttggatttatcatctgttaggataatactagtgcctgtaaaatattagcaccatgcctagcacatagtggtcctacatgttgcctatcattattatttctaaggtctatatatatgaaatattacaaaatccatactttaaacacttgaaataaaagaagaattagatgccacacatatccttaaatttcctttgttgtaactttttaattaagtgcacacctatacacctattgctgaagtttcaagttattcagattatccaaccagataaactgaggcaccattttctaaaaagggagaagatgaaggagggagaaatgtggagagtgaggagggaagtaccaggacttcaatttagaacacataaaggttgagatacctgtgagatatacaactgaaaatgttaagtacaattttgcatgcaaaaatctgaatatgacatgtctgggctaatgacagaaatatcagagttactggcataatgatagtatttaagggcatgagaatggatgagattagttggacgagggatattaagtgaggagacttctggaatcatgtcctgtgaaacatcaacatttaggagacaggtagagcagcagagttggtggacaccttggaagaagtcacagaggaaggaggacaaccatgtgtgtttagtgccttgttttgaaattgattaagtattgagtaggatgattagataatgagtaggatgatatctgaaaaatatttaatgaatttgacaatgtgaagatgattggtgttctttgcaataggagttttggctacatgctttcacgggagccagattggagtgggttgaatagtgaacgtgggtgactaattgacattaggttttattcataattgaaaactttcacagagcttggctgtgaaggaaaaccaagaaaaagcgcatgaggtagatgtttaaggttaggtcaagagaagcaatgtttggtttatttgtttgtaagattagtacaatccattaaataatattgacaattcaagggggggagagaaataacagaaagactaagtacttgaatagataagcaggataagacagtaagcacagttccaaaatacagtatatgaagaagaaagtggagatggtgtgaatataggagaattttcttcttattgcttttagctttgtcttcaagtacggccttggccttcagtcgtatagaaagtgtgaggccagaaatgggtcatttgtgagtttgtatgaggacagctagcagctcatgttcttattatctgtttgttagtctgaggggtggagcactggtaactaagtgatgtcatgttaccgagtagaaagggaacttcactgagaattagaattccagggtcctagtttgcaatgtgcctctaaatcagtatgtgatctgggcctaagcatttgaaaatctctgaacctcagcttttattttatagaaggagaggcttggggatcctttagaatgaccagtgaatgatccatgccactgtttggttcattacagaacttaaagaaggtcttcaaactgcagctattcacagtcaaaatagttccatatatacaatacttatttgtgttcatggactaaacatgtaaaaccttccagactttcaatatacactttataaaatctgtcctctgttgtctgtggggatttttttctgtcttatagattgccatttggaaatttaaaaataacttaaatatttgactgtttaattacaaaaatgtacctggggcataaaaggaagaattaaacataaaatttgatttgaattcttggtattatagatggactgcttttgaggagaaaactactgctaaccacaacctgttcatcaaggatttttcacttcctccttcactgcttttgtgactttaagtgtgctttataaatttccgtccaatgacagcacaatcaaggcatgcaatgattctttcattcttctctgataaaaatctttagtcttagatagctaaaagtgtagtcaaagacatttaattttagccttggggtatccattctctgtcacaggaaaaaataaatatacataaaagtaataagatttcatagaaaacagtgtgggacagagctgcctgactttaattttctgaaatgcaaggggatgcaattaactccctggttgtgattagcctcttggaagctgaataacctcagtaaattacagcacccacagaacccataatggcgtcatatactcaatattgtttacttgtctttggatttacagtcctgcagatgagtcataggatttatgcattaataatgaatcaagccaacttcaagaagcagcgctgcctctactcgaattacgtgtctgcctatcggacctttttaaagtaggtattggccaggactagtttgaggcactggctcaggggcaatatttaagaggacaccaaaaagtcagtgagtaagataaataacattttaaatcaataccttaaaaatcaaaattaatattttaaaaataaaaagttgttcatgatgaataacatatcaaaattttaaataaagacaagatcaataacagtggtatcctgagctgtactggagcctgaggcaaaagggaaattcaataatattgatgctgtctttatttaaatttttcacattttgttcatcatatatttttgcattattcagattgtttttttcaaatattgcagtaaaatataatttatcttgattactgagctttttggttcccccttaaatttaacactcaggcaagtgcctgaccctcatctcagcatttataatttaacaccaaaataactggcatgcaggaagcactgtgcccgtaacttgttcctgctgccataataaaagcagactttgcctctggaagcattccacattttaccccactaagttcttttccttttagtttccataaaagggtttattcatgtgctgtcctaaaagagtcctgctggatggcccgcaataccccacataaccaaaacaaccactgcatcaggagagataaagagtatcaggaaggaaaataaattccatatattttgctcaaaatcctggaacagttgtaaggaaggcagtcgcaaagaagtaaagtttttcaactagaggaagtacgtgaatctctcagtgcatatacctaacaaatgtagatagtcaatagcttttatccacataactcttggatcacaaagggaatgaatcattgcagtcaaagaaaaacaatttacaaggaggctgtgtccaatctcaaaaggcaactaaatgaaattctgagctctgaaaaatctgagatccgcctttattatcctcccaatttgtgaaccactcacctcagcaagactacaaactccatgaggggaagaacaaggacttcttgtttgcttatctttgtatccttagtgtattaggatacatgggaatttcacttatccctatactctgcacgaggaaataattgccacaatgtaggtggatgggtataattgtcaaccttaagcaatgacatatgaaaggactttcacagcaaatgagcaaacggtatgacagaaaaatagggtatgttagggcaaggacacctgtggcaatatttctacctagggattggaaagaggagattttctcaggagaaggcccctcaggactagggacatcccctactctttgtccattcctcctctccattgcttttctaaaagataggtcctgaaacatggtattgacattctcaatttctttatctttttaaatagacattaaaaaattcataaactgcaaggcctggtttaagttatccctcactcataaagcctaagatatttatactgtattgtatcatattattcttgattatacaccaactcatattgctcactaaagcacataaggtaactttgtgtgaactggaaaaaaaagaaaaaaaaaagaaaggtgtgccttcatcaagacacatagttgcagaaaaccgtatcaaaataatggtgcaactagttgaggtggatggtgccttttacatttttgtaatatataaattgtacaatcctatgcaatgacccttggtcactatgtctggcttttattttatatctacatagtaaagttaactccttacttccttccctccttcccccagtcccttcctccctccctcttttcactccttccttcctttcctatctccccctgcttgccccttccttccttccctccttcctttcctccttccttccttccatcctttcccctgttcctccctcccttcctgcctcccttccttccctccctccttccccgtcttcctccctccctcccttccttccttccctcccttccttccctccttctttccttccttccttctttcctccttccttccttcctccctccctccctctttttctttgttccttccttcctttactcttctttgttctcaatacttaacataatcctaaacccatagcaaatactgagtaatactttttggctgttgaattgaaatcctcctttaaaaggggagacacctaactgtgaaatcataggtgattttattttgtcttctacttgttctatattttaattgttatacaaatatgcattatttttataattagacaaaaatgatttaaacctgccaacaaatttagatgttaagtacttattcaatggccaagcccaagtaattgtgccttgtctgatttgagggaaagtgccctgcatatttacaaaaatgtattataataccatgcaattcaggtaatgcaatcctttatcttcttgttaaataaaattatctctttaccatattgctacattttagatctctctaataatgactgcaactgtcatgtagtgagtagaatggaaaatccctcaaatatcagattgcattctgatactttgaccccaaactaatcaaactaaatataaattttgacattttttctggcccttccacagatttaaaaagcaatgctgtctgggcatggtggctcatgcctgtaatctcagcactttgggaggccaaggtgggcagatcactggaggtcagaatttcgagatcagcctggccaacatggtgaaaccccatctgtactattaataaaaatacataaattagccaggtgtggtggcacacacctgtaattccagctacttgggaggctgaggcacaagaactgcttgaacctgggaggcagaggttgcagtgagctcagattgtgacactgctctccagcctgggtgacagagtgagactctgtctcaaaaaaaaaaaaaaaaaaaaaaaaaaggaattctgtcccagaaaaggtcgatctgaaatcaaattcatatatatatacatatatatatatttcaaaagatagctctgtttacatccaggattttctttgtttttatttttagaaataatcagaaatctcacttggtttctattaaaaatgcatttagctaatattcacctgtgtgagtgctgggagattcctagatttttaaaaatcacatagtaagcaggggaacgttatatatatatatatatatatatatatatatatatatatatacctaattccctaaatgtactatctatcctgcttatggcttcttcagttgaaataaaaatctcaccacaaatgaaatagagaacttcactaatttccattcaccaatgatggcagaagccccccatgggttattaagtctgagagatgtgtgaacaaacatgataataagcaagtaaagtgtatcgtaaaatatactgtgttcatttattgtgacaactggggtgtaattatactaggaaatgtactgcactttagtcagtgaaagtaataaaatttgaacaccaggagacctttctctactccgtgctattaagctacttttgaggggaaggtgaaaaatctaaaaatatagaatgaatgttcacttttatagattagcaaagcaggggttagtcagattctctggtcgtctaataaataaaaactctgttctttcctcattagctgtggatacaccaccaaagaacattttcctcaatttctgggtaattataatgcctaactttatgtggattgcttatgctattcatctcactttctccctccaattaaagaatagaacggcaaaaccaaacctgactccattgtattgtaactgcttctacaaagctacaagtagaaaagcaggaaaaaaacgtgcaaaaagataaggaaacaaaggggccctcggagatgataatgttgcacaatgaggagtaggtgtaatgattaaagcattagtggtggtcactaggaaacgtgaaaggaacatgtaatttcagattaggaaaccctgagcttcccagagtgaactgctatttgggaaagtgtagttaattgaattttatgacactttttactaaactaaaatgcatatcttttattaccctaatagtttcattgctactgtgatacttatgtgcagtgatacactaaaaagcatatgcaacaattcactaaagagcaccggagtggattattaccgtttccttttgtgctttggcagccgacaatccagatcataattacaggattggagccacctgccgactcactgaacagaagcacgtggctccacataaaatagagcaattctaacactaaaatatacaaaataaaataaaataaataaataaaagaaagaactatgttaaaccaaagagaccttcaggaacagcctatggaaagctggatatttattttttcatgaacgccaaatgactgactctcacattattactggcccagaacgaagcagagtttgccaagatcttcctggttaaactagatcatctaatgaaatatctgcatcccaaattgactggtgaattcagaccttttatggtcaaattcacaataaatctttgattttagagcatattatttctaatgcatagacgcaggaatgcaggaattgtcttcacttgtataaaactgttgccttggcatgcatttagcctgctaaaccagtggagattaccaaaaagtaaaagtaatgtaaaaatggtgaagtcaagaaagtgaatccatacagaatttttctaattggatattctcatttactaaacaagttaatccaaaagacgacattatttctttctgaatttttccaaatatcactttctaagagaagtcttccctcatttccttaagtcgacttagtcactccttcctctgccctttttacatgcttctattagagcagtgcttcttacacttccatgtgcatatgaatcatctgggatcttgttaaaagcatattcagagtcagtaggtgtgtgggggagggaaggtctgtgagtttgcatctttagtaagcttgcaggtgctgctgatgctcctggtcctctgaccacattaaatttcaacttttattttaaatatgggagtgcatgtgcaggtttgttacatgggtatatgtcactacattttgaaaagcaaggtattaaattacttcataaattgtcccataatgatctgtacatgtcaggcatttcctcttgtgtatgagctccttgaaagcaaaggcaaaggcagtatctcaatagctaccaattatataattcctactagttttggggtacagggaggatgttaccatacatcatctttaattctcaaatcaaccctgcaagatctgtaattgtgtttccattttacagatgaagaagctgactctcagatatgttaatcaacttgtctatggccacacagatgccatgtggcagtcagaatgcaattctggatctatttgtctccaaagtctgttttttctactgcacctgaagcctcatctgtttacttctgtaaatatagagtgtagcaaagtacctattgttatagaaggtgctcaagggatgtgtcttgctctgtgatcactttatatataaattcacctttgctcacagtatctcccttgtgtgaaatgctcttcctgcttctgtcttcccaattaaggtccatctcacttccaacgctcatttctacttagccagcacacaattgtgcctttcctctcttctgaatgcacacggcaatggtttgcagcacacaatgagcacttaaattgttagttatcttattaacagtatatttacttcattccataaatatatactgagtatatattaaacaccaggcatggttggaagcacttgtgataggtcatggagcaaaacagaaaaaaaaaaaaaatcccttctatcctgggtcttggaaataatttccccaactaaaatgaagacttctttgaggcagggacccaatcactccactttctgtatttctcattatgttttgcacatagtaactgctcaattaataatagtctcagtaaggtaatttaccatgtagatatgttcctaatatacagagtggaactacacacaaggcctttctcttttctcataagttatccttggaaagtgaaacgatgctttcacgctgtttctcactttcctccaactgcgttttaggccagaagcagaggtattaaagtcacacacagtgcaggtatcagccagagagacagaattcactaaaatttaatcatagcagcttttagcacaaaaaatatcttttcacaagtgtagaaattataggcaggagagataacctcatgaaaagttactttcactagcaaatatcttttttcctttacactccgaaacaattgactagaaacctgctaactaggagaagtcacatgcttaaaatttcacaatattttgttgtcgtttgagtcaaggtctccctctgttgagtgcagtggcatcatcactcactgcaacctccgcctctcggattcaagggatccttctacttcagcctcctaggtagctgggactacaggtgcatgccaccacacccagctaatatttttgcattttttgtagagacagggctttgccatgttgaccaggctggtctggaactcccaggctcaagcgatctgcccagtttggcctcctaaagtgctggtattacaggcgtgagtcaccacgcctggcctacttcacaatattttgttcaacaacattttgaatgtgcactatctgaaataaaaagtataaatgttttcctggttatttgaaatgctccattttctacttcacaaaaccatcatttttaaagtctgctcattcactgaacgaggtatacaaagctattctttttgaaggtatagctcttctaaagcttcattaggttgttagtcacatgtattaacatgtacaggaggcagacctgcagatgagcaatttagaagggaaaatagtactcaccttgctctgcatcggttcttcctcatttttgcaatttcttatgttaaataaatctacatatattaatctaccttgtatacattttaaaacatttgaaagagaagaatgcagataactcttctcaacttagctattttattcaatactgagatatttcataacacgatctgtggatggcagaaaatggaatttgaaatgagttctaattcttattaacatgagaacacaggcatacatcttaagtacagtttttgtaaaattgatgtcacaatttttattatgcaagaatgttatgagaagaaatatatttaacatatcaaatcctagtttattgctgatgtttagttagtagtagtattcctgcctatattaacacttacacatacacaattatattactgttttttaattatgaaaaagcatttatttacataccagtaataattacaccagcatttagctaagcaagtacacaggcatgatctctgcattcgcaaaatatttcaacttaaagttgatgtaagtagatatctgaaagaagttataaataaatagctacataaacatgaaagaaaaagaataggtgaagtctttgccctgtgtctcaggattaattcaaagtttccttgctgaaaagaggaagacatcccattaatcagatttctttttccaagttcttcctttttataggaattggcaggaaaggtctttggctaaaatacagcttaagattcgtgtactgtggctgagctgtaggctgcatcctagaagagccttaaacataagtaaaaataggtctgagggttgaggaaaaagaagagaaagaatatagtgacaatgaatcacggactcttagctctacagaccttaaagacaaggcaaaccaaatccctcattttataatgaggaaactggggcccacacagctgaagtgacttgctcaaggccacatactgggattacagccgaagaatctttgcatgtaaatcctatgtgatttaaaaagaaataaatatgaagatcttactagatatgggctgctaaccagatgggaaactgtgtttggaattgctggtaaactggaatcaatttgtttagcaagtggtaagaatatacaaacatggggaatgttttaggcaacgaaaaagaatgtcatgtgaagaatatgtacctaatataaatggcaattttgacagtggttctgttgattcaagttttttgtgggtttaaatctctttacagacaaggatgaaactttaattctcaatctatataaattatcaggctattatttcaaagaacacaaaagaatagtaatagagaaatgtacacttggatttggtcattctcctcacactggagggaaaattttgccttgaatagcatgaataatgagaacaggaacttttcaaacattttcaatattgccagccaatgggagaggctgataatcaaaatgaaattttgtattcttttcaaatcaccatatattaaatatccaagatagtattaaaaccctctcataaatgttgccatgatgttctatttacaaaatttctttgggaacaactttcattctattaaagtctttcattatctggaaagcaaagaactaaagaaaggactttaaagataatctaatagtctaatagtccttcaatgtaagggtatattagaatcatatggaggctcctaaaacatagatttcagagcactacctcccagagttcccggttcaggaggtctggggtgagatctaagaatatgtatttctgacagattcacaggcaatgttgacaatgctgatccaggtaccaccgtttgggaatgactaatctagtcaaactatctattattagtctaattaccttctttttgattcaggtagacaaattctagtattcttggaacttattatttaaactttttttctcaactcctccaacaaccaatttgttctgtttctgatgttgtcactatactcatcacctattaagctgatttcaggtatattctactaaaatattgaaccaaaacaatcacgcaaactaagtctcttgttcttggtacggttgcatatataaatgctatcttttgcataattaatacggaaagaaaaatcaccaagaacattttcaattccaactataccacatcaaatggacatttgggtctcctgtggcttctgcaaagggaacacatagagaattcttcagggacactggaggactaaagcagagcacagaagtgatatgctactactgtaagagaaatgggattattatctccagagagcttatgttattgctggaaaaatacttcaagagtgtcaaatcttaaagcttacataaaaaagatcaaataagtattgtagcatttcacaatgatctgatgattcccgtagtatcagctaatcagtgggaaaaaagtaaagtgaccaaaaaatagttatcttgaaatgacaaaatatcctagcagttgtcaaaattaatatgataatatacaggccaggtgaggtggctcacgcctgtaatcccagcactttgaggccgaggtgggcagatcacttgaggtcaggagttcaagaccagcctgggcaacatggtgaaaccccatctctcctaaaaatacaaaaagcagtggggcgtagtggcgcatgcctgtaatctcagctccttgggaggctgaggcacgagaatcgcttgaacctgggaggcagaggttgtggtgagccaaaatcatgccactgcactccagcaagggtgacagagtgagaatccatctcgaagtaaataaataaataaataaaaataattaatatgataatatacaaatcagggctgctgcaatggaatgtgaagaaaatagaaaatgtttgctaaatccatcatctcccatgatatgtatacgtgcccatgaacatatacacatacacactcacatacaaacttttcctagatacacacacagaacctttactcaaagcattttgttcctagttacggaataaagatattgaaaaatgcattttcattaatgtgataaagcataataaattactcctgccagatgtgatgtgacatgtacatattttcttaaaagagctgtagaaatgggcaaagatcacacacacacacacacacacacacacacacacacacacagttaattaacggatcctccaagacaccaatcttcaaatattactgagcatttaataagtgttatgagaaataataccaaaaacagaagaatgagataataaactacagatgagaaataaagacttatacacataaaaagacaactctagacagtaaatatttgggttcagaagcagaagaaccatcaagtaatcaaagactgcactactctggatgaacttgatgtgagctggatcatctccacaggctgaattttcttaggcagagcggaaggagggaaggaagaggacagcccaaatgagggcatcatttagcagggatgaaggcataaagaaaaggtattgactacaccagtgtgtctctatacttctctgaatcaaagagttgatgccagagcatgtgaagaacaaagcatgctgtagagttgtcgcataagattgtggaggaacttaaatgtggaaagaataaaagaatgccagaaaaactgcatgttaacaaaacctactgacaacattagaaaaggaaatattgagatagtggagagagaattttcctggagacctcaaaaccataaatgagagataatactgaagacctactccatttggctttacatggccatagctttcagggactcagataccgtaggcactgaatgtcaaaagagaggttgcatttagaactcaggcagcagcctctcatactgcactctatagatcaattttagtttaatgagatttaattttaaaatccttaggttttatctttagcacttcaacacactgaaaatgcttccaggttttgatttacagaattactgtcactgtcaataaaagaaatgtgcctgacacaccaaaatccagtttaattacttctgtaatgtctcctgcagctaagaggaaatggtatttctctgacacttttctgtttttaatttagcaaaatggagcactttcccttaataggacctgggacagcagattcagaattgatgtcatcaaagatggaccccacagtttcagcaacactgtcttactctgactgtgcaatgattgcatgaatctggatccttggtattggattccttgaagctgggcactcatcaaagatttgacacggaatcatggctgggatatttagacattatgtcatcacttggagaagctttgcaagcaaattcaacagcctgcttctacctagaactcttaacaatgtcagcattgccctgaactgctggaatccagatgaggccttgaaagcttccaaatagaactgccaaatatcaaaatatacactgtaccactggagtgaagaaaccaagaaaaaatgtgtactttatatcttctgctacatattccatctgcttctctccctaaagggtcatatgttatatatttataagaagtgttcacacctacgcgaacagtttccactgtctccttcaaatacagcctcctccttgttcaagacccatttttttaaattcttctatggtagctgaaccttttatgaaacttgttccattctgaaatcatttcaagttaagaaatgcccttgtaccttcctatctcaccaaatcctggggagattaagcctcacactctataggcctttttctgagagatgtgaatttagatcattagggtcattaaaatcacacaatctataatactcagagctaacatatcacctttgtgctttatgctgctatagaatgctacaagagagttaaaacacgtatagcatcacagaactgtagagaaggccataattcctccccataaaagaattctatactttttaactggcacagtaaatctcattaaagacacagaatgctttgttcagggaagcaaaagggatccctgggcaaggtgcgtttccttcacagtaatattttttttccttatgacttgaattattccttaatgcaagcacaatgttatttttatcttgaccttttttctggactctacatgtttccccaggctttttttcccttccctacaaaaatgaggggcccttggtcttcactattaatcttgtattaacttttaatacactgggcttcatgcatcctcttgtatttctctgtgtatctaccaaagaccttcataggccacactaataacctccgacttagtctttttttctttctgcctcaacaactgtataaagaataaactcaggtataattaacataataaatcatttggtgcacattcattggtcaacacaattctgaatcttaacagttaatttcccactatacagattgtgaatctgattcacataaaagtactttgggaagtattttgtctgatttcactatcaaatattagattattatttttgagaaactcagaaaggctgtcatggaaaaatcacagaaaattcccatctctctttcataatcagtacctttttaataacagagctggaagttaatgacagtatgcttttgacagctcactctgaaattttaactcatctgtagaagtgccaactgagcagttgaggggaaaagcataaggtttaaatttacatctaagaattaagagtgagaaaagcatggaaaaacattacacagtgttaaagtgcacttattactaatttctctagggaattttgcagctagggaatttcagttgcattattattgaatctatccccctttaacagagactgtgggtacagaaaagaatatggccttgaaggcagacgcattcaagttctgtttgtgccaactactaaccatttcagcccaaagaagttacttaaaatattcatacctcacaatcagcaaagggaagagacaatctaaagaactggagaaaatatttgcagactattaatccaaagaaaaagtaataaccagaatacataaagaactcaaacaattcaatcataaaataattataacaaataattgaatttttaaaatgggcaaaagaagacattcctcaaaagaagacatataaatggtcaacaggaatataaaaaaaatgcttgatatcactaatcatcagagaaatgcaaaaatcacattaagacatcaaaatcaaaatcacaatgagatagcatctcactccagttaatatggctattataaaaaagacataaaataacacatgctggcaaaaatttggaaaaagagaaatgcttgtacactgctggtggaaatgtgaattagtacaaccactatggagaatagcttggtggttcctcaaaaaatcaaacacataactaccgtatgatccagcaatctcactgctgagtatatatccaaaagaaaggaaatcagtatatcgaagagataattgcattcccatgtttactgcagcactattcacaataaccaagataagaaatcaacctaagaatctgtggataaacggataaagaaaaaaatggtatatatattccaatacgagttgaactggaggtcattatgttaagtgaaacaagccaggctcagaaagacaaatatcgcatgttctcactcatatgtgcgagctagtaaaattgacctcttggagacagtgaatagagtagaataggtggtaaccagaggccataaagggtagaaaggtggagaggatgaagaggggttggttgatgtatacaaagataaagataagtagaagaaataagagtagtgtttgataacacaatatggcaaatacagttaacaatattttattgcatatttcaaaatagctagaagagtggaattggaatgttcccaacaaaaataagtgataaatattttaaatgatggatacccaattacccagatttgatcattacacattgtgtgcttatattaaaataccacatgtaccccctaaatatgtacaactatcatgtattcataattttttttttttttgagatggagtttcacttttgttgcccaggctggagtgcaatggcacaatcttggctcactgcaacctcctcctctcgggttcaagtgattctgctacctcagcctcctgagtagctggaattacaggcatgtaccaccaggcccagctaatttttttgtatttttagtagagatggtgtttcaccatattggccaggatggtctcgaactcctaatcttgtgatccatctgcctcagcttcccaaagtgctgggattacaggcatgagtcactgtgcccggcataaaattttaaaaaatctatttatgcttcagtattcttctttttacatttaaagtaatcagatatttttggagaaaaggtaaagcttataaaatttaaatggcatgcatataatacatattaattatgatattagcactgaaatatgttgatgtaatctacataaattttttgtagttctttttatgcactagctaggcatatccacagcaacaaagtatagaaacaacctaggcctgatctaacacttctttccaaatccaatcataattatattattttaaaataaaagatttcataaattataaggtaattatgtgtaatcctatactttaaaaacactcctgataatttgatttcataaagtgggagaagtatttaaccgtttgctctcttcaaatatcttcctgattaataaaatgatactaagtatttttttacttttattttagatccagaggtacatgtgaaagtttgttacataggtaaacttgtgtcacatgggtttgttgtacagatcacttcatcacccaggtattaagcctagtagccaataattattttttctgctcctctccctcttcccactccaccctcaagtagactgtggtgtctgctgctcccttctttgcgttcatgagttcacgtagtttagctcccacttacaaatgggaacatgtggtatttggttttctgttcctgcattcatttgctaaggaaaatagcctccagctccatccattatcccacaaaagacattatctcatttctttttatgtttgcatggtattctatggtgtatatgtaccacattttctttattcaatctgtcatactaagccatttattatttgtacttatttggtattgtgcaaggttctgataattcactgtgatttatcttcagtttgttcacacgggcttttggtacatcatttttagagaagtaaaatctatataaaaagtaaaattaaacttaatggctccaagtgtcaacagttagcacctctgattaaggcagtatccccatcctgccttgattctgcacctgttgtgttgctacagatggaagtaacatgataaacacggatatataatgcattcgcatggaaaaaaaacattcagatgaggctatctatttgaatagcatttagtgataactaaaaccattgtctttccttgagaatagttagtcaaggtgactagcaaaacctcctctgaatgcagctctggttagctgggctctggtgagataggatagtgttaccacagtaagaccaacattgaaagccacctccatatttacctataagatcgatgatgaagagtgctaacatttgagccaaattaaggtctacacagacagagttttaatgaagccagaaaaattagagcatactagcaggaaaatccataggtgaagaaaacattctgactgggtttgcttcctttttgatttctaggggccaaggtggcagaattcacagactaaaaggctgctgagagttgaatcatcaagctgctcaacagtgcaagggactaacatagataattcaaatacagcattactctattcccttttttgttgtttttctccccacctaaattttctcatatagatacagactgaaactattattcagctgcccaacaataatataaaaagaccaatgcttccatttatgcatctacttttatgatgtcaattctaaaaagaagaacaaagataagtttacgtaaaatagtagcagatagcacttctatgacatattacatttctctgtcatacattatgctttattttctgtccttcattacattttcttacttagtaggaaaaatattttaatcctttatcattcacctgaggcaggtctgaccctgtttccccatagtttttttaaggtgttttcagtaaagattgcttatgaattgctttaaacagcttaagggcttccacttagaaaaaattcaaggttaataagattcatcatactcacaaagagtatctggttgtggacatagctacttgctaaattttattcagccctaagtgacaccagcagcaaatcagctcacagcttaatactactggcaactctaaatgggagagaagtaacattactcagatccaggtttttaaaaatatatgttatgattcacttccattagttcatatattgatgctcagacactggatattggattctctttcaaacaacaaaagaagctgagaaacaaagctgaagatatttttaaatgtcatggtaaaaagtcacagggaagtgtattttatcctcatttcagcgaatgtttctaactctcatatgaaagatacaataaattcctatcagaaagattttctcttggcaaagtttaggattctgaaaacagccttttaataaaacagcacccacaccctcctaagctgtagcaccaaaataacagcactatgttatattcttcccttatggtaacagacactgttgaagctgaactgtaatttggcatacaacatttctatactaatgtaatgtgacaatgttattatgttcgctattttgcatacggtcatagccatgttcatcttctccaacctgacattaagttagcttaatatggtaacattctattccggaccactgggtaaaaggagaaaaggattattgtgtagcacactggtgtgatgatggtggacgaatgtgtaagtattaataggtgatatataaaatttacaatgaatgtaaacttttagcacagaactggcacatagtaagtgctcagcaaatggttacatccaagagaaatttcataaacagctacaccatacaatgtagtccagcacactgtttcctacaatttcagaagagggaaaaataatgtcaagctcagaaaacaaaggaagtttccatgggacaaaagagttttagtagagattgaaaaggaaattatatttcttcaagcagacatagtgaaagaatgcattccaggtggaatgaatgcattttccaggtggggaaattagcataagcaatggtgaggaaattggaaagtgtaatgttgttcagaaagctgtaagtaaattggcagtaatatgccatatggacaaggttctgcaacagataagtatgaacatgaaggctggggtcagaccattgaggtccacgaattccacattgactaacttggagagtagtattggacactgaggatatatttgaaattcttctgcaagatgcatgtgtctagcacgctttgattttagtgagttattacaattacatgcagcatgctataaaaacactgggcttataaaccaagaaaacagagaagaatgttattcctagtagaagtatagagtcttatagggaggtaagactaaacataggtaactataaggaaaaagtgatggcaaattaaatagtataaacaaaattctataggaagccagaggagaaaaaaaatattgcctctggttaggagaattaggagagactgatgacatttaaactaggaagaatagaaagaaagaacaaaactggcagagaggcacagaatggatcagaggaaagaggaataagaaatgggagataactaagaaattacatgatataccagaaaaattatacagaggatctaaaatttggtattgatatggaagaaaacttgaagaggtgagtatatgacattaccctgtacacacacctgcatatccacatacacacatgcacaaaacaattgtttttgtcagtgagtaggtcacttagatggcaattttccggggaagaaagggtttaacaaacatttcattaaaaatagcctttggcatcattttgaatagcacttctttttgaaagattcctttcagttcaattaattagtatgatttatccaagattacatttacaagctacaaagtattcccatcttcccattgttaattatatctccaggctaatataaatacattttttctagttaccctaacccactctataaaccttatcagcgagatgacatttagaaattctattttgggggagggaaggtctcatttgtaatgtggcatgttcgtttccccattaaaaagttttgtttctattttcttttttgttttctatgtaattggaggctgcaatcacagaatttatgaaaaaataaactagagatgaaaatttcattaagaagtgaaatgccttaaatggctttattttaaaagaaaaatcagcttctatacagaaaaggagtttgttaaaaccccaggaatcacactaattctatttgtgcatcttagagaaaaacagtgagatgtacagacaagatttattttgatcaatttaaaaagtgaggaaagtgttgcatgctatttctattgcttattaattccacgtcttcaaagtaacaattgctactatatcttctaccaattataattgatacaaaataagatttgcttttgaatattgatttgtacctatgtattctcaccactgaaactccaacgtataagccaaggaaccatttcacattttcagaaaacccactaacaggtaatgatttaatcaaaatgcatgtattctgagagctctctaaagtaattttaatgctgatttgtgcaagaggcatatcaggagacacatttattgaatgacatttacctatttacaagaaaataacgaatagccttatcattgtcatcaccagtactatcacccaagagcagcattaaaatagttttctgtaaaaatcattcgaagacagcatgatacttatggttgtatcttggtgtttctttagggaaagtctaacaaatacatacacaaaattatattctttatatttaactggtatatgaggatacacagtctgccacaaccaaatggcaactgtatgtaaaacatggaaactacattaagcatagtttggcagaaaaagttctttagcaacatgaaaaatattttcacaccaaaaaaatccctctcaactaccacatgtagtcatacatctgtcaggattgtattcaggatgaaaaatttgcgataataaaatcttaacaagtattcagtcttctgattgtccttgaaaataaatttacgccattttctgtgaggcaggaacaaatgcaggaagtaatttacctatacacacatatacatatccttatgaaaagcacatgtaaggctgctatatgtatatatatttattaagactttatgtaaagttgtttatataactcaaaatggcgttattgtgttttaagtgtgatttggcttgcagagtgttcgcaaatgtatgatagtttgaatacatgtttattgcttcaggtttactgtaattctatgggagaggaaactagtaaaatgaagaacaaatatttctccatctacagtggcatggttgttaaaggcctcttccacatatgttttaactctgtattggttgtgcgtttttccaatagtcaatattttggaaaggaaacctaaagacagcaggtaaattgtactttattgctaggctgcaacaactcagttcagaggattactgtagctttaccccatcttctacattgcgatgcacatatctgttgacatgaatacagtctcaaatagacaaaggtcaaaatgaacaagctctactctttctttaaatccacattcaaattcagcctctgctacaaaatctaaaccttcaaccgttgcatcttctattccatcatcctggaggtttagcttaagtgttgtagcactgacaacatatagcacgtattctattttacaaccaggtcaatttgtcaggaatattctcttaatatagcagaatgcaatgttttgtatgaaattcttttatcattttgatgatgtgctgtaaatcaggacctattagaacattaagacacagaacttcatcttatagatcagttaattccatcttcaaaccctcactgctgtgatataaattaggcactagcagatatgccatgatataatgtgaatcatgtgttttattttcatgcttatattgtaatacttagttaaaggattttaaggggaaaaacataagttgctaagatacaagggagaatggctgaagggacaatgtttgaacatatttttttaaaagtaaaaggcagcaatgggcttaaagagatgtacgcagagagaaaaatgagacctgtaaccattcagtaaaattacagccctcgagacataatcatatgaaattaagtattatttaatataaaacaatatgaaggttctttcaaaaaccaagggagaattgtcatatattggaaatgaaaaacattcttttgaacaaggtgatcattagtaattaaaaaataacaataaacccaaaaaccaaagaatcaccatcatcacaggatttagccactttaacaattagtatttcaaaactgtcctttccgtagaaacaactgcttctatgggttatgacagttcgactgactcagagttaatataaggactttcagtgttagactttagatatcaaacagtaactggaagcaacgatgagtatcagtccatactcagagaggtacttacggtcattgcagagtggtccactgaaggaagtcatactacagtcacagctgaagccatcccattgttgcaagcacacaccttgattggaacatgagtcctcttggcaggttgtgctgggccctgcaaaacaatccaaaggaaacttgggttctttaaaagaatccaaaagcattttatacatgagctagatcacatgtagtagttgccaacaccacagatgatatgtccaaactagtttttaaagttctagttcacacacctgaattaggaactgagaggctgtaatatgaaggttttcttaagtttcaagtataggataaaatacattataatcataaactaaaccaacaaatagcaaaaacaagcacatagcttctagtatgattattgtagcaggtaatctcattccaacttcaataattctttatcactattttgattttagaaaatgaatggatctccttaacattctgaccaatgaatagagacataatgagaaatggagattataacttcatgaaattgagataagattggcaaaataactgaagagagttatgcaaaaatgccctagaggtttccaaacgataaagttatgattgctgggtgttttgaataggtatgttggcaagtatcaattcacatgcttttaacaatttcatgcaattaaacataaaattaaaaactccatataaatggcatgccctcaataaacatacaagtaaaaagaatgctagtctatttctaaagaatcataactagaacactgaaaaacaaagaactaaaaaaagcatgatcaaagcactaaaggcaatcactatacaaacatattcaagactgaaagcctttatacaaactatgctacaaagttaggcttcttgcacaacgttcaagaaaggaaaagaatgaaatctgaacccaaataacagttactgcagaaatgtaaaatatgttattttagggtttccactgtgtattatggggtttcagtcttgttatatacacacagggctatctaccttgcaagtcagctttcatcaatgcaactttgtcagcaaaataaaaaaaaaagcaaaatatattaaatgttagtaagcaatactgaaatggggcaaacacagaagaatgttcagattcaaaaggcatgctgctgtaaagagggagaaaaatgctatgtagagcaaacaaattaatactaacagccataaatcttaagagaagccaaaaatgagaaagcagaaatttattagaatttaattgtacatatgtatatatataatggttaattgagccaatgacatgtaatgaaggaaaattaaaagggcctttgtatgtttcctctcttggatagatatgaatgcattaccaaagtgactgtgttgcttatttggaacatgcagcaccattcatcatgtgcagatacagtgtagactatgatcagtagcaaagcaattatccctttctatgtttttccctctagatcctttatctttctgttgcaattaaggcttcaaaccgtaatgccagccattcactgacaacagctggactttagagtgacaccaaccaaatgctgcataaatgatactgtatatcatttagagtggatgaaagaagtaggaaggatggaagaaataaactgcaatataatccatcataaaggaattttctgaataaaatttccatgtgcagcgtttatccttgaacttaccagattgggtatatgccacttatgaatttcagagttacgtctgtattttctacactttcacaagtattttcaactcttataaacttccctgtggaataactgttacagtaaaacctcactaataagaacctatcttagaggagggtgaaaagggaatacagtctacctaaatagctttagagtataaactaaatatattttctagtaaataaacatataggttttataaaaatagaaaaaaagacaacagctaattagatgctattaatgtaaaagagagagcctctgaggtgcctgctttagtgaataaattagaattttctgtaattatattttgtataaatagatgattttgaaaatggcttctaaacatgtaccttacaatcacatttgtattataaatttttagtaaagatactctttattgaatgttattgaatttagcctagcctctgagaattcacaaattcagaaaccatgatattgtaaatcttaattctgtaataataataataataacagcaataattgtaacaataattaaaacaaaaatagtagtttatataagtagtaatataataagaagacctcccaaatccaggaaacctgaagagagtaacagttgtttttttcaacttagttatttgtaataaagaactaagaactaacaaagaactaagaactaacaaagaactaagaaccactaaactcaacttagttctttgtagtaaagaaataagaaccacttaattgcttagttttaatttttgttccaaactgtgagagggaagtggtctactgatccttatcccatggcattagagatcaaaaataattagcatatttttaaaaataaaatctctcaaagcaatattccttagcatatttcttccagtgttaagcaaataaacagggagtaatacaagcccagtttggggagatgccattttatcaaatagctatttgctctctgacctgcacagcagaagaaaaggtcagaagcaagaactaatgaagatccagattttggtttttgttttttcaaaaattatcagaaatgcaattgagaaacaatgctaaactctaaaaatagtaaaactacaatcttagaaaaataatctgcccatattgtagagcagcaactcagagtacctgccaagcttctatgtaagcatacagacgtgctgtattttattttcattatcacaatagtctttatattcaggaattacaagacaatgcatgcctttgcctgacaagacacatttttcaaagtactcaccttctagacaatacttaaacattgacaggtattacacaagagagagccttaaatttatttttctttttagttatgtaatattatctttattttatcactgaataaaattaggaaaaagctacaaggacatttgtattaagttatttaaattaataatatgtctaaaagggaaagaaaaatgaagataaaactacaatttccagaaacaaaagaaatgatacacaaaagaggttaggtgtctctgctttcaagtaaggtaaacttgagtttgaaacttgtgtcatccacttactaggtgtgggactttaggaatgtcaccttacttttctgaggttcaatttactcattaaaaaaaggcaatgatacctattgtatagagtcttgatgatttaatgagatagtataggtaaacatattcccaccagtgtttaatcaatgatagctgtcacgattaaacagaaaattattcctgtagatataatggagcctagagctgaatgttacagttgtacaaaaagagcatctattaaaatttcactctgattttatgtagagatattatcttgactttagtgggcctgcttattggttgaattccagtgcccattttctgctacataaacagaaaaaagccatccaaagtatggtctccagtataacagcatcagcatcacttgggaacttgttagaaatggaaattctagggctctatctcagatctattgaattagaaaccctgggggttgtaatctagtgatttgggttttaatgattctgtaagtgattctgatataggctaacattcaggagacaataatctaagtagacttcgacgggttaaaatccgtactctagctgaggtgaattttataaataaaatgaaccattactccctgaaataaattagaaataaaaggcaacaagtgattatttaggaaagatcaaaagttttttgtatgcaagaggcttagaggtgtgtgggtgtattggataggaacaatggaaactcctcacaagatattattaggttataccaaacatatgctaagtagtcctatcaatatggagcctaagtgattccagtgtggtttggactcaaattccatgacataacaatctttagaaagagaatttattaggtatctacagttaaaacactaatcctaaaaaatgtgtgaatctcatcaactgtacctgtaacaggtaaatctaagattattcctagaaactatacaggtcagaaataatagtaaattaaaagttgttcaccttgatgttggaatgaaagaatcaggacagaaagtaatattctaagagtaaagaaaaaaaggggtgtcagggtgtgaaaattataaaagctcagatatataaagcattctagataaggaaagaaccaatgccataagtgactgggttcaaatgttcaaataatagtttaatgtgtaactaatcatcttaaccaaattccttactagattatgtgggtaaacaacaccaaacatcattactgcaaatgccctttgttagtatatcctgctcctcttaatctacttgcttccgcccactcactcacattacataccagtggtgggggtcctgtgtgtttgcctcttattttctatctcattgggtatatctgcctgctctcaccatttcttgtaggtgagaagtcacataccaaacaacttgtagaaaggcctatttttaacaaatatgttccataagggattgtaatacctttctttaaaaaataaaataaaataaaggtacacattctcactaatgagatcacctccaagaattattatgttgtatcacattcttgtgttcatccactaatgggaattgatccccttaacaattttgtctctcttaattaaaattaactgaaagggaaaaaaacatagtttccttatgttttacagaggcattatgccaaaatatcaaataaagaaatatactaataacattaaaaatgaactcaacaacaccttccattactaaccttatcctctagtattactgaaatacagtttaaatttcacctaacatttcatggaaacacatgctgcacagaggaaaaaaatgtattttcaaatataaaatttccatgtacttaagtaattgctaaatataacgacattattttggctgagaataaatgattcataatcacctgggggacaggaattcaaatttctttcttcttctctcatataaaacatcctcatcctcataaatctaaaattttcaaaatggcccaaactgtgttcagtattacaggagaggcagcaacacatgcagagccacaaaattcatgataatgtgattaaattacatttatggaggaagaatttgctcaaataatctgaggtgttgaagtgaaaattatctaaaatgaaagtggcaatcaaaaagtactcctacagatcttggtctgatagagagcacaaaagaaaagaagatacttcagtgcatttctgatataggaatattagcctggggtgatacaagaaacttgtttttgctaaaacagactgaaaatatacaggatacagtgtttctgccaggtacacaccaactgaatagtgctttgagaatggggtatctgaacttttttcttttgttatatgctattggatatagatttacttatttttattttactttttttttaatttcagtagctttaggtgtacaagtggttttcggttacatggatgaactatatagtcgtgaagtctaacatttcagtgaacctgtcactcaagtcttgtacgttgtacccaataggtgttttttcatcattcaatccccttcccacgattccagcttgtgagcctccaatgtcccttataccatgctgtatgcttttgtgcacccatagtgcagctcccacttataagtgagtaacatgaagcatttggttttccattcctgagtcacttcacttagaatattggcctccagttccatccaagttgctacaaaagacattattttgttctttctatggctaagtagtattctgtggaatatacataccacattttctttatccactcattggcttttgggcacttaggtagattccatatatctgtaattatgcattgcgcagtgataaatatatgtttgcagatgtctttctgacatagtgacttctctcactatccttcacaaactaatgcaggaacagaaaaccaaatactgcctgttctcacctataaatgagagctaaatgaagagaacacatgaacacatagaggggatcaacagacactggggcctactggagggtggagagtgtgaggatggagaggatcaggaaaaataactaatgcgtactaggcttaatacttgagtggcaaaatcatctgtacaaaaaacccctatgacacaagttgacctacataacaaacttgcacatgtaccccctggacttaaaattaaaacaaaaagaatgtagatttttaaaaaatgggcacaagttgattaatactcggtggagcagtatttgtttaatgctataaagcaagcatcgtagaactgattaacaaactaatcaaatgtactacatagctcaaaaacaaaaacaaaaacaaaaacaaaagcaaaaacaggcaaaaaaaccaagatccatagatatacctcccattttacattgggcattaatgtaggcttgcaaacagtacagaaaatttaaggtttatgagataaaaaattaaaaacttgaataaggatgtctaagcccaaattgggtatttgaccagttatcagaattttgctggacagtgagattcactctcagttagacaggtggaattagaattatttagagcatgatgacaaaaatctaataccttcacatcctctctcgatctgtccgttgcagaaaagagcatcggagatgaggtccggaagccgtccatttaaatcaactgatgccaggcagccttgaaagccttctttggcatgtacaagttttggtaaggatttgtatgtttctttagctactcctcctatatataagtcacctgcaagaagatcaaagtctttgttacaaaagtaccatgtcattgactttaaacacacagtaggatggagaaaaaacagggaggtttatttttcattaagttaataaaaaattaatttatgactagctgttttccccaaagtgctaaacaatagagacgtttgaataatatactggcactaggagacatttctaaaagctatttccatagacaactaaagtaattccatattatgtggtcaaattgaaggaatgtgggctagctatagagatgcatacccttgcgtggaaatccaggcctggttatttgcaagccctacagccttgtgtgtgtgtgtgtgtgtgtgtgtgtgtgtgtgtatatatatatataagtttctctgattattagtatcattgtttctaaaatgggaacaataaaaacctatgccagagggtttcatgatgattaaatgagatgaaatatatcaagcatccacaagagcaaaagtataaagtggacacacagtcaacaggcattattattaaattcaccttctgcttagagatctctgtgtcttccatttcatcagaagttcagtaaatttcttcttgtatctaaagtcacttctatactaggctgaagcccactatccttgcttgcacctctcttgttcgataattcacataatagtctgtacataagtggatattgcatccttcttgaggtatttctgtttttaggtaaaattacactactttcaatttttaggctgctctgaaatccgttaacaaattttcaacttatttttctaattttattgcagtttctaatggaagacattgcttagctttgtttaactttttctctctaggtttgagattccccaactttatggactattacttaaaaaaaaaaagagattacaatctatgttggattctgtttctttttctatttcagattatttaccatatctggataatattcaataaacataactaagtgactttagtaaacatttaatcaatgtggaacataaggaaggtgagctcaaaattcagtaatatgctgctatagctccagtctacaagttctgtaacatactctttttatctacttcttcaactttcattttcatttgaactttctttctcatgttaaccattctattcaacttgatgtcacttggcacattttccccagtgtaacacaaaaatcctgcaatcttactgttcacctgggtccttctgtgttgtcttcacgagacttgggaacaaggagaactgatacacagactgttgagctgtgagtaacaaattccttggtctcccatccagaaatattctgtcttctgcaggcacccattaaacagtaataagctaacctattaatttgtatgtagggtaaaatcaaaccacagatataacactcttgaactgtactcatgaataaattgaaatagaggaatcatgtggcatactcaaagtcattcaacgttaaaaactgagaacttaggtccttgacctaactaaaacttaagttttataactatataatttgcattgaaagtactggatgtatttacttccccccttttacataaagcaaagtctactgactattaaccatcattcttaatattaaaagacagcatggttttggtcagagaggggatactattttgaagaattatttgatttttcttccatatttccattctgtcctttgtttttgctctcacttaaatttcaggccattgtgttttagttgcctcagagaaaggatatgaatcagaaatcaaagatacaaaattagctttctgtatttaagtctaaaaatcctagactcttcgaggaatgaaatagaatacattggagtttacataagaaaagtaaagctttcctactcctctttcagtcaagcaggagataaagttggaagaacctagttgtgcaagtacagtcattggcaaatgtcaaagagggtgctgatttctaatttaaggactgagctctggtgaatctcaaaacctcaggtaagtttcaaggagtaatgcaaacctctgtgcatttcctcaggagaactaagagggagcagtgagagctctgaaaagaaatggctgcatggtggacttagataacctgagaccttagacagtctcacacaacgttccgtactcctctgtgccatgggagctatagaacaatttccagactggcacagaaatagcaaaaaaaaaaaaaaaaaaaaaaagtccaacctaaagaggtcatgcacacaagaatgaagatgctgggtagcacctcagtgagcacctgagttgtgactctagaatatttgaaacaagcttccatgccacctctctttacccgcccgcccccctaccaaaaaaaaaaaaatgagtacagtagaactcaccccattgagttatttagatatgacacaagaaaaagaagggaactaaaattgcctgagattgtaccttcactaactcaaagaatcaaagctcaaaatagaaaccaaggtgagttatagaaaaatagaaaagttacatttcttgtacatcagagattgtgggctgagatttataatttgacatgacaaatagcaatgaaaggaaatactacctactcctttcatttgttgaacaaaatttgttagaaaatttcagctctcctccaggactaatgaatgtagtagagtggggaattgaatgaagaattcttggcacagctttaggcttttcagatgtagaactcagtaatagaaattatgtatagaatactatatatttattaatcaatcttcctctgtctgactgtaacctcctgaaggagagagactgtgtttcccagagtgcccggtactgggctctaagcacggttggccctcaataaatattgtcagccaccttatggattgaggccacggtagaaaagaataaaaaaagaggaaacagtaaggcaacacatgaggagagtgctaattctaaaatgcaccaacttacttccttttcccacttcctaccacaatccctatgtttttctattaaaaaacttacttgcctgacaacattgtaaagcttattgaagagaactagtaatctttcccttgagttactaaagagcagaaaatatcagttcaagcagtgtgggatacaaccttcaaacatagcaaggtagacgaggttggctttataaataggggactcattctcattttcattactgaagctgtacttagcaccaccacttagtactgtttataaactctttgatatagcaaatagtgatctaaagtcccttggtgggttgccacatgaagagaacaaagaaactcctttagtggtctgagccctgtgtactattatcactttatcaaagatgcaggttctctttttgatccttgaagtgacgggtttaaaaaaaaaaaatgacccattagcactaatgggtcctgcaggtgagtccctgtgcatgtgaaggaggatatacttaatggctctgtgtatgaacaagagcctgcatgggcaaccagtaaaagccaactttcctgtagatatgaagctagcctgttacctcttcttcaaaatgagtggctgatttttaattcatatgttttaaggaccatgtaggcaattgataaggcaaaggttgaattgggacactttcagcaaaagaagtagagaacatgtacaataccaaaaactcaaaagtctaaggggtgagtttcttaaaataatctcaataatacccttatttttagtactgtatatacacagccactatgttcctctcaagagtgttatctgtgaatgaactggggtgatatcatgagtatccattccgcagtaattgagcagtaatgactagggaatagggcacaggcattttggttttctctgtctacaaaccctggctctgccacctactggctgtctcagtgtaggcaagttaggttacataacttctttaagagtcagattcttcatctatgaaatggggttgataatgcctaccttgcaaggccataaggattacaaagtatgcacataaagcatctagtatacagcatggacttagcccgtcattgatactggtatggctgtcagtatatctgtaaggatgacacatctatgatgtacctcaatctatgctgattccactgagaaatgcagaagaaggagaagtatagtttatctcctgtttctagcacaactggagtgacaacatgtcaattttataaattctccatgatattttttctattggatttagttgacagtcatttgtgtgctgaagtgtgccttacactattctaaaagtagctcacagagctcctttgacttaatttgaaattcggtggcattgaatctggtaatataaataggaaagttgcttgacaaatatcttctaatttgacacaaagcgattaagaggacaaaaaaactctatgaagcccaagggccaggttgtcagttccagactaaacatgccttagaaaatcagagaaataacaggtttttgtggactgtggttgcaaagtgggggagcatacaaaagttgagacaagaagaaagtatgggagacattactattgtaatgatataaatgtggatgccagacacagggaacagcacaattgtaccatggagacaaaatttatatggcatttaggaaagagaataaaaggcttgactggaagagaggagttttcagttatttattaagttatgtaaataatattgtataagtaaagtcaaaggaaaggccaccatagaacttatgactgctggctgaaaaaaataaataattaaagataatgagaaatccaaggatcaaagcaaagcaggctaggaaactagggaatttgaagcagtaataatccggaggagaaataaaattgcatttaacgtcatgtatgtggaatttgagtaggaacatcctagaggaatccagtgatatgaacctgggccttagggaacggaggttggagcttagaggccttccttgggagccaccaaccaaaagcagacaaatgacgcggtagagatttcctcttcacttaaaataggaagcataaggcaattagagtaaagaccaagctctgccttacagtagcagaatgcaagtgtcaaggtataattagttctttgactcagctttcctgtttattcacatgtacttttttgaacctcttaaatatctcactttcattttaatttttttaaaaagcatacagaaaaaggacaattgccttatagatttgaatagctaaaactccaggaaatatgaaggaagctctcacaaacttttataaatggcatttggggaaaaagaaaaagtgaagtcacacaaattagcttactttcctatagctggactagagaaagtgcaattctagacacttcattttaagaagattggaccttggagagaaaatttgggtgcagctttttctcctaattcttattgtgattggatggtaaaagtagtgcaatcaagcttgggtagtttctgagcacattctatgggaagggtgcctttcggggaacaatcaacctctgtccccaaatttgtaccattatctttaattttaatattgtattgcacacacataaaggaatatctgtaggtcagaccttatctagatacactgagagagcttgtctttaggtgacaaatccaaacctctaaaacaggtgttccctgttagataaaagaaaatgacctataatatctgataaacaaacatttgtttgctttcttagtagaaagcctaagtgtgactgcttaaataaataatattaaactactaaaagaaaaagcatgggaagtgaatactgctctaatctatttgagcttacaagtaaacaaatataaacttctataagaaaccacacagaaatgaacaatgaaaactatacaagatcatttctaagttcaaggcttgtaaaatattcaaaatggaaatcaaatgggcaattcaagcagacattttgctctgagacacaagatctgtgtctgtaataaatctccattttttaaaagattaattttagaaactctccgctgaagagatgttaagtggtcaccagcttgatttattgttttttaacttctatacatcttagtctcccttggtacataaaaggtttagccttacaacaatctatttttgcttctgtaggaaataaccataaattattatctttaggcgtgtcctgaatttctaggtccagcctaaaatcaaaccttcatcatctcccttgctgtgaaattactttttctaaactttcatgttgtgtaacagccacatatctagtctacctgctctccagattggaaattcagtatcatttttaactttattttatatctcacaccttacaatcaactactgccaaggggtgaatgactcaactttgccaatatttctgacatttgttgtttcgttttcattcccatttccagttcttatctatttttcttcttgtacacaccttttaagtactaacctgttacctggtgtcactgtctccattcagcctcctcatcaacactgtctcagtcactccactgtgttctgatatcttcaatacctttctgtatcatctaaattaagtctaaggctcagcagtgatcaagattttgaattacttctcttcaaaaacttttgctaaactttgaactatctttcaaaaataacttttgccaggtagaagattgaaataatatctatcttcgccccacagtccgacctttagtcaaactttgttggcagcctttccccaactctgcattttcccactgctccatccttgcttgtggtatacaatacttccagcatgaatgcctttcctcttctgatgttgttcttcaaaatcctactcaacttgggggactcaactcaaactccaccttggaaatgtgtacctgtttccttagccacagataaatatcttggaatcctcataaaaaattgaaccccttttctgaaaatgattttatctttttcagttctttgtatgtgtaagccttatgtaaccattagtttatacattatttgaaggaataatcctaaacacgtttatattctcattttcacttagtaagcatttgataattagttgttgactcactgaatgaatggatgaattagtagttcacattcaataaataatcattgaaacaataaggacacagggaaggttttatgtcagcactcatatttgtccctggctctttttacctgagcaataatgaattaagttaattgtggaaaatttttcatctactaatccatttctttttcttttttttttttttttttttttttgagatggagtcttgctccgttgcccaggctggagtgcagtggcacaatcttggctcactgcaacctccgcctcctgggttcaagcaattctcctgcctcagcctccagagtagctgggattacaggtctatgccattacacccggctaacttctgtatttttagtagagattgggtttcaccgcgttggccaggctagtctcaaactcctgacctcagatatccgcccgccttggcctcccaaagtgctgggattacaggcgtaagccaccatgcccggcctgatccctttcttaaacacaaaggtgaagccatccagctcattaagaaaatttagggaattcaatggcatattttttcccactctgatagtgtaacttgatagagtaatacatgaccagttttaactgacacatactgaatttatttgtagaaagagatacagagatgaagatagaggtgtagaaacagtttggagtatcagtgtgcgtagtaatgagaacccatgcatgaatcgtcttctccaattaaaatatgtacaaaaatctttggaggaaattaaatttgagcctatcctggccttctgtttcattctggctctatgctgctccatatacaaagatgacctgattcatgcatcctccataggcatatggacaccatgagcacttcacactgtctctccagactcatctgctctgttattatcacaaagaaagacatgcatttatttgctgtgtgtgtctgtagaacacagagaagctaactgtgtggacccttagtgctctgctctagtgagtttgttaatcctcatctgcacttccttttggtttgcagatgtttcactccttctagcctttgggccaccactcaaagactcctaaggttagagtccttctagtttgtagcttctatttcttggctccttgtcagccacaggtgttcctgatgctacagcaggcttacacatctaacagtatattgctttagctaaaatgactttgagtttcacaaaaatcaccgagacaactgaactgaaatgtacagagtcctgagtgagagaggtcttccttactgctttgaatctttggtaatcagtgtcaggcattactatggtcaaaaccagaaaaaacagctctgacttcatcattataataataactgacatgagttaagtatccttaacttgaccaagcatttgcacatatattgttatatctggtttttgcctgttgagctacaagaggagtaaaggttatcagggatacatgttacagatgaagaaactatggtttagggctacaataccagaacagggcagggtcttattgcaagcccaggtcttctgaaactatgttaattgtccgttaatccagactgacacgcacatgtacaccctgtacactctaagtggcaagtggccaatatgtacagcttcactactacaacatacaggaaattttggagagttgtggctagttgataaaagtaatggtaataaatggtagcaaaaatccaagcaagctaacaaattcctgagacaactggtacaataagagactcatctgcataataatggagtaatctcataaaggcaaagtcaattttcttccataattataaatattaggtattcaaattctgatacataagtagaattcttatgttcaaaactttttaaatcaaattttatcaaaatgttttttaccaaaagtcaacatttgatttttagatacagcagttacttttcaattgtctcccacaaagagataaatcagacacttgtatgtatccatggcccaatctagtacaaaccagcacttacgtgggacaagttggggaggggcaaccccaagaagataagagtttagaccttaacgttttcctgtagtgagttttggggagttaatattgttattatccatatcaacagaacatataattctttcaatattctgaacttttgtttctttttttttttttttttttttttgagacggagtctcgctctgtcgcccaggctggagtgcagtggcgggatctcggctcactgcaagctccgcctcccgggttcacgctattctcctgcctcagcctcccaagtagctgggactacaggcgcccgccactacgcccggctaatttttttttgtatttttagtagagacggggtttcaccgttttagccgggatggtctcgatctcctgacctcgtgatccgcccgcctcggcctcccaaagtgctgggattacaggcgtgagccaccgcgcccggccgaacttttgtttcttatttaaattttgaaacaaaactgcccccaaaaagatttttttaaagtatgattctgaaacttacaacaggaagacagattttgtttgtatgtttggccaacagactgtgaggaaacctggtgggcatgctaaatgggaaataataaagtgaaattgctatgggagcgtgtagagtaatccatcttcttttaaacccactctatgccagtaacagtgtggcagatggggtgcgagttcagggatataaatccatgccaagctaacttcatctaatggctttaaatttttaaatttacctttaggtaaaaattgggtacaaacagtttcagttttttccttttgtctcatccaaatgacagccagtttaaatacctgtgacattccttacagcagacaattctgtcaccattccatgtttcattttttttacttactgtgtaatgctctctgggactgcatatggatttgcaggggttttcaacctcacatatactgctgtaccttacacatgcataaacagtgcagtttgaaaggtgcttttttcagaagcttttgaaccagagtgactccatcttgaataggggctgggtaaaataagactgagacctactgggctgggctgcattcccgaaaggttagatgttcttagtaacatatgagataggaggtccacataagatacaggtcacaaagaccttgctgataaaacagaatgcaataaagaatctggccaacaggcgcggtggctcaggcctataatcccagcactttgggaggctgtggcgggaagaaaccccaactctactaaaaatacaaaaattagctgtgcgtggtggcatgcgtctgtagtcccagctatttgggaggctgaggcaggagaatcgcttgaacccgggaggcagtggttgcagtgagccaagatcgcgcccatgcactccagcctgggcgacagggagagactccgtgtcaaaaaaaaaaaaaaaaaaaaaaaggaatctggccaccaaaaccaagatggcaatgaaagtcacctctggtcatgctcactgctcactatatgctaattataatttattagcttgctaaaagacactcccaccagtgccatgacagtttacaaatgccatgtcaacgtcaggatcagaaagttaccctatatggcttaaaaaggggaggaaccctcagttctgggaatttcccactcattttctggaaaactcatgaataatccaccccttgtttagcatataataaagaaaaaactataagtatactcagttcagcagtccatgacgctgttctgcctataaagtaggcatttgtttgtttctttacttctctaataaacttgccttcactttactctatggacttgccccaagttctttcttgcacaaggttcaagaaccctctcttgggttccggttcagggcccctttctcgtaacactttcacatctcttactccatttgatccttgttgcaacccttcacaataggtagggtggttattattatccctacctgacagatgaacaaactacccttctgaaaagtttagttacctgcccagggtaatacaagcaatacaagaataataatgccagcacttcagcgtttgactcccaggctaattcttttctgatgcaccacactctctcctatttttactaaaacccttctcaatgacaggagtagaatagatagaggagtttagaaatgactgttctggaaattaaaagagactgataaatagggaacaagtagcagaacttatgtaaagctgttattttttcccgaatagtgtatagaacaattagactttctttcccaaaataacttttcttatttgaaagacaggtttttttcttatttcaaaacaaacgaacatttattttgggtggggaagacccagtggtataaagggcaaatataaaagaacagctctttcctataatacgtctctttaatgtaggtgaaaaattggcaccggctctcaacttagatataaacaggataaaaaaggttatagccaccagtggttttctgtgtagcttgaaaggacaaagtagtataaagcacacacaaaaaaacttacagacattgccaaagagctttcaaaatattatgagcttcctggagtcaaatcacactcttgtttttccttaagtatctgaacatttctgtatttttttttccaaaaaagaattccttctgtgctcgaaagatggaatattattaataccaataaggtcatcacatccagttgctatagtgtaatttcctagtgcatgtctccaaacactttgttcttccaacataagctattcttaaggagaaatggagatacttaaaagcagggatccctcctccaggtcagggaagtgttaggaacttttcctaaaggctaaggaaattaagggctttgagagctgaatgagcctgcaagtagccagtttgcaccagccgatgactgattgataggccaacccccaatcacccaaccaagtactagattttccagagcctattctacatacctataaatgcaaatgttctgcagaatatatataaaggacacacagcaattaaagttgttagctgtattgtttgaggagaacttcaggggctaagaagacagaaccaatatatagatgctatgcaaggcattggggagagaagagcatatagaaagtaaagtggaaatatccagttcctttgcaactaccagaagtggaattttcaatgttatacaatgtagtagaaaagtagaagcttgattaagattttttatggaatagaaagtgttttattttatgatatttccccccaagattaaaataaatgttagcttttcactgtagacattcagaagtaatcctttcaaatattttggcaaatacagatggcagtatttaaatactgccgtagacctgggttcaaattctgtttctattgctttgtgctacgtgacaaatgaataactcacttaagccttccaagtctccattatctcatctgtaaaatgggggcactaataattcactgatctaattgttgtgaggattcagagaccgtatgtgtaaaataaatactaaaattgaatttctgactgaagtgccaacacagtcaatatcagacaatgtgagaatgagacagacatccagattcaaaatttatcaaggaacaggtgaaatactggttctaaggcccttgaacccctcagctacattaaggaaataataaaaataaaatggatcagaaatgggaaggaaaggtgtctgagaatattttttgaagtagctcgtactatgcagtgagtttgtgctcctacattctagctccaagcctagcaaggcagctctcagaggagggtctcctggagtgcttgctttgcgttcccgaccactggaggatgcagaactggcacccgacacgctgagaaaactttaaagaggtcaagatggaatggaacggaaatgagagcattgggaatggggtacacttccaaggttgaggggacaaaggatccatggaaactcctcgtgggccgagataggccccaagtgcatgacagcaagctgggcaggactgcctagagacaggtcagcccatgtggtaagagtctgtgaggagggagcagaagcatccccctacacagggattaaggttggaagttctagcagaaaagccttggatgaacccaagaatgcaccaggagaggaggaattcgagggatctgccagaccaagagtcccaacatcagttgatgtgccttgtcaaaaagctgtcgaaagataattgcaggaaaaggcagtagccgaacttgccctttgccctactgccagtgactgaccaaagcagagggcagcctcaattctgagctttgattagtaactcagattggtggtttgtaattttaatgaatgttatgttttataatataaaattattatataattaccttaacagtgaacccaaacatttactctaaatcagtacgtggtacaaaaccttaacacaatacattttaaagtgatcggttgcggtaaaaccaaaaaatgatattatagcttgaccacattaggacatcatacttatttaatgtaatgctttcacacataagcccttaacatgatgcatgacatataggcatgcataaatgacataattgataataacgaggatgatggtgacaataacgaaggtaatttattatatctttgaacagagaatacagacagacccaagccataagatagtttttctcacgaaaacactcagttttctacaataccactctattgatgtgcatgattcacacatgtcgcagccaaaagacatttaatgtcattttggatatcattttgggaaactgagttcattgggtttcacaaaaaatatcgggaactacacatgttaaatttttaactgtcaaagggctgttgtgttagagaaagaatggtacactagtacaggcccttatagtgtttgaattctttttacagtcccagaactctaaggggaagccagtggtgagaggcctaaggagtctgtgtattgtgggtaggggagtgtgagtggggcatgaggaggggagagggaggagagaacttcccacagacaggttaggaatattgataactaacatcatactagtcaacctctaataaacttgagatggcaaatgggctctgcttgtactagggtagttatgggaaattggcctaaatattgccaacacctgtcagatccaaatgagccttatgagccctcctagtcctttttatgaacccttgagcatcaaagaatacactggcaaaccttgtgtattgttctgggaattaattgagatgagataccatgtgcaaatctttataacagtacatgagatacgacgaacccttagaaatggttacaataatttctatttagtattactatcattattgttctggtgagatgcttaacctccccaagcctcatgttagtttcatcacctgttacatggtgataagaacagcaacttcatcagtttgtcacaaaaattaaagagaaaatatatgtagctgtcttacctaatgcctagtaaaggtagatgaggatgatggtgatgatgatggtgatagtgatataccctgcctaaggaaatacacaaaagaaatggcagagatgctatttcacccaggtctttctgacgtcaaagactgtattattaattataatgctatatgcttcttgtattgtccttacgaacaaccaaaataattaattgcaaaggccaaaaaggggccacttttaagaatggacacagaaaaccacattcatgtgatgtcaatgggggacgctgattgacctaatgtggttcctaaggagcactggaagtaccctctagtgcatgaaaataaagagccacaacagtgctatgtcattaaaaatgcactttcctgtgtggataaagatggcagatttagcttttgagcatttctaccgtgggagcagcaactttgttttaagcccacccaactttcaagtctatttccatgttgacccatggctcaagaggaattgtacagtacccgggatggaagctggctttcttctggcggggactgtgttattactgaaatccaactagatgagacaattgcctgaaaatgatagtgacattcccttttgggaatatagtaaacaactgtaacattgcccagatgtcagcctgggcccctttgtccattacagatctagatgagtctggttaggaccctcgcatctgcacagaaggtaaaaatctaaggtcctccttcttctggcatttcctgtgaattcctgggaacctctgactattgcttggctttgctacctcatgtactccctatgtataaacaaagtctctgtctccacccaaaaacaaatgctgctcactcaagcacttatgagtttcatcatctaaacatttgggtatcacctagcacctagtattctatcaccttgaagaatttaggccctatcctcaccccctactccagagcaaggcaaaccctgtccctgaattcttgcatagcaggttaaaaatcacactttttgagcctttgatatcttcatttataacccaagtagcctatccccatatttctttaaacaaatccagtaaactcatatttgtataatgtgactctgtctcttattccctcaacctggcacagggaggacatctgtcttgatcaaatgtactcttccaagaatttggcactagaactgctaaacttaaacgagtctttcttgggtgtttgagttgatcaggggtgaaaagccaggtctgagaaggccaagtttaccaatgcttgtgaaagcagagaaaactagtgtgcagagcaggagaggaacaagggaatgatccttgggcagcttttgggaggcagctcacagccccagtagagaccaagtgaggctgcaacactggcttattgctaagagctttcctgagtacgccttttatggagcccagcattgatctttctctgttcttgtccgtgggttcctgtaatgctacatcctgtctccctgtccctttccacatcacttgtcagtctgaatggttttatgctactgtactccaaagacttctgtataagtctcccttcagcaaaaggagggaggtctgagagctaggaaaaccctgaagatttaaatcttacttgaatgagagagatattgtcagatatctgccttctcagatggctgacaaagacagctcttgaacaagaagctcgaattctaagaagacaacgcatcaccactcctggcattccctaaagagggacctgcaccaaaggctcatctctggatgacgatgaggtcttgtgagcagtcacctgacctttgagaactcagctctgagcacctgcaggtacttgctgctccaaggcacaaatgtcaccaccttgaagagctcaagccatctaatcaccatcctgctgggacgtggtaaactgtcagcttatcatgaaaggcatctgggcataggattgaactttccagtagcccacacttggcgtggaaaagctgaagaaagctatttctccctgtgcacaacctccttgtggctgttccaagcatggaagccaaggcctgtggctgtcagagttcagctagtgtgctgggtgagaagaaaccagccccagggctttatgcatctgcaaatgggatgggttgggatctttaaagtttcaccaaaagcagagtcaataggtggcactctcgctaccaatctccatcttgggcctgtgactgaacacaccaataatcttcaccaatgaatccacacaaaggtgcagatttcttttcagtgtgttgctgcaggttgtcactagcagtcaattgagattgatatgagcaacgcaacttctatcttctgagctatggtaaagaaatgtgaaactgggatagctgtgcaggtcaacctcccctgagcagatttctctcatctgtaaaaggaattggtcacaccagacaatccccaagatcacttatacttcctaagttcacgtgattctaatggtgggaagagagatttcaaataatatagttggagggagttgataaaactaaatatagacaacccatggttaatgtcagaaaaattcagaaacaagtaaaatgggtgaaggaatttttaaaaaatgcttttagtagagaataaagaatttacactctgctgaaatactgtgagctgggccaagaaccacagggaagcagagggaagaactcccaaaccaaatgttggatagcaggtcccagataactgcatgggaagggaatgttttaatcccactctcaacttcccgcctccttaaggtaggattaaaacacactgacaaaggctttacagtacggagaacagattgagacaaattctgcaaaacccggggattcaatggatgtggcagaagagaaacagtttcacatctctgtctgtctttcaagtaactgctctaaaattcttgtgtaaggaaaggagtaacaatatatcaagtcttatttctacatactcagaaacttattgtctttgttctgtaccatggcaattgcctcaaaagtggtgtcttttccctgaacctcggctcatccatcccattgaagccaaaggaataattctaatgagcattgtgaactctcctctgcttctcaaaaccctttaatttcacctttcccatcttctggcatggcgttcagggcccttcaaaatgagaaaattaccctgctcttttgtcaggggttacagacggccttccaacccatagtctccttctcttccctttcaagttcaaaaagctacctctgtgtaattgtgtaattggactaaagaagtgagcctagccagtagcagcaggggaaaagcttatgaagttatagcctagacccaggtccacacactgtattaaaccctgtactggggggaattggaaagtgagatgaagcagtgaatggacagaagtggaaacatacacaggaataaaagccataggtgtaagccacgagacagaagaagccaagattggaagaagccagcaggcagagaggagccatctcacagcagtgccagcagacagaatagagcgagggtggctgcactgctgtcacggtggggcaatggattagggagcagtgaacatgtgtatccgagggaaaaaccaagaggatggctcttgagatcccagtatgactccaagaacaaagttcttatactctgtgaggcctcattgctcaacagctgaaagggtttcttgtctgtcttacttcctactggatccttaaaataatctacaaatggaaatagtgttaataaatctctttcccttatatagactaaaaaaaaaagtaacctcaaacagcaacaacaagaaactaataaagatggcctaaccacaggacagcaggaccttccctccacttccggtgccatatcctgctctaacgttaagctcaacatcactcttccctgaatattttctatttaaacaaagtatctgggcaagacaagtgggctgtcagatgtcctgtgggctgaatgtacaaagcctgggcatgtttaaatgtgattatgactttgaatagaatctggtttactgaatgacagcagtaaagatttgtcaagtagcaacatgaaaaggtataaaatggaggggatatgtgttatattcaggattggagagggcagggagctgagtaatagcaactggtcagagatcaagaagaaaagagcaagaatactatttatcttcaaactttgcttagaggttgagtatatttgaaaagaaagtccctgttgagttgtttctgattagggacatttaagtggcttcgtagcaggatgaacaatagcaggcagttgccttcagggtgagatttaaggaggaatactaggaaggttgaggaggagataaatgggtgatgatcctggtaagaaggaaaaggggcaagatcagaagacaatgaagacaatgccagagctcaaaatccttgaaggagttttgggtttgagagggagaacagaggaggaagaaaggacaaagtactgcctgggctgacctagatgtggcccataaataaatcactgtactcagttttatgtagttttgctaggtggccacctgagggcactctatgctacacagctaggaatctttaattttccccctatcaagtaaactatatatatcctcaatttgctgaaggataaacttagctaatgctttaaagaagggtactcattgaaggtgggggccaaaagcaattcttcctccctattttttccctcaactagattaataaatgagcaagactgacctcaatttaaatccctgggtaattgcaaggattaaatacagtaacttcagttaaatctatttagcatttagtaggcacttaataaatattagctccctcccatatatatgcacatcctaacatacaaatttgccaaatacaggaacaagagaaggaacacaaggaggaatcgcaccaaccatttatctctctaaagaaggcagggctcagaagtcctaaaatgaatacaaagctaggctaggaaatcattccagagagcaaatttctgctgctcctttcattgcatgttgctgcttgtacataataaccagagggaatagaacacaaacagctgggaaataaagatgaaagcaaaactgtatcagcaggaagagacacacaaccccctgagaatcgagcggtgtcatgagagataagctgaacaaggccagctgcatggaatttatcttctgagagaaagatcattagattcctacccatttctgatcgtttctattggagtcaaggtggagaatgaaatacatgagccccagttttcaaagttctacactaaagtcctgttcctataatgaaacagagccacggacaaaagaatgcatcactataaaagccaactgtggaattttagatgtctgaaaacaaaagaaattctacttccccttgcaaacggagcaggttgaggtttccccaactcccgggtcctatgcagcatgttttgtggccttctgctgccctctagtgtctttttaaggtatggtaaaacataaggaggataaaaaaaattctcctaataatcctaaccagccaacaatgtgacttcagcccagggctggtaaaacaaacaaaaaaacagtaacattctgaaataaaagcaaaaccaggatttatacaaaaatttaaaagtgagttaaatttggcctcaacatagatcttgcattatttcaggactctgaaataatggcatctctatcagtcaatgcactttaaaaagaaagatgcctgttttctgtgcatctctctcaaatgattactgccttggttggtctgagataggatccagaaatatgaacttcgcaaacaccacaacatgattctcaagtagctaaagttggctgaccttcttttgagaagcaccaaagatggctgcaatgactctcagcaggatggagagtaaatctgatgttttctttaattctttaagaatacaatctattgaccaaaacaggtcaactttcatttttcctgcagctcagtgctacatgattagtatgcaaagaaaatactgctgtccatgtctgagcgaagagttcatgtagaagttctcctttatgaataagtccctctaaattccagcaggcatccaggtggaaaaaagaaaaaaatgcctcgttgctcttgctcacccttcaaatatccctcaaacattactgctgcaaaaaagccttccaggtggtcccagcttggtttcaatgccccactacagctccacagcacctaaaagtgctgtccttctctgtcctataagtgctccctcaacgccagtgttctcatagagacggagagctttgcattgcagaaaccctgttgtcctctttccaaagtcaatgctccataaatactcatgctctggccaatgcccacagccacccttacccaaagtggtgatgatgggagacaagacacatcaggccccacagcaggctgttctcaaactccctctagctgatggtgcacatgataagaggcaccgtgggatgactgttgccatcggatcacatacccaatttgttagctcaaacttggactaattttagaaacttgctcttacttttctgcaatgcagaaggtattattctatactaatgattagccccttcacatgggaaattcacaaacaattttaattgtgctttttaaaaaaacacaagtacactgagagttcattactatatatcttaatactatgtaatatgccatttttaagttcatacttacagtgttttttctttattatgggcaaagcctgttttatcttcagagttatccatcacttaatgctttaataaaaataaactctgaagtacttaggtgtgtaagtacccccaccagaaagaatcctagtctacaatctcctattaccttcacttccatttgttaatgaaaaataagcagatatttacttctcaggagacagtgtcctaactatctgaagaaatacaatccattgtctcacacggcttctctggaccctcaatgtgtagggctgtacatgccacatacttcaaccaattataaactgctttttttttagccattttaatttccaacagagtatccctaatttccagtgaagttcacttatacttactgacgtctcacctacacaaacagggcactttttgctttagctttggtgactcgatcagcacactggattttacaatctctccctttcttttgacaattaccacctgagcccactgtgcaaaacagggggccatgaaaaatacagaagaaaaagctcttcaatcagagggaataaagagaaagaggtttggcctgtaagaagcagttctttgaatttcattttattttttgagccaagctattagatttgtgggtacaaataagatctctttgaagttagcaagaagcccactgtgaaagaagggagacggccattaccacacattttatatgttgagcaaataaagtcccaggattcaaaatatattctgcaattacagaaagcaaaacacttttctttctcctttcaccttgtttagaaagagcatttttctctagaaagagttctgttgaggctgggtgcagtggctcacacctgtaatcctagcattttgggaggctgaggcaggcggatcacctgaggtcaggagttcaagagcagcctgaccaacacggcaaaaacctgtctctactaaaacacaaaattagccgggcgtggtggcgggtgcctgtaatcccagctacttgggaggctgaggcaggagaattgcttgaacctaagaggcagagactgaagtgagccgagatcgtgccactgcactccagcctgggtgacggagcaagactctgtctccaaaaaaaaaaaaaaaaagagagttaaattttctctttccagtttcctaactcccctcctccgattttctacattgagaataacaggctaataatactttctggaatgcctgttgtagtgttaaattagatgggatacacacatatattcttagtgaatcacaaaatgtgattcaaatagaaacttcagtcatttctcttctattattgacatgttttctcagcattttgtcacgtgcatttgagaaatgaagtatcaataaggaagagaagcgtatgttaagactttcttagcagctggtgaaagaagcattccgtgtgtgtgtgtgtgtgtgtgtgtgtgtgtgtgtggtgtgtgtgtgtgtgtgtgtgtgtgtgtgtgtgtgtgtgttgggatgggggatagaattcactgttggagacacagggtttctaagccaggctcaaactcctgttggtcagggacttaggatccaggaaaccttaccaaggaaagaaaactaataagctctataataagctcctatatatctggttccctgactccaaatcaattgaaaactgttgggacttaagtaacttacaaatgcctttttaatatcaagaccaatattatatttttctcactttttacattttaatcatgcatgcttccttaggtgctgcattttttgagctgttattaaaaatacataggttcctaccacattaaaggggagcagaggcttgtgtgttgtattgttaattatgtgctgaaaatgaaattctggtcagtctttgcagaaggtacaaacacacccctaagcaaaggattttccatgtgaagggagaccgtgtggtgcaaggctcgttgctctgacttaacatgcacttactcttgaggtctaagttcctggctccggcggtgatttgcgttgtgatttttgtgtcaatctttacagtgtggaggttgctggtgtcccttgatatcatcacgttgtgccactgattgtcattgagaggtttatttgagcttcctttgatgaggttagcaccatttcccaaatcaaacacgtaatgtaagtacctgggaaaaaaatgaaagaggggaaagtgccatcactttttaaattttgatgaacctaaagtagatattacaaatggagattttttttcaggtggttccatccttactagaagtcatgacaataagttacatagaaactcagctatcaagaaggtaacaaacactattctgtttcagcaaagaggattattcagtgttttaactaaaggaaacagtgaaaattatttttaaaatcatggtctacatttaactttatgaatttggaaagcaatatctttcaccacgcgctccctgtttccacaattccctccatccttttctaacacttaaaatggccattcttctcgttcttgcacttgcttttctcctctatctcgattccctgtttgaggatagggaacgtgtactcatccttcaacatccaggtcagatagccactccctgctccacatgtttttctaatttacctgaagagtctcctgagcctttgaatgtgatcacctcaagaaacatgtcacagtgcttttcttttcttttctgtttatgtgttcatctacaaaccctaggattgtatgttggtgtgtgtgggtatgactcacagtggtagaaatctgagatgtgcatacgggtggcagaagtatatatatttatatccgtgcatggcacctgatgtagcatattgtaaatatacaccaatatttgcagaatgagtgaataaatgctgaaatcaattaaaatacattaaattttcctcacagttttaaggcacgtttacacaaatcttcctttctaaattctctaaggcactctgacatagaatgaagtttgagttaaaagggtttttttgaaatttaaacaatctgagtacttgaattagctatttaatttagcatagactatcctacaaacctgtatcaatgcttttgtggaattacattgtgcatagtcaggaaatgcccatttgaattgtaacattcatgaaatgcctaccataaattagagcccaatgtaatttgtatctcatatgtgaaaatgtaggtgcaaaaaactgtcctaaatccatattaatttaagatacctaagagatgatttaaacaaatgccttcttatttgtcctccacctgctccggcccaccaccttatgagccagtatgttcttcttagtgtatatttttggaaattgacgtccatttttccaaagttttatttatttgctattgaacaggcatgtactcaccctttaactaattcaaccacaataaagtcatttccatccccactgttatatagaattaatccatctagggatgttgtcttgaactggaaaaaaagatgcatagaagtgtaggcttgcaaggtagctaaggcaacatagctcgatttggtcttgaaggtgacaggatctgctatgatgttcctgaagccaaatctggcattaagctcacagtaatctatgtcgccatttttacacaggtcaatgtatgccattccattaaatgtcaagctctgcaggtgtccaatgaagttggaggggacagaagaaagataccgtcgttctgtgatgatgccagtctctatgttatggaactccagcctagtatgatcacctgccatttgacctaaaagagaagataatatatgattattttctgtatctgaaaggcactttcaactttaggctttcataacaatatcacattctaaaatacaaggagccaaatccctccttggtactcagttgcatataggaagaacacttaaatgatgccaaaaggtaagcctagattatataataaaacattcttaggccaggttataatccctgtccaaattttagtcttaacaaaaaatatcctcattaacaaaagtaatggtatcttttaaaggcgaaaaataaacaaattagcaagagagtgagcacatagtaaaagaaggagagggaggaaaaaaggaaagaagggagagtgcacagagagacgcattaggagcagtgactattctcagtcacccaactagaaagtgatacatctcagcctcatggataggtgatgttattccttataaatgttcttccaggaaaaaaaaatgtgactatatattttcctatacccagtagaaagagtggagagttgcagccctttcttccagtaatgaaacatgaaagtgtgtttgaagttaaatatacactattcactttccctcttcgtgctcaataatgaccatagtttttgttcatgctagtcttctaaatacattagaaatcctgttgatttcttcacctatgcctttttttgtccttaagttttctataactaaatcaagcaaaatacactaattgaaagcttgcccaattttgataataccagtaaaattggcccaccatgccccataccacaaggcaaaaatcttctttaaacatcctagggtgaagcttggatgcaaatttatttagcaactgactattccactcagtcctcatttctctctatccctgcatatttccctgtcaaacccattaatagcaaacttagtcccatctttatctccagagtgatcattttacctgtttgcaaggttgaaggtaagataaataagcaaagatgtgaacttgttttctaaatattaaaacacaacataaatataaggtacttgtatcagtaccagtgattcacacccaacatcttgctcttgtctaaataaactgtcagtcactctcttctgcaactaaaaatgctcatttattttgtaatcaagttcttccacgtgctagcttccctgcccgatttgccataattggaaaatgtttcaagttacctctttccatcatccacattattaatgaaaatattaattagagctaatcccagaatcagcccctgagaaaatgcattgaaccttttccccaggggtaatgaagactgaacaaccacctatgtgtgtcccctttggccagtttgacaaatttccatttctttagtcaagacagtaaaatattagacagtgtttaaggaaatatctgtaagtaaaatttagacgtcatgctttttgttgtgcaacaaaaactgtttatatgtttgcttaagtgactttgatgattatacatatatttgtacacaaaactcccctgaactgtacttaaccctatttcattttcaaacactcttttttagtcttgatcctggaaacaacattctactcatccttggcatgttctcttttcagccattggtttgttctgattcccttcctgcaaacatttttaaaacaaaaatgtcaccataaataattgtttcgtctctctctaccctcactaccatgcctcctgattgtctatctgatgcaaaagtactattacatccttgtcaattctggtttctcctgtgacatcatttctatcttctcccccagttcttcttgttcaatgacctcaatattgttctgtggggatctacttctttggtaaaaaataaaattaatccttaattatttccaaatataaagctctaaagacaccagcaacattgaattaagaagctaagtacaatgaagaatatgagaagcttaaaaatcgtctagatgcggtggctcacgcctgtaatcccagcattttgggaggcctaggggggcagatcacctgaggtcaggagtttgagaccagcctggccaacatggtgaaactctgtctctactaaaaatacaaaaattaactgggcgtggtggtgggcgcctgtaatcccagctactcgggaggctgaggcaggagaatcgcttgaacctgggaggcggaggttgcagtgagctgagattgcaccattgccctccagcctgggcaacagagcaagactccatctcaaaaaaaaaaaaaaaaaaagtcatatgggctttgatatccctttgggttgatttttattctatgccacattaaaatatgagccttaactcagtgacccctaccctgatcctgaaactgtcatgtttcatcttaaagtctctattgatgaaacaaccaatagtaaaaaaattctgaaaaaaatatttctaacacttgaaattaaatattacctccagttgtcaagttcttaccagctctaaaagaggaaagaccagttaattccagactaaggagttcagtaataaaaataagacagtatatctgttttcctctctcaaaggaatagaatatgcacacagagcataaataataaaaaggtagtacaacagcattgaagcaactatggcccagttacaagataaaaaaaaaatataattacagtgatggtagatatatttgttcactggggagaattagcccccaaaagccattatttgatgactaagaaaatattaactgattgttgccttctttaaaaaattattttttctcagaattttactccaatgtttaatcctcatcagtaatacagccacttctactactgtagatatttgttgattaaataagaaaaaattataagacttcgaaggggaaagatttttaatgttctaatgatttaaaaatgcaccatccaaggaaaatttggaataagcaaaatgcctctgatcacaatatttaaggtataacagattgacaataatctccaacaagacaacaaccaaaacatgtttcctagatgctgtgtttgtatagaaatctcaatatttccaagtcaaatatttttaccaaaatagatagcaaggttaatatgtgctctgcgttaggttacatttctcatgtcgagcaaaataaccctcccttacatccacttgttaattcacttaaaattgctgattgtgtggtatatgtgtccggtgctagccttggtattggagaaatagtgttgagaggggcagaaagggcccattttctccaaactcatggtctacgggagaaaggcagacaaaagaggttaaggttgtaattaaatctataataacaaaactcagagaaatgttatgaatttgatgaacgaggtattgtgttggtaaatgtgaaatggaagaagatgccaggtttgatatttaagctagatttgaagaattaaaaagagaaagccctgttaagaattggagaaagggaatcaagggtggattccaggaaggggagacggatgaaggaaggcttttggataacaaacagctacagagcatggctggagagctgggaacaagtaggttagtgacccacatgggattgaaaggagcgggagcgccagggtccagatttctcatagtgcttcttacattcagagctaaggaggatttgaagcaggggttaaccatgactcgtgtatgtgtgtgtgtgtgagtgtgtgtgtgtgtgtgtgtgtgtgtttattccctttgtgggtgcaagagattggagagtgaactagggcagttatagtagaaatgaaaatcatcaacaaaaagataatttcacagatataatttccaggatttactaatgatgagcagaatgaaggaagggaatgatgatgcctggctttcaggcttgggtaactggatatatggtgaatgttgttccataaaggacatacacacacagattaaaaaaaaaaaacacaattctagatttttacacagactggatgatgaattgaagcccagtgacttcccacttagggattccacaaaatttgtacaaccccttgtcatctatgacctaggaaatctccttccttgggcttctctgctggcaaatactatcctcacgatcctaggtgaggtgcaaacattcccaagaacagcttgagtatgtactgccctgtgttcaacagataactgacttaatagaattacgataaaacttaaagatatgggaaaatgtaggactttgcatgaagagtctctagtaccttccttgcagaaattcttctcattcagtgatttctgacttgctgtaaaatttaataagaaactcccattgcttctctgatttatgggtggcttcaagtggccactaggatatttgaaggaaatctcaatctaaagctttcattgccacatttggaagccttttatgtactacgtaaatcaagactgaattattcttatgaattgttggctttcatgagatctctgacaaaatagaagaagaaggaaggaagaaaggaagaaagaaaggaaagaaggaaggaaggaaggaaggaaggagggaaaaaataaacaatttacccaaggtatttaaaaaataactcagcatttgatgttaagtcttaggaaggaagaaatgagacaaacagtcgtaaagtaatcctgacttatttgttgccttcaactaagaaggcagaactactataactgccctagttcactctacaatctcttgcacccacaaagggaataaatacacacacacacgcatacccacacacactcagacacacaaacacacacacacacgagtcatggttaacccctgcttcaaatcctccttagctctgaatataagaagtggtacgggaaaagcaattttgaaactattttagatgcattattggattaagcaaatcaataaatgacattactgggagccaggattctcatcttggatgaaaacatatgaaagtatggaatgggaaaaataacgaaacaatgttgtaggtatgaaggtagcagtgtaaactcacactttataaaatgtgcattatgtgtatgtttatatgtacatataatgtatatgtctgtgtgtagatacatttacatgtatgtttgggtgtaggtatatatacttgaatacatttcttatctctgtctgctgaaggggtcaagtagcaatgataccccagcagcactgaggtcacctaccacccaaatcttggtctgtatcattcctcactaaatggaaattaaatggctaattctaggggcgaagtgtggtagacaaaagttgtacctggaacatcctgttattccgagaagtaagaaaagggccaggcacggtggctcatgtctgtaatcccggtactttgggaggccaatatgggtggatcacctgaggtcaagaattcaagacaagcctggccaacatggtgaaacctcatctctactaaaactacaaaaattagctgggcatgatagcatgtgcctgtaatcccagctacttgggaagctgagacaggagaatcacttgaatgtaggaggcggaggctgcagtgagctgagatcactccactgcactctaacctgggtgacagaatgagactccatctcaaaaaaacaaaaaaaaaaagaaagaaagaaaaaaataagaaagcgctaaaaaaataattggaatgaaggcatgtcatgagatcatagaggccaagttaatgaaactcacactggcaaaaattgaaaaacatttgcgcaccaaaatcataagatagcgtaattatgaagtattataaaaacatagcaatagtgggtctacaacaataagaaaaaaaggaagggaggaagaaagaaaaaaagagaaatgaaaagaaagaaaaattaaaaaaaaaataggaaagaagggagagagaaggaagagcccttgcttacagcagaatgctaagcattgactgtaaatgtggaaggagtgctggagtttgaaaataatcattttttgtaactctcagagtaaagattgaatcaagcaaaactctgcaatagatactaaatctagggcaaaattttgatgagttacaggatatttacatggtcttaatgtctccccacagacagtttattagttgaaagggagaaaacgtagtaattatacaatggagaaactggacaacatgttgaccaagtggtcaaattaaatcaccaaagacatgggcagcgtatgccccagatgggatactgtatagaggccataacatcaacaacgcggtatttcacccaagaatgtaaaatatacattcagtcatgaggaaatatcagataagcacaaactggtgactttatattaatacaaagcaggaagagattatatacttcaacaatgttaatgtgatgaaaaacaaataaagtttatggaaatgttctagattaaaggaggctaaagaaacatgacaactaaaaaaaaaaaaaaaaaaaaatagctggccctagactgcgcactgtgctggaggggaaaaatgcttattgcgtattgataacattgaatcaactgacaaagctggaatatggattacagattagaaaaataaattgttatctatgcaaactttactgaagtcagtggcttttatttcttaggcaaggggatattcccatttttaaaaaatacatgctgaagtatttcgggttaaagggacactgtgtatgtaacttaccctcaactggctaagagaaaagttagagagagaagagacagtgagagagcacaaatgtcaagacaaactggcttaaatgttcacagtagtaaaggtataagggtattctttgtattatttttggaactttttataaatttgaaattattttgaaataactttctaaaatacatttcttaaaaaaaatgtttttcaccattcttttgttttcatcctgctacatccaccgcagtacaggacttattactttacaccctagaccatccaaaacactgccacagaattaatttcgctcaaaacatattttctccacttactcttcagtttaagtgcagtgacttccaatttcctgaaagtctacgaaatataaactacttcatctagaccatcaagtcattggcctcaaaaggccattctagcaccatgcacttgcaagaagcaaaataaagcttcttagttccctgaaaattattctagccccaccagcatcattctttcttgtctggaattctttcttgcattatcctttctttaaagcctagatcaaacattatcaattgctttaaacaatacccaaaaccaagttccttaacttctcttctgaactccaagactataaagtactcaagtcaaccattcagtagttcatctgttactctatgtaacatatcaccctctataataatctgtgttttatatgtatgtatgtatttgccttataatatcatgcattgtctgataaaatactttctatagagccatacacttactagatattgacaaatataaagcaagggacggtaagtcaaaaaccaacaaaccaaaacacacaaaacaaaaaaataaacgtaggttctctcctcagatctcgtaacacattccaataaaacataattcacttatcctcttcgagtgccacttacctcatctacaaaatgggaatatgtgtgtcctatctacttcataggactctaatattcaagaggcactcagagattttaaaatgttctgttgtagttctggcatgatcttgccgttggcagctgcctcttcccaaactcttacatgtgaccttagatactaactgttcatttccatgccttttgataaaacccagttgtccaaactgtggatgctgatctaagaaacaattcattcctcttcaaagaactgtcctagaccaaaactaattgaactccaatgatactcttctgccctgtaaattttttttaccttcctttcctaagttaaggaacgattgtttcaaaagtttaaaatcctgtaggtaatatatccacattgacacagttgactgttctctgggcatggggacctccttcgaattgaatgaacagacacgtatccactgtacaaggaccattttgtgctttttaccagaataattaacatggctatctctctgaaaaaagaaaaagcagctaatatcccagtgggtcacgtgcttggagttgttttcaaagtaaataaaggcaaaaggatttttcttccatgaggctttcctatgtttctagggtggacctgcatacagctcacctcaggaatctaaaaatgggggttgaacttgacatccttaatattagaatttaaccaactgagctgagtggccaaaaataatctattatagcttaaaatgaaaaagtgtttcatctgaaagccagatagataaacgccagtatatctatcatcttacctagaagttaaaaggtaaaacttgcagttgttcattgccaaaatatatacaaaacaaagaaactcaacagaaattggcatctaaacatgactgcaatatttgatgaggcaccaagatatttatcaggccacaaaagaaaatatattataatttcttcttgcactattaaagggccaagaatatgacataaaatgtgtcatttttgaggaaaaacacctaacagactgcttatttaataaaatagttactagaaaaaaatagaataaaaatggattgtgtgaatacatttcaagttgtgtaccagccttggtgtgcaaaaccacctgcaagaaatgagagtcaaaagcgttagcataggaaaagacaatgggacagaggtgtttacctgtcatggcctgttggtcatccactgttaactttaaactttttccacgccgaactacacgcactgtgtgccactcgttatcattgaggttatagccagcaaaaagagtctcgggacctttgcctgtagaatatgccaaacagtcattatggacactcagaatcagtcaagcaaatgaacctcacagagagtgagagaaagagacaaggggggaaggtgagggagagagaggagagaaagaagaaaggaagaaagagagagaggagggagagaaaggaaacagagaagaggcgggctggaccaattttcaagcccattagagtcatagcaagcaaggaaaatgacaacttttacaaacattcaggtgtgaccatttaagaatctttaatcctacgcattgatccataacaagtgaattaacctgctgtcataaataggcacagtcaatacagcactgggaacccacccaaatttacacacacatttttaaaaataaattctctgatttttagttaccactttcctgctaacaaagtgtctagccatcatgtaacctctgagctctagaagacatctgactgtagcccattagctaatcgttttcagtgagataagtctcccagtagactctgggagaaggtactatcttgtgtgatggcggctattccgctcttatacctggtacctccagtgctcaacacgttcttaggttctttagcctcctaaatttatggaatgttgagtctaaaaaacacatcgaaataaaccttacaactaattgacctgtacgtcacaaatctgtctgtgtgtggcagaggcacttctggcaggtgtaggtataagtattgactcacagtaagtggaccgaagaaaaggaaagaaaaaaaaaaaataggcacagccaataaagggccaactgttgagcatgaaggaaaagtagtgatattaaacaacagtagagagcaagggattaccagtgggcatcgagtgggcaagaagtataactgggaaagtaactgctagtgaatctatataaacctatgcaaatgaaatttaaatggactcagcagagacatattatttcagaaaggtgtttggtagaaattattgaaatgattaagttagactatatccgtcacctcaaaaaaaaaaaaaaaaaaaagcaagggaaaatgcttttaacataaccagatatttttatttaaaaaataagtatttctactaatctgacattatgagtcattgagaaaaaataacattaaagatacattgtttggtaatgaattttttccctggtgtttttttaagtatggaaacatgctggtacattaaaataatgaagggcattatatcattgagtttcatgtctttcaacgaattgagaatcaggattggagttcacaatttgtttaaccaaattctgccagcaaaaccaattaatgcccaaggatcacgggaggatatatgagaaagtaaagatacaggccaaggagaagaagaaaaaaaaagaggagagcaagagagatcgagtaagagacagagaaccaagtaaaataaacctcagttttccatccacatgagatcattgttttctttcagaactacaccctatccaccagcctattgatttctctcttatggtgctactaataattcaagtgttgtatccttggctggtgtatctcaggttagaaatgagccagtgatatgagctaaattttaaaggatgaattgcctcagttatttatatctgtttgtatctttagagaaattaaattacaactccagatacatgaatttaaaactattctagatataacagttttaagagattgatggctaaataactagagaaagcctgctagtccagcaactgcaaaaatactttgagatcaaatgttgaaagcaagttccaggatgaaaaaaaaaaaactctttctaaattcaatagtgaagaaagaagtgtttaataactctgcagcatcttagcatcctgctggcagtaagggtcatctttcattttgatccttgaaaagagaacatatcattttagagctatttttatagggaactttttttttttgttagaaatatgtgcttttgaagcagcttcacttctattcttttcttttttaaatatattttgtcaaggaaaggaagcatacataagggtgatatcatcgttataccccatccttggcttgatcttgcagtaaagtcataatgcttaatctatgcaacaactatttccataacaacaggcataaaatccaattaaaaataaccctttggttcataaaaatctctgtgcgccaacttctagctcctttcatgcattattaaaattgtgaacagattgattttagaagataaggtttttaaaaaggcacttaatagtctcacttcaacacaatgttacccatgcaacatgaagtgtaatggaaagtgcactagactgggagttaagaattgcagttgctagatcatgatttcctactaaaaaagaagttgggggttgctgagtgcttattatgtagcaggcactttgtctgttgtcttgcttcacctttacattattaatctgcagatgtgaaactgaaggcctataaagctacaactacttgtcgccaggtcacacagctaaaaagtggtagaaccaagtttcatccttggcctgacctactcaaagcctgcatgcttttccctgcattattcagcctcgtagttatgagaatctttggctaacaacttaatttctcactttccccatattggaacaaaggagatggaaaagatcctctttgtggtgactcccagcttgccctacagaatgatcacactgctagcaaatcctacacaccctctgcacaagtcctggtggaagcaaatctctaagtaatacaatgtctatctagggatgctgaaatgactgttcctaaagatatgacacagaagaagggacatcattttaggacctgtctccacccacaatcagcaatttgctaacacactcaacttctggtggtctcagcattcccatccataaagtgaggagagtttccagctgatctttacagttcctttagaatttcactttctcacagaatttaacatatacaaacttgttaaagaaagatggtttaactgttgaaattttgaatttgagagtttgtcctcttgctataattttaatggcaaaattatagtaacttcaagctgttaatgacctttcaggatttcctttcctttgggggatatcaaaccatgcatcagttgtgccaacgtctttctccctgcatcaatgtattacagacttaatgtgtgtgtccctcagaattcactatgttgaatttctaacccacaaagtgatggtatgagaaggtggggccttcaagatatgattaggtttagataagggtggagtcccatgatgggatagggccctcacaagaagtggaacaaacaccagagcgtcccctctgccatgtgaggatacaaagagaaggtggctgcctaccagccaggaagaaggccctcaccaagagccaaatctgctgacacttcaatctttgacttcaagccttcaaaaaactgaggtgaaaaaaaaattctgttgtttaagccatccaatctatggtattctgttgtaacagcccaagaagactaacacagtgggcaatattttaaagacttttaagaaagtctatagctggctgggcatggtggctctcgtctgtaatcccagcattttgtgaagttgaggcgggagaatcacgaggtcaggagtttgagaccagcctggccaacagggtgaaaccctctctctactaaaaatacaaaaaatagctgggtgtagtggcaggaacccgtaatcccagctactcaggaggctgaggcaggagaattgcttgaacccaggaggcggaggttgcagtgagccgagatctcgccattgcactccagcctggatgacagagagagactccatctcaaaaaaaaaaaaaaaaaaaaaaaaaaaaccacaaaagaaaagaaagaaagaaaagaaagaccatagccttatgtctattaaaagacatcattccttatgttttgtagggagttttgatttgtttgtaattttacacttgatttttactgtaacatattatttaagccagatatattaatttttcattttatagttaaagaagcagatttaaaagtgttgagcgaattattaagtctcaaaggcagtaagaagtagagagaagactgagattttgaaattttctattttcattaaaatgtgttttccacagaaaatgatctgcaagtagtgtaagaggtacaacgggactgaatgcccccagctaatatttcaccagaccaggtcagaattcagctctacaggctaatgttatattaaagaattttagaactaggagggacatgagaagtgtagaatttcaatcatcatctacaaataagaaacatgaagtgcaaagacattagatgacgtccccattgtcacaactgttaaattaagaagcataggtctctagactctcagtctaacaagcttttttttttttaattattattaagacagaatctcgctctgttgctcaggctagagtgcagtggtgcaatctcggctcactgcaacctctgcctcccaggttcaagtgactctcctgcctcagcctcccagggagctgggattacaggcacccactaccatgcccagctaatttttgtattttaatagacatggagtttcaccatgttcgaggccagtctggtctcgaactcctgatctctgccagccttggcctaccaaagtgctggaattacaggtgcggaccacagtgcgcccagccctaacaaacttttaaaaaattattctgttcattagacaatgctgatttagaatgaatttctcaaggcacaccaaaatctgagtctgagtttaataagtctgtcagtgcttgtcaacagagtttgacctaatctatggtacaacagccaaattttttggctggtgatattcactgggtttgctggtgaccctgtagctaaaacctattgataacagatggaagtagaagcagtaaacatttcagttttccttaattcagtgtaaattgagtgttcttccacaacctacccatccataaattcaaggtgtctctaagattaactcctaagaagggctggagttaaccctaacttgaggcatggtaccgacagaggaaaatgtgtgttagcaagtatatgtgtgtatgtgggtgtgtgtgtgtgagagggatagagagagagacacacactcaaaagatggtagatttttggccattttagtaaccacatttgctaatgacttttacttccattttcacatcaacatgattcttaggtttctttaaatattagtctcagaacaaaggaaatttcatgctataatttgtagttatgggaggtaatggtaaagaaaattggattttgtccccagtctgtcatcaactaattatgttaccttgaagacgacatgtattctctctattcctatttttatctgtaaaatgataatcccatataaaagcatattaaaaaaaaaactttcctacagccaacttcaaactattgtcattcttagaaggaccaaaactacctcgcggctacatgaaagagtgcaatgttatagtgaatatctctaatggtgcaagctttttatttttattattactgttactaatttcatcacttttgttttggcacagtaggcagagagcagaccaagccttaaagaggctcttctacccaagaattactacactcaagtgaagccagaggacaatattaatacgtgctagaaaatgtgtttattattttatatagtcaaattttaatggtgataacttttttcttttgacaacatgtaattatgttacaactatttttgttaatcactataaattttgttaatcactataaattatatttgaaagtactgaagcacagactactaagtgaatgtatttaagaaagaaagaatagcattcaagggatgcatagctatgctacttagtccagctctccttttacagacatctccatgggaggttagttgccttgcctctgtcttccttgttattggcaggatgaaactaatgcctgggtcttgaacttatttaggacctaacatgcattacctaattgtctggccaaagtcagagagggtaaacattctttgacctttgcatatcattcctttccctatttatatttttacatattcaaaaaatattgttctaaatacattttaaacaaacccacctgctttggatagcagaatcagtacaatttacaaagaacctcactgccatacacagtttcggaagcagtgatgaaacgggtgtgttttttcacatacctctttacatttggttcaaatgtagattctcatatatttcaggggagatctgcatgcatcataagaaaagcttgaacttggttgagagttatataaacttggatttgaaagcaggtattgcattttctggttgcttaggcttgggtatgttagcttctttgagctttccttccatcatctataaatgtgagataataatgcctaccttatttcatagatttgttgtaaggactaagggatataacaaatctaatgtgtttggtgctttgcactttgtgtaatctcaatgaatattaatttcctttctctcctttttatggaaaataagttaagtaacagtgcatgagttctgcaaaccaccaaaggatctaccattaaaaaatggttgacagtcaaatacactatacactatataaaaatgtatattgaaagaaacatccacaatttttatttgaacacgcacactgcagtctagttttttgaaattaggcctcccaaagtcaaattttttggaacagttgccattttaacctgagatttcacagtatttgtgtttggttatttaattcctaagcattcaccctgaatataaaaataaatgtaaaatacacttgcaagggaacctgaaatagatcaataacgacatgcttaatcttgctgggttaaaataagatgtacatgatactaaatttggatgctttttgctacaaagccttctgtgcaaatatcttgtgaacaatttatactggtttatgaatgtggagggaaaatatagtgaagagaaatagagaagaataaaacaaagctgagaccctttcaagcaatggaagcaaagacctctaagagacaaaactggcagatgcctctggaactgaaaggtggatgtagctgtacagaaacttgaaaaaaaacaaaaacaaaaacccatagcagttatatttggagttttaaactcttagatgtatgtgccccaagtgtaaactcattgcatctctacacaccctttaggtagctttctccctctagtggtgcatatattttaaagaggttaactacataaatgaactatctttatggtgtaccctgcttctggtatatatatactctggtacagtgcaaaccaattggttctaaagttcactttatttgtctaacatattcattgtaatttctactttaaaattctacctagttatttcagtggttaatctgacttactcaattaaaccatttatcgagcatgaagattttgatgggtatttctgcaaaaccatcacctaacaaattgcacagatgatggacaggcaggaattttttaaaaatactagaatcaccttatatgtataaattggttctatatttatacatgattgttcaatatatttagacctacagcacctggtaattgaattaggaagagaagttacagtaccatagcatctgagaattataaaattttaaaactgaatggtccatattgtgtctgttgtttatcccatttagctactcatttattctgggttccatggcacccatatgctattaattttgtttaaaatttattttgtgccaaataccgatctcagcattgggaatatccgagttacagtcaaaggaacttacattctaataggtcagaagtcaaaacactttttctgtaaagggccagacagtaaatttatttgactttgccgaccatgtgttcaccattgcaactcttcaactttactattgcaatgtaaaagcaagcatagaatgtatgtaaacaaatggagtggctgtgtttcagtaaagcttcattaaaacagggagctagcttgagagctatagtgttcaagaccctgtaagataaacacgtatagataatttaaacgtttcccataaattctgcattgcatattaaagaataacagaaacatactcaagaatttaagtgcgaggaaacctgagttttagattcgatattgccactaactgtaacataaccttaaaaatactaattctcctaacttttttactgctgtttgttttcttaagaaacaactaaaatcaatttttaaaggctttaagcccgggctccccaccccccaggccacagacaggtaccagcctgttaggaagcatgccgcacagcaggaggtgggcagcaggcaagccagagaagcttcatctgtatttacagccgctctccattactcacatcaccatctgagctccacctcatgtcagatcagcagtgacaaccgattctcacaggaatgcaaaccctattgtgaactgcacatgcaagggatctaggtttcatgctccttaggagaatctaatgcctgataatcagtcactgtctcccattaccctcagatgagactctctagttgctggtaaacaacctctagttttactgattctaccttatggtgagatgtataatgatttcattatatattacaatgtaatagtaatagaaataaggtggatgatacatgtagtgaaattcaattatcctgaaatcactcccgtctgtggtaaaattgtcttccatgaaaccagtccctcatgccaaaaagtttggagaccactgctttaaatgacacaaatcaattgcaaagtccttctacttataaaatctaggataaattaggttcctttccttttctgcaaatttagaatagaaacattcattaaatgcttggggtgtgtgtgtgtgtgtgtgtgtgtgtgtgtgtgtgtgtgtgtctgcatgcacctttgttaaaaatttggttattaggtttctacgtatatcaacttttccaggtactaacaagttttatttggcagttgactttggggactgtagtctctggggtgaggcaggaccttgtgagaagctggaagcaagccttgtcattgtgacaatgatgagaagatggaagcaggagctaccactgcttgatgcctgagtcatagttgctggcagcagtacttcctacctacaaatgatgagaggatatgtttcccaggttgtaattatgacaccttcagcctactatttgactttcccattactttctggttttaaagtaatctgtcctccagttaaaaaaattcaaaggagattaactcctcattacaggtttctattttatccttctcaatttttaggtattgagttgtgagtgaaacctgtttgttttaatttttcacaagaatcagctagaacattcaattacaaattaaatttagacatgtaaatggcacttctaaattttcctttttctgcctcttaacattactagaggcaggatgagccacataatttgagagtccattgcaaataaaaatgtggagtccttattcaaaattaagaatttcaagatggtagcagtggagcattaacccaagcacaacacaagctcagcatatggcacggtgtgactgcataagttgtatgctgttgaagccagttctttttaggagtataagttttgtgcttatttatttttgatgcttcctttagtagattctacattcaggaatgagcagacaaggctggaggcaaaattcttcatttatctatgtgagaagcatagttgagtcaccttccccagagtatccacacttaatgacatggtctctggggtatcagagaagctgtctcaggcttgttttgctggccaggcctggtgccaatcatgaactgggcttggtgatacaccaataaccctcagaaccaggaagcaaaactacctgctgacccatgtaactcctttctcttttccttctctattcctcctcaagtgctcctcaatttagccaaggatatacccttgagaactattcagaatgtcccataaagagatgcttgcctccttttttttaataagcaaagagatagagtcctaaggacagacacatttctttatgctaaaaatactagaaatactcatcccagttaaaaagtactttgactaaatgatataaagtcagacattcagcttgatgtttgtttttcaaaaatgaacactaataacagagaaagacattttataaactttaaaaaatccactggagaaattaaatagtcatgtgctgaccaactatattgcatttattttttgacccacacagactgttgagttttatcctggttctacaagttattagctgtgtgaccttgagcaaccttcttactttctgcatgcctcagtatcctcatatatctcataagctaatactagaaacaatgtaaatgggtttcatgcatcttaataactcaaaactacttttaatcaaaggtttaatgcatcttaataacgcaagaagcttaccataatctgatttatggtaagctttcaattatagtagtgataaaagtaactatcatcagtattatgttgtcatttttatcttctcctcaatgagtttaaaatctcagagaaaatatgatatagctcagtgccttgaacataacggcaattcactaagtatttgttgaatgggtttatttgtgtaaactttgtgggacttttttttaaatggtagatgaaataccccttgatattaaattaagccaagtagttgatgaaaagtaactccatcttttaatgcctccattcactaagaaaggtaaatataaagaaaactctgtcctcctgttttcatatttagcaggatggaatttggtaacccctacagttggagaacttgagtaactcagttatctggataactatttggacagctttttcgctcagttacattgaaaataaacttcatgatgcatacagcctagtggaacaaaatgacctaaggttagcagtgaataacttccgagtccaaaggaaatagttggcttagaaattgggggaactcaaaacttactgagtatttaattataaaaaaacacagatcttgtcctcaagtggatgtgaccttggagagttgttggaaacaccctccagagacttttctgccattttcctaaatgatagcaaacttattctattatctacaaaataaatttcagtatttctcgatgcttcacctcctgctctatttcttctggcctataaatatcattgcctatgcaaacgaataaacaaggttaaaatcacctacttcatctactaagaaacattaagcctctgtagttttgtcattgattgtacccatttatgacagacaaggataaatatctcttatgtaaatatatttcaatgcgaaaaacatacattttaagaattataatttactttttaagaagagaattacatttacaacacagtaaaaatgaacacaaattaaataaatatatttctagaaaaaatgttctaaaactagcaatctttaaatctaatctagctcaactggcaagtttaagaagtataataaaataagcctaatacaatgaaagtaacaattcagactgtgattttatttttttcaaaaggtcaattccaagggatgcttatcacataacaggacagctagcagatataaaattgagtactaaatagttcaatttgcttttgagtaagcattaaaaactgaaaatgtattcagtgtttgtgtagtgttaaagaaaagggttatactgatttatagtaatactcatttaatgtattttctgcaatacatacacaatgccaagttgtctgaataaaaaaaaatcaaaaagcatatgggtcctgagcatttggatatttacaaaatgtaaactgatattccataaacgaagccatggattatagtcacaaatgcatttttttaaaattaaatatatcattccatgtctaaatacaccactgtaatagttatagcatttttttaatgaggtcaagaaggatgtacattttttcataattcaagatcaatgaatttaccttttactttccatttcttcttaacataaggatagctgaatattattaagtacatgactgaattcacaaaatttagttcatcctcagtatttttgagatattctagtataaactttttccaaaagtaagaagcatattagagaaaaaaaccctaagtttctgcctttattaagtttatttattttttcttcctttctttttactgggaagtcattataatgcgtagaaatctatttctcagtattgtcaactttatggacctatttgcttaaagaaaacaaattctaagaaatgtgacaattgatgaatggtagcatctcgtgtcttgctttctttttgtttctttacataatgattgttcaaatgaaggctatggacaaactgtacatgattattaatgcattcatcatgtgaacattcgaatgcaatatattttttctaagcaatgatataattattagctaaacccttctttatttgaattttaagattttaatgacagtgctaacttaattgttttctttaatcatcactggattatttattaagctagcttttagtcagtggcttgaattctatgattctctttgaccatttattttagtaattgaaaaatattggaattaattctttgaagttatctttgggcaaatgtcttctgaaatgaatggctcaccttatgctccaggaaatgttctaaaatggcaattgtccaactataacaataacttagcaattaaatcttaggccaaattaacttggtttatctgaagagacagtgtgtgaaggttccttggaactggtcaaaccactgatagaaatgttgagttatgtctctgtgcctgtttctggttgatcttcctaaggtaagattatgttagattttctattagtaggttacagtcaaggacgataacttatactaacacatctagaagcatcttctcatgtgtggctattcaaatctggtttatttctcatgatcttgttcacagatgctcccaaccagttatcatctgagaaaactgagatcactgaagaatcatggtataatttccattggtagacatatttttcctccctattatatgttacttcaactggctcagtgacctggaattgctttatataaccttggcataaaatctaagagaaacaatagattacatttaaaaatattgtatgttttaatcaaagacaggacataatgtttacaagatgttgctaaaattagagaacggggtgcaaaacattcctataccatggctctatatttttaaagaagcacatattataccatgtgttatatattaagtacataatgtgccaagtattatgtgctataagggcatttaagacattaataaaacttttctgtgaaaattgaaatcctaggctacttttatgtattttctgtttcctttagcctccaaatatgaatactatttctgattaggaacaaaatgttgttctgaaagatattcattctattttgagagtcaaaattagtaggaaatttagcctgtaaattaatttaaaatgtacatgatgtattacaaatatatgatctagtgtagctttatcctaaatattggtgggattggtttaaattatattttacttttacccacttttgattttttaatcacaatagcaaagaaaaaacattgtagaaattatagatgatgaatagaaaaaaaaactaaaaattacctcaatctcaccagcagatataaacatttagagggatatacttccagaaacataatagaaaagcaattttgttatgaaggtcccttgcctgttccataattgataactcaaaaaaaataggagatgctgattacttcttcactgcctattggctgaactaattttacttaattgattgcataaagaatttcttgattaccaatatattatttttagcagtataaaatttctcagttgatttattaaacagaatttattttatggggtttctacaatttttatttattgtactcatcataatggtctaactccatatttatctgcctatttcaacactattaggtgaatatgtctgactactaagagaacacctgcattatttgatttaaaaatttcttttttattttctttactagaaacttataattcatgaaaaatctgtaaaaacaactttaagacatgtcattacagtatgtttgttctataatattttggttttaatttttacatgcataaactacttcctttgcgcctactgaaatgtaaaacattttagaattctttaagttgtatagaagttcatacttatttacactggaaacttcctggttccaaagctggttgatttctccatgtatttgaaaatttaatgggtgcacttcactagaaacctacattcttcgtaagcaacatttaaaagggattttgttaactcatatcttaaatcacgcatttcaaaagcaattttaaccataacatttatctgtagaaaaaggcaattgtctttgaaatttaattaatttcaatagtactatgcataaaatatttcgagtctgtatttagactgatatcctgggaagtgcagttggagagtgaagaatttccacaattgtatgaatgatgaactcaaagaacaagtaataataaacaatccaattttaagtacattaaaaataaagtaatttagccttttagtatttcttattcatcttcaggaaaactgttttcataatgcatttcttatccatcttgctttttgctcacattgttaataagtaaaagaagtggataagagttctgagcacacaaaacatttcaatctccaaattctttgaccgtccccatgatttaaagagccttgcccacttgacttatgtaccacatgttagccagtaatctgttgaacagattgtaattctcatgggtattttatagctaaactgaaaacaattttcagtcagacaacatatagaaaagatgcttgtgtagaaagcttgctgctcctacatctgctctgaggagagtgtatcatgtggcctctattctaatgacagctatttggatcaccagtggatccaattggatccagcaactggatcatctgccaccaaaactaagatctggtgagtagcttatggggcgacctgaactgaaagatttgtccaacgggacaaggataagtaatagattcactagattctctttctagaaaagtcgaatatacaacatatagagagtatacagccagtgaaagggatgacagaaagaaagagagagagcagaaaggaagaaaaggagggaggaaggcagagaagaatacagtaaaggaaggaagagaagaaactcaaaacaatggaggaagtggggtatgtttagaagcagctcttcataacgacaacaaataaaaacatctggccaacatgctgtgttctcttagatttggggatatttgtataaaagaaactcccttttcacagaaactaataagagaatatcaagtttagaatgtttcttctaaaactttcttggattttataatactttttacctaggcaattgttataatgccgactctcaacaattgaagagaatttgatcaatttggtcaacactcaagaatgttgcattactttgagagtctctgcagtatcaataatgcttaacgtgaataaattaataactgtgcttggtttcaacatgcattcttaaactgcacaagagtagtttttagaatatcacagcattttatatttgcatataagcaatcagtagattaatcattcactaaaatagaccaaagcaatctacttttcaaccactcacagtatcattctgttgcctaatccatgtagtcatctaaatatgcaatgaaagctgtattcttctttacaattctcataagtttaaacatgtggataatttaaatgggcttccatttattcatttatttttattcattttttttttttttttttttttttttttttgagaggagtcttgctctctcacccaggctggagtgcaatggcgcaaccttggctcagtgcaacctccgcctgccaggttcaagcaattctcctgcctcagcctcccaagtagctgggattataggcacctgccactatgccctgctagtttttttgtatttttagtagagacggggtttcaccatgctggtcaggctggtcctagaactcctgacctcaggtgatccacccgcctcagcctcccaaactgctgggattacaggcgtgagccacagcacccagcctcaatttcgatattattctaaagactcattgccatgtgccaatacactgcctgtttttatttgttttctgtcagaaatctatgttcattctttacattttacatgcaattttttttgatttttgctgaaaataataatttataaactttcttttcattcccttcacatatactttaagtaaaacaacacagaaacaacaacaaaaaacaacgagacttctgttttctttatttatactttgaacttcccttattccttgagcagcttctatcctaggcaggtggatagcaccagtcactgacaggcaatgactggcagaactccacaaatcaagtgactgctgtgtgaaggcagaggcgaaagactcccttttacagttttctgctctcaggcatcaagcagcgactctaaactgaatatttactttatgttaacaagctccagcccctagaaatttcctcatatctttttaagtagcttctcaaatggcagcctgatcaaagcaatctaatatggcttaagtgccagtggttgacattttgcattcttttattgctttccatttttatctacataaaaattggtgataactaatatccatttgatcttttcattctggtaataaaatggtaatacaaagatcttattatctactccagacatccatcaaagtacatttttcaaaaatatactatgtgaagtgtttcttccctatacccaagtcaaaagcgaggtcaagtacttgtccttagatgccccttctctccaatacttgggcactggactgcaaataggaattgaacttcagcccttgatgctttgttcacactaatgttatatgtaattgtgttgtctctgcctcttaaatacactattttctgtgagaagccaaaagtacttggaaggtctgcttaaatattttttttaactccagagtttttattcttctaagaagacaagaaaaaagataacggaagaaacaatactggaaatgaagaagtaagaagagtgaatcttaatagaaagaaaggaagtgcaggtaggtgggagaacagacaaatgtaataaggcataaagaaagccacataatgcaaacaaaacaagccccagagatcatgagtttattaaatctatttttatatggatgcagaagtgtccctgaggacgggtgtggtggctcacgcctgtaatcccagcactttgggaggccaaggcagacagatcacctgaggtcaggagttcgagacgagcccggccaacatggcaaaaccccatctctactaaaaatacaaaaattagccaggcatgctggtgcacgcctgtagttccagctacttggaaggctgaggtaggagaactgcttgaatctgggaggcggaggtttcagagagctgagattgcaccactgcactccagcctggatgagagagcaagagtccatctcataaataaataaataaataaataaataaataaataaataaataaaataaaataaacgaagtgtccctaagccttccagtgaacaagaaggtcattccgtaattatgccattgatttggaaaaacaaaaagaatagaaagcataagaaaaccaagaaacacaaaaggctccctgaatccactgaatccactgcatatttaaagtagttactgatatgacaattaggacttacctatagttgataggagcaagtttagttttcaaaatttcaatgtatttacacctcaaaagattataggtctaacgatttttaaggttaccagaagaagagagaaagaaaaaaatggcactacttaatcatgcagtacatcacaaaaaaggccaaattttcagaaaaaaaatacatagaaacacatagcctaatgagtttggatgtatcgtttggaattattgggcaccaaacttgaaattgagaccatcattataactctgagattgacattaggctatgtgctttggcagatataaagaatgcagaatgagactaatgtcctgtacagaacctactaacaatgcacttgagaaaatttcacaagcaatagaaaattctttttgcattctttatcatttttaaatgacttactaaagtcatttaatactatggaccaggcaagagactgtaaaacagtcatcttctcatgcaaataattcacgtgctagtcacaaaagcaccttgttcaatatgatttaaggtttcaacaatgatttgttaatatttagtttttgttagtacagatttctttgatgagttttaaaatagcctacaatttgtgttccttcgttaattcagatagttttttcctttttatgttaaaagaatgtgactgtacagtcccttcccatctacccttattaaagtatccttcactgtctaagaaagaaagaggaggcaagggtaatctgattgtccttctattcctatcctggacagaggagagtggtgagccatggataattcatttctgtgctcaccttgcagcccatggatttggaaacactgaccttaatctaatcccaaattgtagataaacatattttagcaatggtataagctaatgagcatcaataaactgagactcgtctgggattgtgtgcagtcacactctgtaatctgcaagatcaaaacatacatttggcagtgaaatggccattattcagagagacagctttttaaagaaagtaccctatctatagctgaaaataagcttttttatttttaaatgaaaagaggctctcttcttccatttaaggatgcttgacagcttttcttcccgggggggaaatggtagcaataaggaatttgacagagataatacttggaattcagatctggcctttctcagaggaaattttaacaaagggctgtgccctaacatgtccatggaaaactctgtcactgcatctaaactactgacacaagagtggctgaaaaagaaacattcattcaggtttgaatacatgtagctggaccctctaccctcctcacctcccacccatttttcactggcaaagattagatagtctgacactatgtatattttccatataaagtacaaatgctgtaaacttggcggtggggtagggaaagagaaaatgactataggaaacagcagcacaattttaagtaaaagtagaaaagtgtttctggggaagtttccattcaaacgtaataacttagagtttaatattagtctttaatgtaagataatcttttatgttttactttgtatatttcttgtgataattttcttaaaagatatcaattgaggtatttcatattaatttcacaatacagttgatagcttaggtatggcacaatttttagagataatggtgttatcggctgtgatttaataaacgtacattaattttctcagtctcagacaaacctatggctcacagaggacacatgtaataactcagtctttcattaaactgcaagttatactgagatacagatattgttaatttagtttttattgagtacaaaatgcactccaggtagaaatcactgctcatttaatcactgtgtgttaggtttgcattatctggaatgtaaattcctccctttcctcaaaggtgagtcttttttatggaacttgggtttcttactacacctgctccctattccccaaataaaacagaggcaaaggaaatgaaaatgttacctgttcattgaatgttctttccagtgactgctgtcaagttaaggaatgtgcagtcctgtccgatgtgtacactggaggctcacaatcattaattgaattcaagtatcacatactcattaaaaagggaaaacaattcactaaacagcaaaaacctttgtcctcaaaggtattattctgtggaatatccagaggaaaaataagactgtcctcaataccagagtctcatgatataagccaaatggcaaacgagtctaacaagggtaattatactataaacatacatttaaaaaatcattgatatagccacagaatacagaatcacatgtcatttgaataattttcattaattgctatactttgcatagttatattttgtaaattcaaaaattcatgccttgttgcatgcttcatataaataaaataaaaagagtacataaggtagaggtctagaaaggaatattggtccccacaaggattttctaagatgcaggagggatcaagaaaacctacagccagagtgaggcacagatctggctttggcaaagaatattttgtgagttgccactttgcctgcatctatgcccccagctgaaagcaaactggacctggtattagatgtgcaaaatgtatatccttttaggaatgcatggaggagatagagttggagaggagattacatatatttgaaaaattccgcttacgtgagagctttgacaggttattttcaggaactattttgttcgagatctttttaaatgcctgggatattggttataatttattaacttaatttttaataagtcatcattctgttacttttttattggtctgattgaacaaactcattttaatgttatttttaaaagaatattaaatatatgtggatagaattatgagttgtaagaggcacagtgtttgaaacagtacgtattttattaggaaaatagtcttgttttcgcaagtttaagacctctatttgttcctcagaggatgccttattgccacttgaaaacatggccaatgctgtggggagtagactccatcaactcacattcagcattgttttgagaatagaaaaaaattctttactgtgacagtgagagattagaaatttgttagaaccattttatttaaattgctgatgactttgtgttgtgatcattggagatttcttaatgtgatcagcaaaacctggaaagaaaaaacctgagcatttatgtacagaaataaataagtttacacttaagataatgccacaactcaaaataaaatcacagtccttatatcctttcagattttcatccaaattcaaagaaaactcagtccatgcatcttttcagactcatcagtttgcatgcatgtcacagatttgaagggttttggttatttttgcagagatatgattaggatgtaaaaattcatcatataaacattcttaatgatcaaggaagaacgttttagacgagtaattttctatgtctatgtaaaactttagatgggtttaatagtaactctcgaagtaagaggaattaagtatttttttttgtatttgagttaaaagataaagacaaaagaaaataagacccacaatattttctcctatttggttatgaagagaacaactggagtctaaaaatgccacttgcagtatctaaatgtctataaggtgctggcacattctgttacaaaacacttgtcacctctttttccatatagaggtaggaactgcagtgggaaagtcttcagctgtacaaatttaaaaatgaatttttacaacccagatgatggactggtatactttaaaagtgagctcatgagttttataaacacatttctcttgctctctctctctctttttcttgactagcttacatcataatggaggaataacattttaaaaattttgaataggcacttactggaattacagttaatcctgatacaatctagatggggaagaatagatgaaaaatgaaaattcatccttcaaggtaatagctgcagacatccaataaaattacagtccacccttccggggacagacacatgcaaatatggccactccatatcattattctttacatacttataaagcccagatgttttgttataaaagtttaccattggaaacaacaatagaaggttttaaaaatggccaattcaaacaaagctacatggtgacaaatctaagtgaagtaaagaattgttaaatgtcaaagatgtttggcttagactggctgcaactttctccccatctgtgaaagaacatatcattgttttccgcaaaatgtaaaagtgctccgtcacaatggggtacagtgcaggttcagctaggctcagacatcttggacctccgaaatctaatatcccacaaaggccaacagaatccttcagaattgcagtggtcaaatggaaagcaagttaaaattattcttatcttaccctaagggtttttgttttgtttttaaattttatttgcttgggcataaaaaggtaactgccagatgttggctggattccataccttgcgttaattggaggaggaaagaaacaactgtatgtttcctttagaaactccagtggctaaggagcagtcattattcaaggcacacaagcctatgcctctcttaggagctaacagtgttatctctgtgtaataagtgtcgtggttcccttgattttcctttcttgattttccctttcttatatttgctttatataaaagtagctactataagaacagaacgtcttgtatgggtaacacaaactgtaattatagtggttatttttaaaagactgtaggatgtttcatatttattttatatgtatttgttggtttgggttttattatttaatgcctttggagaacataaaaaaataaacctagattctgtttccatatagctgagtttgtcatgtgtcgtcaaccgcatcagaaaagtggttgcaaacagccaaggaccagcacctacacacctctttctacagaatgctttgctgttcgaaaattctcatgagtgtttccactttgactaacagcagctttactgcatgcaattaggcgatttgttttgattggcttgtaataacctgtcatcgtcactagagggtactctaacagaacagtaaaggagagtgctctgtgttcttaaagtagtatttttttaaccttaatatttaacttaatttcactaatattaattaaatatgattatatgcaataagataccaatgggataattttatattttatgagttatcgttctgcccagcacaatttgaaaatgtaggtggggtttccacaaatgccttgcctcatcacattttattactccttttttggggtaaatctatgtagtttcaaatttcatttttccctctctgtttattcatttctatatacgtgtgtttaacactgtcaaaaatacagtaaaacctcattaattttgactcctcttattttgaaataatgataacactgaaaatttgggcagagtatttattcttcctttgatatgagcaaagatctcttaagaaaaaaaattaaactcataaacaaacaagactttgaaaagccaagcgtgggaagaaaactgatttccaatacttcatgttgatggcatagtttgcatgaaacgatgtgctaattataattaatttttatccaaccattaaaatcagcctagagagccctttccgtgataagactttccaaactattatgtttttgagtataatttataaaaataaaaactgcttaaacaaattttaaaatctgcaattcagactttttcctaattcagcctggtttttccccataattcatctagattggtgaggttttactgtaatgggtctttcttaatgctacaattaagcaggaaagcattatctttctgtagaagagcctgtgtctctagtgttctcatggctgtttgctaagggccgcagactttgggcattgaagggctgtggatcgctgtttgatagcaaaataccaccacacagtactccgaaacagaaaagacagggtaccacaaaggtgattattcaaaggagaagcccatggagtagagtaagaacagctcttgatctagataacaaagcagaaatttgatattttgtgcaaatcctttctaagaagacatgcttttatttatctgcaaggatgtcacctacaaccgatccaaatgtcagtgaatatatcaacagaaaattcagcttgaggcaacctcaggcttaataatttatattttcaattaacctcactgacagacatggcctctcttttaagaaccctcagtggtagaaatcacaaaacagtaagttatgttaaacataaaaaataaaataaaaaataaaaagatgcccccgaaaacctcaaattactttaaatgatggaaataagaccattaagtgttttaattttccatggcaaacaggctacttgatcaatgtttgcaggcaaattgaacaaaaagtaaaaaagtgttagttcaatgggggaaggcaggttgttacctagattgaccgtcagtttcacacgtcctgcgtctagctccaggcggagggtgtcagcagagtctctagaagtggttgccatcagaatgccatatgcacgctgggatcggaaccgtaaggaaacatcctcagcctccgtatgcatgactacggggagctgaattttcataaacatgctcccatcatagctcaaaaccgttgcctctagagatggaaaatgaatatgataagttcttggatggtatagcgcattaatactttaaagaggaaaaggatcatttattatcatttatttaagacttccagaacacaatactacaaaatcaattcatcttcttcagaaataaacaaaactgtgagctggaaagagaagtcacagtagaggacttcccttgtgagatatttgctaaagcccagaaacagagatatcagcagttcctttttttttgttcccagagcactttctacctatagcattaatcatgttgaattttgagtgtttgattatatgccccccttctcaagagcaaagatcacgttcttttgtacagccacagtgtgagcctagtttgaaacaccagcgaagttgtggatttttttgttgttgtttttgtttgggttttgttgttgtttgtttgtttgagacaaggtctgtatcccctaggctggagtgcagtgacaggatctcagctcactgcagccatgacctcctgagctcaagcaatctttccacctcaacctcctgagtagctgggaccacaggcgcatgacaccatgccaggctagcttattattaatacttttttctagagatgggtctccctttgttgccaaggctggtctcaaactcctggactccagtgaccctctcgcccaggttcccaaaaggaacctgtgcccagcctccagcaacttttcaatgcatgtttatgtatggtaagcccactgactagttctgtgaaattagtcaaccttgccttggctctgaattattcatctgcacaatgagagggtactgccagaaggtttctcagggctttgatctgttctgaaaacctgtagttctaggagaagttactgtcatcatttttttttcataatctctgccctgatagaattatttttaaaagaaaaaaaaaagaaatatagcttaactataggaactaggccaatactttaccaaaggtgatgttcaaaaagaaaaaagaaaaactgatattaccaaacaacagataatacttcttttgagccattatgtttagcaaggtaatttttacaaaggcttccttttaaggaactgttacttccttttaagattaatttatagaaggggagtaactttaaatattatctataagcacagccctggtgtcctgaataagttctcatgcaaagcagtaatgatgtgcttttgctacactaaataagcatgggggtgggactggggagcttgtgaggatgtttgttactaaactaaggcagatggcatcagtagggaagttgcttagtactgtcttaaacacacaaagaaatgaataaaaaaaaaactgttgatgacaacctgacggctttaagaaatagtcaggactccttaatgttaagcaccatatggtagtggaatattgcaaaacaagcgtgaatcagtttgctttctcattggttccgataactcaggatgctacttaataaagaaaaactacctggaattaaaatgaaccaggaaattttcattattttgcctacttacacagcatagcaattaagtgtactgatacaactgtgttcaatattaggactatatttagagttgtggttttgtaagtttatttttcagaaagtcaagtactgtttctataagactttaatcactatttgttgtcatgatgggattaagtgagaaccagaacctctctaagcactgagtgttccaggtctccctgcttaggttagctcccttctcttttccatctacctcttgacttaagagatctcagtcaactcatatgctcactcctctaatatttattaagcgttctgacttctctcctgagctgtagcattcattgcctattggaaattttcaattggaatatgaaatttcaattggaatatttcaattggaatattattaaactcttgatttactcccttcaaaaatgaacaaactcaaaacatgctccttcttcagtcttctccatctcagtaaacatgataatctcattgctcagacctaaagctttctgatttctcttactctctctgccatgtccaatccatttgcaagtctgcaagtcctaaaggctctaattccaatccacattctgaattgattgctgttcacctctgccactaatgtccctcagactttgctctcatctctcacctacaccactgtagtagctccctcaaccgtgttcctacttttttaaacctacaaagatcagtgtgaccctggccccagtccatctctctggcctcagctttaagtatgtcccgcttcttgttcagtgagctccagatacaccaatttcatgatctcactgaagtgtttgcacttttagatccctctgtttaaaaatgtttcaccccagatctttaaatagctggttctttcagcatttaggtctctgctcaaatgttactccagagagacctgctacccactccagttattcaatatatattcatcatttcactttgttgaaatgaccatttcttgtttgtagagtattatctgtatatgccctttagaatacaagtaccttgagggcagagatcagtctctcatatgcattgctctatcagcagcaagtgcccccacaatgccaggcccacagcagagcctccataaatattaattgaatcaataattgcacacacacacacacacacacacacacacatacacacacagtgagctaatttcaatttgaataccaagcttacataaaagcttaccaaagaaattaagtatttattctgcttattgcaagtgaaatctaatttcagtactgtgcatgaacgaaatatgtaataaggtccactttgaaggccaaaattgggctgcagaagataggctagggaagtgtctatttatcaaaacaggggcctcatggttaggcaatgccctaagcactgataaaacaaaatatggtctttcaaaaatatagtggttctatataatatcatatttttttccaattagacaaaaagtttcccaaatgggagtaaaatcccagtggtcaaagaccagtgcaaataatcaaattgctgttgctcaaaaaataatgaaaacctgagtgtaaagttatagtgaattctagagagaaaaatgcttgtggtataattttaaaagaaatttgatctttacttttgtttttcctaaactagacaatcatgacccatatctgtaaagcaacaagcacccgaataaaagtgtaaaagtcattatcatgtgttcagttactttggtttcatatagataaaaggatcaaaacagtgtttgttttctcttctttatttaatctctataactaggctctattattcaataatcacatttttgaaataatcatattcttctgggaaaagtagcttgatttgattgaaaactaaatagggggcacctcctttaagaaatacagatgactgacaatggatcataaatatagtgtgaaatacaacccagagaaaaaaataatcagaatcattagcctttaacattctccagaaagctgcaggactgaaataacatagtaaagtaataaaactagagtgcccccgagtgtcatgttaaataattctcaatgtgaaaataacttgttgataaatgacaaatgaaagcctaaacgattcctcacaattagagttaatgtttaattagacaagaaatggaaaatgcacagggttgtagtctagagttgccaaataaatggtaaacaacattctgacatttgaaggttatgctatttggcagcatccttgaacactagtaaaattatttcatcatttagaatatacaataattctttaaaaggctaattccaatacaatacttcccactgggggagaaaaccagtttcaactttgtcttctatatctccttctcccttgtcattaagtttgataaatttccttttctacattattctttgttgcagtctaaagtgtacacctgtgctcagttttgccgaaaggcagtcacatattgtgatcaacgatgaaaatcagacagggagccaaattatattgctctgacatctgtccctccatctgttagaatttaacaaacagtataaagcagatctctgattatatcaatgctcttattcttacatataacagaataatttttatatgatcaagtctccacaaattctcagttttattaaaaataaagcagaagggaaggcgctaaatttaacttttattcattgaacattatttctgtactactccttcttataggatcaatacatgtaaaacaaaatactctcttcttgtctgcctaagttagcaagtatcttattctttcttataaactcctttgcttccttaggcatgataaacatctcctataatgcaattgcaacataatttttccatgttgaactttctaaatccaaggagctgaacatgttttttaattactttgaataattattttcataaattataaattatcaatttttgctcaaagttaataagaaaacaactttaaaagttctcttaaaaaaagaaacttcaagagttgtcaactcttatttgatcaacaacagccttaagtgaccaatgtgtgtctggagaagaaactctgtcaaagccccctgttttaaattggaaattcggaggttcaggcacaatcttgtgttaactgaactagggcataatagccacgaactgggcagaagccaaattttgtggtattgagcatgacaaccatcacacatttcctttgctttcaggaggcaccctaacgtgagcaagaaaattacttctgaaaagcaaaggactcacgcaatacacatgggtagtccagtaacaagaaccacccaaaaatgcatacagccaacctggagacaaagaaatctgcagaaacctgcagcctcctatcagataaagacgtatgctgaatcccaatgatgaagtttgctattaaattctcatttacaaatctacatatgcttgctgcccctttttctaatcattgcaatatataaatatttcttctctcatcctggctctgaaagatctacaatttctattttcatttttgccataggtagtagcggaatattgccacagggtggtacaccacgcatagttaacagaaagcttccgtaattcatgtgacagttgagttatacccttttttcagcttcacttaaccaagaggcatcagaacaactggcagctctctgggtgattaaaattaaaacaaaaccttaaatcgtgcaagtccgctaatctcatattatgcgtaactgtattataccttgcaagctttgttacattgttcatccttttggcaatttccaaaaacaaaactaaacaaacaaactaaaattaggaagcaaaatgcaaagaggaaacttataaagaatatacaccatactaactaaactatatagaaatagctaagttgtattgacaattcacagaaatgccggttaggtactatcataaagagaatgaatatatctgtatctatgtgataacatacccgtctactgacccatctaattgcatgacctacaataataacagcatatggtaagtggtttaatatatgatttctatgttactattaaatatttatattgttaatattaatctcagaactaataagttgatgtacctcctttttaagataaataaccaaaatcaggtttcaattttgggtttcacaaaacaacccctctttttcctaggaggttttcggcaaactgaactgaactatttcaggaataaaaaagggaaacaataaatattcatagcttaaaaatagatgccaggtaattttaggctaaatatgtaataaagcaatgttatttgtagcaggtgaggacaatggaacaactcatcaatattttttcatattgatttttagttccattgttgaaaataagtggcaataggtgtagtgactaaagcatttatctgaaacactgggtcgatggaagaataaacttagaactatttgttctgctatttattcctttagcctgttctgcagatcaactgggatggctattgcccttcagttttctttgaatcctcattccttttattgtatagggtgaaaaaaaagaaaaataaaatgtgggtttgcctcctgttagaaaaagagaggcagcacctgctcagaacttcaataggcacagctaagtcttaacagcaaattggtaaatgaatcctctgcagttggttaggtcctagccaaaggtaagtactttttctattagggtacacttccagaaatgttggtgcaccttagatgattgaaagtcagcttacttttcagagaggatattgcctcttttgtaagttgactgaagtgaaatgagcaggctaacttaagtctcacccagttgtgtcagggaagttgcaactcatagcttagcttgcctcaaatgctatttcttagcatgggtattagcactagaagccataggtatgtataattcatgcctcttttactgtctaatgttctgaagttaaaaactgggcaaaaaagacagcagttactgtctataatacatcttaggctcatactctagaggatactaaagattcaagtttctattcctgcaatatacttaagaactgtgtcctttcagaatcaagctctttgaaaaacattaagagctcattagtaatccatgtcaggtatggctgctcagcttgcaaacagagtttacttcagtagagtatacattacgtttcaatggtcagtgcaggtttgaggtcaacatttaataaacttttcatctcagggagttggctgctggggttttagaatcctacctctctcacaggacctgccaagatagcctgttccggaacaatcacagacatatctgttccacccatccctgcacatgccattgtttttgcaagggttgctaaggcacggttttgctgtttcctttgagcaggaaggcttcactccagcagtactttgaacttcagccatttgccggatatctttgctttggccatcgatgaacaaatccctgatgcagcccacgtagccatagttgagcagagcagtccacacctcggtggggaagacaaggccagctttattttctggcagcccccccaggtacaactcatcatccaggtccagaatctcactctcaccaggagcagtgtagggagtacgcaacgtgttgacagaaatggtacctatttcaaagagaggagaatgcacaggtctttaaaaagcaccaacgtgttataattatctttctctctttcgtctgcttgatggttaactccttggaggcagacaattattattattctttctgtcctcactttttggtatttcctagagaaattaagatatctgtggtattaagaaactttagaaataaaacagactaaatggttccatttgaactcgagaatggaaacctaagtgtacagccaacaaatagtgtttgagagcctcaaacagttcagtcaatgcatgtatacatacattaaaaataaagaaactgtaattctgtatcagtctctagaagaaagtcagattcccctgggttagtgcttgttttcaaagccaatattcaattgcaatccaaagaaagatttcatgttcctattttaactgacttgattactttgattgagcacaatagtttcacagattacctatgtcaaaacctgacttcatcactcctagctgtataaacctattgattaacttacatagttttgtttcccttactcataatatgcgcataataatattacctaccttatagagttgctcttagtgttaaacaaaataatactagtaatgtacatggtttataataatcactgtataaatgtttgtgattatatttcagtgaaagaatcaagtaaaaccaattgcttccttatttgtaaaccaagctagttatttatttaaattaacaaggctttctttttctcactccaaatgttaaggagaaaaatctattggtttataaatacaagggctctaagtcctaagtatggaataaccaggtattcatctacatgggatcatttgagggtcacagaaaaatattagtggaatctatgaaaaaaaaagaaagatataaagcatattcctgatcaaaacgtgcatacacactgtcagattaccaaaattccactgatactttatcttcagaaagacctttgtacaaatgcaaccatgatacctgaacagaacaccacaaggacccacaaccacattatcccagatttatttctcagctccagattataagaaaggataggaagagtctgatgagagagagaggatgagaaaaggtctgatagcatgctggggcatgggtatagaacctcaggtatttagggaagagacacaagagagacctggagatgggaggtgtgatacagaagtaaggacaaaaagaagaagtggagggtaggtcaggtgtgtgtagggagacacattttagttgctacacagaataccaaaagcccgccccaagtgaaaacacatatctaactaaggatgtaaggctgtgggccctgatgtgcccaggagtattccaaatcccagcagaagggcccccttcaatctaggcagtctaatgggatctgtctttgtcagggagaagggcatggaagccactgacaaagactgctcaggtggccgagtcattaagaggatatttggctctctagactttcagagaaagaaaagggaaaagctcctaggggagaaacactcaaaggcattgctattttggccttccaatgaggggagcaaaatagagatttcctagggaagcagctaaaagagaaaaggacaaagtattcatttttactgttcacatttgtacaagtgtctagaagaaaactctcatttaggaacatatgggaaccataaaatcctatttagaaaaatataaagcatggcattttggggaaataaaatttataatattgaaagagaatggtggctcttttctatttcaaatggaacgatcattacacgcattttaaagcatcattttttatatagccctattcaaaatacctaagaagcgaataaacagatggtccctatcctctgcagtagctaatgaaagttagaatatgatgagaaagagtgtcttttaatgacaaaaggaaaggtggacactttaaaaagcacatattatcatggaaagcaaagagttacatgcaatgaacaaagtgccatgttctttttttttttctttctgagacagagtcttactctgtcacacaagctggagtgcagtggcaggatcttggctcactacaacctctgccacctgctttaagcaactctcatgccgcagcctcccaagtagctgggattacaggtgtacgccatcacagccaactaatttttgtattttcagtagagatggagttttgcaatgttggccaggttggtcttgaattcatggcctcaagtgatccacccaccttggcctcccaaagtgctgggattacaggcgtgagccaccacacccagccaaagtgacatgttcttaaataaaagagagaaggattctactctattttccaattagttcaataaggcctcctaaaagccgtagaatttttgaggatttgacgaaatgaatatccactattgagaaattgagaagaaatgttaggagacacggaacttagcaaaggaacaatgacaaattattccaagtgtggtgatatattcaaatatacatatatataaacatatatgtatgtatgtattcccatatgctctttttattcagctcagatggggaaaaaagccctgggaaaggctgtactgtccttgctcagggtatcgtaattctgacactaagaggactcctggaggactcctgagtcgaggaaattcattggcttccacaacccactttctccctctattccatgtagtttccataccttggtgcactgtgtctgcactcactctaaggggcaaaacggctgccaggtggtttagacaatcattcattacagtttgtctgacagtaaggatggagtaactgtgtctcttgatttttatttatggtgtgttagtgcttgctttgagcaaagtattgtaagagagttcaaataagttattttaagaatgtgcttgatgatatggacagggtaagattcttactacaaatttatcattagacttgagttttctgaacacggtcatagagaccacaattttcaaatatcccagtgcacacttaaacacacatccacccacccacccacacccacacacacactctgaaacaaatgtttaaaagaaaaaaaaaatattcaactctacagcctctgaagcactttgatattttctctctcatcatatcattttattaaaacaaatgctggaccatcaatggattttagcaccagctaaaatgttgtaacccatggtacaaaaaaataaataaaaaacaaaaacagatttaagggttactatcataaagagtaagtttctcccatagttccctattgtccctttgagagacaattgtagagttctcatagaaagaacaagcaggccaggcgtggtggctcatgcctgtaatcccagcactttgggagaccaaggcgggtggatcacctgaggtcaggagttcgagaccagcctgaccaacatggagaaaccccatctctactaaaaatacaaaattagccgggcacggtggtgcatgcctgtaatctcagctactcgggaggctgaggcaggagaatcgcttgaacctgggaggcagaggttgcggtgagccgagatcacgccattgcactccagcctgggcaaccagagcaaaactccatcagaaagaaagaaagagagagagagagagatagagaacaagcaacaaaacatgagacagaaagaaaaagggatataatcctacctttaattcaaatttaatccaagaaagactagaacttaaattgagctctggattcaaagttaaggagacacatcaggcaaatggatggatcagatatcagtcattggaatattatgcaaacagacatcataggatgaagaaaatagggctgaaaatcaagtactactttatctatatgctttgctaattcgtatgaacttgtattttagaaaatctttgtaaaagagatggcaaataatcagaaagtaaagaatttagttcaagtgggatggaaacaattatttttatattttgaaaattcatggagtaaaaatggttagaattaataattaaattttattactgagacaaatgcaaatagaagtttatattttagcctaaacatgtgtcctgaaatagacacatttccaataagggatttgaatcccagacctccttaatgacttttactatggatatgaatcaaagaacatattcacctagcaaaagagtcatcacagaatccgaattagtttaaaccaatttaactcatagatatgagcatagtgaaatttaaatattaaggttcccgtgtgcttattttattaaaattgagttataaaatcagtggttacaaagaacacatcaaattaatatttaaacctggttcattgataattgaagacaattgagtagttgccaaactctatatatcaatggaaaaggagaattttcaaaggctgaggtacataaatgttataaatacatttttaagagaaaacaaaaatctaaatatattaatgggtcatccctctatctttttccaggaaccacaaatactgacatgttcttttttaaatagtttgattccttcatacattctaccccttctactgaatttatatttgcagtttctggtaaattaacaaaatattttatgtaaacattgttacattaaggctcctaaaattggggaaaagttcatatttgagaaattatctagatcagggtttcatgcttcactatttaagaatctgaagcaccctgctatgctattttattttttaaaggaatgagatcgcaactaaaaataaattatttgtggacatacaacttttataattttaatgtagaaacgacattacattatattcttacatgtaaagctgttttttcacgacacatgtaagaggtaaaatgaaggtgataagcagacaaggtaatatttaagaatattcataaacaagtaataaatttatgtttcttgtaaaactgtatgcaaaggttcaaaaaactttttaaaacagctcttagttataaaagtggaaatgaaatttacaacgtagtgaggtagtttttcattacctattagtttccattaacttttctatcctatttttattgtctgttctacttccataagattagtttacagggtgagaagaaacacagagtgaaggtgagatttaaaataagttaagttgatgtcaagagttaaattacttcacaagtttaaattactaggaaatgaggagtagaaaatagtgtgctgtaatagggaaccctttttcctggtgagaaaatccgatgttccagctcttcaactaactagctagcaagtttagccaaaggatagatctgttaggcttcaatgtggctcttatgaaaaataaagaaattcagtagatggattattaagattcatttttgaataaacaatctttaaattactgcttaaatgaattgtttaaattaatgtcaattttatctatacttaattctgctccacctgtccctacacaaatgaatcagatttcacaaagttacaaatttacttgtcaaattcctagtctaataacaaattcaaacttgatgaaatatgcacaacataagtaataaaaacagaatacaacattgacaatagggtataatgtaaaatgtaaaatatataattatcataaaataattttaaaaaagaaccaacatattaagagtgggtatttggtgacagtgtaattatgagtgttatttaaaaaatttctgtatcttttttaaaaccaatgttatctatgaggtttttaaagaaataaaattaactgtatttgaaaacaaaacaaaaataccatcttaatattccactctctgcttattaccatctgttttctgcttacttgattcatctgtgagctgggaacttcaggaattaaatcaatatatgaaaacagaactctaatgacaaaaatttaaaagtttaataatgtctggtattggcaagaataagggggaaagggcacttcaataactgtagataagaatgtaaattgaaacagcagttagtaaactaacctgtcattgtctttcaaaattaaaattacaattaatccagcaatcccaattctcacattcaatcctagagatattctgaccaatatacacaaagatttcatgtatgaaggaattatctataaactagtttaaaacagtgaaggtttaaaaaagtaaaaattcaaatgttcttccatagagaaatgcctaaatatcagtatgttcaaactaaggtatgtatggtgtcactacaaagaatggcacagaaaaagctatctttaagtttttttgttacacagtaattggtaaactataatcttgactatagaaaaaaggctgtataagtattttatgtgtgtgaacatatttatagatatattgatgcctagaagaagaactgggaatttttcaacgccaaattattttagtggttatctatggagaacagagtaaattgatgagggaatgtatggtaaggggaaacgcttcacttagctagtttttgaattgcctgaacgtgttcaccaaaagtatgtatttatatattaaatacatcatgcattacaaaaatgcacatatataaacacacatacacattcacagcaatgtatagacacatatacattttaaacatgatcatacacaatggaaggttgtaaatatcaatcaaataacattctgcagcaattgaaatattattttgcagaagttccacagatttccactcagcattccacagtaagggtcactaggtccgcgtgtggtcagtaaactgcctatcttcttagggtgctactgatgccatagtccagagtctgccccttagctaggcaagcccaatgaagagatttggtagattttcagagggcggtttcatttcccaggtttgactgatatttactaactccataacagcaatgtataaaacaagaatgccaagttattgatttcctctgaggaattacctattacaggacatgaaatacttcccatgtagctctgccaatatggatgtcaattataatcaaatattacttattcatttatgatgagaaatttacttgttacaggaatgtgaatactcatatgcattcctcagtatctgtggaaattggttccaggatctcctggagacaccaaaatctgtggatacttgagttcctgatacaaaatggcttagtatttgcatataacctatgcacatcctcccatgtactttaaatcatctctaaactacttatatctaatacaatgtaaatgctacatagttattatactgcattgtttaagaaacaatgacaagaaaaaatgtctgtatatattcagagcagactcaatttttttccaattattttcaatccatagttgattgaatccacagatgcaaaacccacaaaaaatggggggccgggccgactgtatacataactggtctattttctccctccactctaatcagacttacaatgggaactaaatcttaatcaaaagagtgcatggggaacatggattctgaacaagaagaatgcatgagataaggaaatgtatagtaatattggcctgggaaggcttgacacccttatctcagttaaatgacctgcctccatctttacagtggggatgaagttgtcaagttcgctaagcagtgttcagaagattactgctaatatttgcccctgtgagtttcttttctttagatatgttaatacatttaagttctacaagcccaggggcctagctcaggtacttctgaaaagctctgctctgaatctttgcttatgattccataattcccagaaaataaattttgctacttagatgatcttgagcaaaagagtacataacaccatattaaacagatagcctgaaaaattatgtttatactctaactgcaactatataaaatatatataatgttaacaaaaactgaaggaaaatgtacaaatataaaaaatactttgagtgtggagaaacaataaatgatttttttctataaacttcttcagaataaataaatataaacattttaataaaacttaacattacaattttaagcaaaattgaccccatctggtcatatgatcaaagaactagtaaattattggtaaggtatttcggtgtttcctctgatgaatagtggtttatgggtgtggatatgaaacaaaatataaatgcacttaaaattacttcaatgtatataacaggctactaggcagaggcatgggaggaacatttacagtcagagggcaagttcaaacaagacctaagcagagaaattgtctaatggttgctcaagtagaaatgtttaagtgtggtgattcatgaatggtgtacacagaaatcagtgctggtaatagatagctagaaagtgctgttcacatcaaacagtgattactataaacctctaattatgtgctcttgagagagccttgtacctttcccactgtaatatctagttcttaaactggaactctacgacttcaattcaaatctcaatggcttcttagctgttaaatgtaggcttacccatgaataaccgctgacacaatcagctgtaccctgctgtatacaagccaactttgacaagaataatgagttttctctttgatttcaatgtgtaatgatggtttacaaaataaataaataaataaataaaataagactggcagtttgctataaaaatacttgagagggtactttgactgagccagagtttaacacaaatttaaacaatatttgtgccccaagaaaacaatcattaacctcatcctaattgtagctccattcacagtttagctaaatacctgggcagctgttttgtgttgagggtgggaccagagaagaggcaaaggggaagtctggaaagagagagactggtttaaaaacaacaacaacaacaaaaacgctcagctgtaagtcctgcaaaaattgcaaagtaatgggcctcttcaatcatatttattaagtccactgacttaggggttttgccctgttagtagctaagttatccacagaggttatttacattttgcagcactgaagtcatccactctgattcactaaatcatgcctgcacttggtatggtttctcctttgctagcttactgcaggatctggaagtgccatttacggctcagcccacttggctttccatgtccctgaccctttagtgagcaggcagtggaagaaagctgcactgcacataaagaacagctatagccaagcagaattagtcaaactgtggaaattagagtgaattttccccatgtctcagattggaagaaggaacatatgttagaaataaccagttacaatcagttttgccaaaatgagaaagttttagaaaattacacataaaggtgttatttctcattgaataaggggttcatatacccctttcagtgaactaaagaccaaagaaccaaagggaaggccaccaaaaagatggacatcctaggttcttgtcaagagcacacttactgtggttgcatatcccagtcctcagaaaggagttaccaccttccttcttgatggattttcctgctccctaaatgtctgcaaaatgatatagggacctcaagaccaagaagggacagaagtcctgttctcataaaaacttgtcatttttgtaccaggtttacacattcgctaacaattatttaactttctcagtggcttatttcaaacatctgggcttggaggatggtgttgcattcacaagagaacaccagtttttatcctatatcatataaactgctttcagaaagtaatgtaatttaaataaatgcttacagttaaaaaagttgcatttacaattaaaagagtgccattattctccaaatgtaaaaaatgatgctgctaatttattttattttatttttttttagagtatcaggggttgtttggcactgtactacttacatgtttttaatctttagtttttcttataccaaatatatactgaacaactgctatacccaggaatgtactagaaactgtggataaaaaaataaatacaattttctctatctgggatggaaattatgaaccttataaagtgggtaatattaaaattaaatcatttgtgtccaccaaatatgattttaaccctctctctatccaaaaataaccactacttagattggcagcaaattaatgaccataatggtctcattatatttctatttactttagtatggccaacagcagaaagaattgctcttaggcgtgggttccctctactttaataacagagataataaggcttttaaaatactgagctaaggaatattccaggcaaatcaacagatatggcctcattatctgtatgtcagaaaggagcccatgttaccctcttgtcatagcagtacactttctccacattatatgaaaaataatattcatatagcccctgaatataactgatataaaaaatgggtaaaataaattatttcatgaaatttccatgtttcttagttgtaagtgacctctgaatcttactgtttcaccagccaaatcagaaatatcctttaagtaaaataaaagcaagtatagccattcattcaatttttaaaaggctactccataccaaaccaatgcagtgtgcaaatatggaacttaattaaaatactatatataaaatattaacagctgctattaaaattacattaaacacccttgagctaggctaacctaatatgagctctattttttttcaatttaataaaggacagaacttggcttagtgaatgaactttggtttttatattgtttgtaccaattcactaatctgaaattttaatcacataaaagtactttaccatcacaacagcaccaagcatagtaatctgatctttccactggattcaaagaaaaatctcatgcttcgtttattttctttcttagatgcaaacaacacttccttagaacgtgtttctgttcttcccatacagaattgagctttgtaaattaaagtagatatcatctaattttgaccttctccaatgagggtacaaatagagtaattaataaactcttggtaatttggatgaattaaagagcttaaacagaaaaagtagattttattctgcttgaagattaaagtatttatctgataattaattagattgcatcaatactttctccttataataagaaacctcataaaatattcaaaataattttgttctctgtgagtatgtgtatatgtgcatgtgtggcatgtatgtacatatgcatatatatacatacatatacacatatacatgtagagagagacatgcacacatatatagacacacacacaatttacatagaagaaagactggaaagaaatacccaaaaatataaatcattattttcaaatgaataatgaatactttcctttttcttttatattattttgtatttactagtattttgaattaatcgtgtattacattcatatagttagaaaattcctcatttctaagtgaatgaaaagcaattgatttgatgtttggtgttttttttctcctctgaactttcagaagataaccgtctaatctgatatgggttgttttgtgttgttttgttgttttgagacaaggtcttgctctgttgcccaggctggagtgcaatggtatgatcacggctcactgcagcctggaactcttgggctcaagtgatcctaagtgtggggattacaggtgtgaaccactatttttggcatgttttgttttaaagtgctataaaatctgacttaaaatatctcttcttgaaagtaattttcaaaattttattctagatctatcttaagtcaaattataacatccacaagctaatatttcaaagcactacataagcccatgcccacgccacttcaaaattcttctgcttgaaagttcatatgtaccaaattaactgctatctctggcagagataggctggaggaagtcagaggggaacactctattattattgttatatttttgcattcccatcaatgaactcttctcagcttatttttatttttattttttatttttttttatttttgagacagtctcactctatctcccaggctggagtgccgcggcccgatctcggctcactgcaaaatccgcctcccagcttcatgccattctcctgcctcagcctcccgagtggctgggactacaggcaccgccaccacgcccgactaatttttttgtatttttagtagagacggggtttcaccatgttagccaggatggtctggatctcctgacctcgtgatctgcctgccttggcctcccaaagtgctgggattacgggcgtgagccaccgcgcccagcctcttctcagcttaaatcagaaagaagaggaggaggaagaggaagaggaagaggaagaggaagaggaagaggaagaagaagaagaagaagaagaagaggaggaggaggaggaggaggaggaggagggagggggagggggagggggagggggaggaagaaaaaatggtaattcaattccttgtagacttctttaggaaagtgagaatatttagggagacaaagtttccagagaggaatgaatcagaaacacagtctccaatatatctgggaatcagagtaatgggttctgaccttccttctctccacactcactcccaactccttctcaatttccatatattctatttctttattttgttaggtaaaaaacatatttccaaacaggcaaacacaatcttcttgatctataaacagcagaataaaaaaggaaggataagagggaagtagaaaatagttcagctgggagttaacaagtactgagggagcccatgcaaggagggtatgagcaagagagttcagccccaggtcttcaacagggcccttctgaaagaccatggttatcacagattactgagtctaaaagaagcactcagcttagttggttgggggtgggtgaagtaaagaaggagagtagataggtctaaatttagttatcttctattataagatcatttgatttatgtatgagtaggacaatcagagcatgggagcccggggtgaagggaattaaataaatgtagttgtatacttaaaacagatttctctctccttatctctccctgtctgtctgcctctttctccctctcttctctctctctctcttcctccctccttccctctctttctcaggattcctacaaatgtcatctctgcttcctggatgattatttcccctcaaagctcatattagtcaacatcctaagccccctaaaacactcccaaatttcagtgtaaatgtgatttcttcggagaaactttacctgccacctttacccctcctctcttagagaaataaaatgcagcaacaggaagcagaatgtttgctggtggaattccaaatacctttcatcagaaagggaagcagtttggaagggcagcagagctttgccactgtccttgaaatgctactgtattgattaaagtgtttttaatgccatagactcatcctaaagtgtgacgtgccaaactaaggattttatgtttggatcattctaatttttttttcatattttatatttgccacttcgggtacctccaaacatccaataacataagagaaaactgggaatagaaaaactttgaattttttcacttgcaaattcaagacaaaattttctgcaagatttggcacttgattacccaataaaagttcatttaagaagctattttagaagacatttgagcatttggggtttgatgcccaactatgataattaattagctctttctttcatggtgtgaaacagaagcaatatcaggcaatttcttttaggctaaagaaacaaatgcaggaagtctttaatatgtcttggttttcacttttaggaatggcatgggtgggtggggtgctccagcagataaacagcatagaaaaatgataagattacctgaccgtccgtctctctggaagtccacatgataccattctccatcattcactttcttcaacagggcttttatttttatagtacctgaccccatgtccaggaggaggtagaggtggccatctagcatctcaatagcaaagaagtccacctttatcatctgtgggtgcttggcatctttctgatgtcttggcttgccatggctaaataagatgaggccatttggctctgttgtacggaaatcaaatgatatggagccagttttctttgcattccatttaggcaaagagatgaaagactctggggtttcaaaggtgattgggtctaaagttgcaacattctcacatttaaatgccaccactccatggatcttcatcttaggatctccttgcttggcaagtcgagataattccagcctcacatcattatttttatatacaacctgtgggcagaggatagcagtgagaaactagcctccatattttaatatctgaaacttgtgaacagctcatgtaactttcaacgacatcataaaaaggcacacgatatttagttaattttgttgtataaaggcaacatttctcaggcaaataaaattcaagtgtcaattcatagaacaataaccataacaacttaacttgattcaaataatgtgtgtgcagatgcacccgcgcatgtgcatatacacacaaactgcttgtatttaactcaaataatttaaaaatctgcatatatctttaatttcatgtctacattaccatgctaagacttgaacttataaaagctacttgtttcatagttgtctatgatatttttaaaattaaatataagcactgaggttattcagttttcccatcattaaagcatttgaaattggataccattatataccagtcccctaaaatattggatctcttctattatctatatatctgctgtggatattgactttgcaagacagtcacaacaagttaaagcacaaaacagcctgacatttctcagaaaaaaaatatataactaagatacagaagatccctgacctgcatcaatacctttgaatactgttaagtaatgtggcactgccacatgtagaatatggtgcttcccctcaatttattcaacctgtgttactggtgatccatttcacttttaatttacacaaatgctgcgcaagggttgtcttgtactctcattttccaaggcacttcagtgaaagaggctaggcacttctgagtgcttactgatggtcctaaggctttttggattccaattaacacatttgataattcactgacagggttcacggtatcatacatttgctatcccttcacgctaataaattcaaaggtattttgacataaggataaagagagaaggacaccttttctctacaaaatgcatacagtggataatcacatttctaaaatacatagaccatacttacttgagggtgaattagttatctaggtccacatagctgtctaggctctttcaagaagggactctatagatttcaaagctcccaacattgctagactctagatttatttatccacatgtaaaaatgtacatatatatatatgtatatgtatacacacatgtatgttttgtttttcatttttcaggaatggcatgggtgttttatataatatatgtaacaggaaaaataagacagcctgtatctgattagcgctatgaagtcaaccaagacaacgcagcagttattccaaacccatggccaactgaaccaagagatggctgatgagtttcctgataggatttgttaatgaatactttatttttcagagtaattaagagtacatgctctggtattggacttcctgagttcaaattctggctccagcattaccgaactgggaaatctctgtaagcctgtttcactccctgaaaggaaaataatacttcacataatggttataacaattaaataagaaaatacacataagtgggaaaatctacataaaggcattcattccaatgccaatcacattgtaagatttcaataaatattaactacgtaaaatacatgataataaaaatcaatgctttatcatctaatagacacagattttaattctaaatttatccataggaaaacatttagaaataaagcccacacatataattggtttttatacatgatttgtgccaactaaataagtcacatctttccaatgctgggcctggtgtttcagtttacctttatcttggagaaggattataataaagaacatgatatcccttattctttgaacaaatatgtacaatggtttaacaagcatctattgacaacaaaagaagagaaaatgaacttgagcaataacaaaaaggaattacattaattcttaagaatacttttttgaaaagagaaagatctattaagtcttagaaaaatttatttaggattgcctttctttggagatctttagaggcagggaaaatgcttttcaaggatgattttccaagttttatcgcttctctctatgactttcatgctacttaaacctatattatttttcctttttcctattgatttatattccagcatgtggacattcttttgacatagatattgatcaagaataagtattttcagacccaaatgatgcttctcttgatcaatgctaacactcattcttataatagaaccactgtaaaagaattgagtgtttctgacatgaacaagtgggttttagccctggtatattgtctcttgaatctgacatcagccaccacaaagttgaagaatgaggggcagtctaagtctgggcaaggatttcaatgagacataatcttataactgaatcaggtgacttggtgatgaaaaggttcaggaagatgtaaaaaaaatagaagtagggataattccctgggcaaaatttcttaaggttagccatgcatctctcataaaaaaaagtatctccaccagaatcaatgctttatatgctttacactggcaagaaccttgctcaccacagcgcagcaccaagatcagtggctggcacagagtagatgctcaataaatatttgtttatagttgaacaaaattcttccttcacctttttaaacctagtttctagattataggcttttgtaaataacaatatttagacctataattaaaatacagcagaatatggtattgcggaccaatctcataaactaattactattttgccctatttctctagaaaaaagcataaacttatgtgcatatccagttcataattgacaagttggcccatgcattgggaaatttcatcttcacacacattttgtggggtataaattccttttagaacgaagaatgcctgagttaaaactctccagaggtttatacacaaaaatatacactgtgcttctcctcaacatagttcttgtaggtaagaactatctccagatacaagaactctttcctacaagaactatcttgagaagaagcacactatgtatttttttcttcccattttgtactctttgaaaggctactccagaaaacagaaaagcaattttgcattggtaggcttacggctctcagatttacactactatttcatctgacccagattttataattaccctatttttctaaagttagacctactcttaaaatgaactgaatctagttcaattagaataatgagtagctagtaagtattctaactcctctaaaaattcatgtgtaagctatttttgcttctttctgaaacaatgtggcactcaatcatgggaacaccttataattattcatatatttttaattcttatgtcaaaagttgcaatttacatgtttcacttttgaacaagtttctatatgctttatcatcataacaattgatgatatttgtgcacactcatttggatctgtttatagaaccaaggtttctttggggacattgattttttttttttttttaaagagtgattcaaaatgttgaattttacttcctcgcttcatgggcttctttcccatttcttcaaatatttgttagaatttttagtgtccctctcatgttaatatgcaagaatagggcgtaatatgtttgtgttttcacattcctagggtttacctttgaggaaaacaatcactgagtattatctttgatcttaatgataatcctgaaaacatgacagcaatgcagagaaaataaataacttaaagaataggagcttagtagtctgcatattaacttggttcaatctcaaagctattactaagccaagtccctaacctctctctgtctcagtttcttaattttggaaactgacatctataaaggaaaggcgtgccataactataaattcttgagctttttttacccttaatatgtgtgatttgggacagacataaaagatggtcgattgttcctgacccctttctggctttctcctgttgcaatttttgatgccaggatattgttctctactttcagatacactgaaacactaatccattagtaaagagagtgttcactgcatcttctcgtacacagacatgcctcgaggattatatctacctaagttttgtacagatggtgctaaagcactggtagctgatagataaggctctttcaacagagcgggagtatgtgaaattcagtgtgaaaatatttgccactcagataatgactttttaaaataaatatgtgcttcagcttggaaattacaatgggggtcttaacttcactaacatgcatgattaagacttttcattacttaactatggtagtatgcaggatggtgaaataagcgaccaaagttagtgttgtttagatatttagactttgttatgaccctccctgagagaacatgaatgactcatattttaatctatcttggttttatctttcatacttgtggctaataaggagtgaggcctaagaatttggttctcaagtcagatttcagagagaattccagctcactcattttcaaacctgtgaccttgtgcaagttcctcaaccttgccaagtctcaagagttttattcgtaaaggacaatggtatctaccacattaaggttactgtaaataataaattgtattttagttaaagtgctaataatgggtcctagcatggagtaagtgatcaagtaaatactcattgtttttattaacattattataaataacatttcttattcttacattgaattgatggagctacacaatttaattgtcataacaaaggtaacagctaagaaggtagatagcaattgattggtcacatatttaagggaattaaatagtgctgagaccagcaggatcaaaggtattcagcagactggggcttcctttttcatgctgatatttacgttgcagttggatgtacacatcaggctttctctgtaaaattccttaactagaaaatatacacagcaggctagctaacctaggagttgtattttcacccatgaaagggtttctgtggtatctaacaacagcggctaccactatcaccaaagccaccacaacaatcagttaagatttaccagttcactttctggcaggccctcttataagagttttatatatagtaatgtgtttaattcccatatgcatcctagaaaataggtataattatttcctattaccataagttacctagaaaataggtaacattattctactttatcaataaatatctggaggcacagagtgactgcatgtctttcttcatgatcatgtctaatcctgtttgaatacctaatgaccttaacctcaaactttatctttgtttcagtaggaaatttgtcttcgtttttgatagcagttgctaagtagattcacaatcaaacagctgtttgtcattaggcaaaatgataacctttcaatgagttacatgtgcgttctaaataccagtatttttccttcatttgttgtcattaaaatatctctaagtgaatcaaatgtcacaagtaagtagaggaatttattgtgtatctactgattaaaatgtcccttcaagtccagttatagcagagggcctatttctgtttccaagatgatattgtagtttttcaacaggtatgtcatttagaatgtaacaaacgttatcttaaaaatctgtgcggtttaaaaattatttaaagggactgttgctttaatgctgatttttgtttgtttatttgtttaaaatgcagttaatgcttttactctattaagaccaagtgaaggccgagcgcagtggctcaggcctgtaatcccagcactttgggaggccgaggagggcggatcatggaggagggcggatcacgaggtcaggagatcgagatagagaccatcctggctaacacggtgaaaccctatctctactaaaaatacagaaaattagccgggtgtggtggcgggcacctgtagtcccagctacttgggaggctgaggcaggagaagggtgtgaacctgggaggcagaccttgcagtgagccgagatcgcaccactgcactccagcctgggtgacagagtgagactccgtctcaaaaaataaataaataaataaataaatatcaagtgaaaatatttatttcaagtaccagaatttaattatcattttcacctagctgttatctttctacgcaccatctccttatatcagtgcactgtgtcaaaatacaaccaggaactagccagcaagtgaaaagtacaagcgtcatccagtaagtagcagataaattgcatttgctttgccatgatctgggtaagaaagagctcagaaaaggaaatgcagcatattacaactttcatccccaacattaacttatttattattttgaaattatgtttcaattctgacacttccaattcaatcagacacgcactttttagacacgtgctatggtaggatcaatcaaatgcaattttagtcacttccctgtgcatatgcctagttccacagaacatgttacactgaaaataaactaatttaatacgctagtttaatttatcttaaacatttgctagtggtaactatataataggtaaactatatgtgatcaacacatatacacatagacacacacctacacacaaccagagtttaaacattacccagatacactatatgtcaaatttaatgtcattgatatccatataaatatgcacttatgttagaatatatggtatatctctcaacagatatatagataagtagataatacatacctatgtatgtcagagacataacaaaatataaatacattaacaatatttgataatttcaaaaaattagaaatttgaaaatttcaaaaattagaaatttggtttaagcacaaagatggtcctactcattttgtatcaaaaatgttttggcccaaaagcaaattttagcacatataaagttggtgctttccacaaaaaacaactgtagcctccaaaaattagtattttatgattaaatgaaaggagaaaattagacatttcccttcatgttcctgccaccatgaggagacaatctgaaaagcagaataaaggcaaggtggtcactttttaaaatctttgcacccattattgttttatctcccacccaaaatcaagtttcttatgctattcactttcttacactgaaggtctagcataggacatgattctagcaaaaatgtcaaacactgttgagcttaactgaccaagagagactaataggattttagcttttctgggaatgtcactccatagaaattttcatgtgtagtgtgatatgtccacaggagacaggtgggcatccagtacagtacctacaactgtggagtggctgcgggagggctagtggatagggaagacagtgtagaaaatgaacaagccctgtacaaagtagtctgatgtatgtttatttatttatttatttatttatttatttacttagaagccgtctcactccgtcgcccaggctggagtgcaataatgcaactatgcaacctctgctgcccaggtacaagcaattctcctgcctcagcctctggagtagctgggactacaggcatgtgctaccacgcccggttaattttggatttttagtagagacggggtttcaccattttggccaggctagtctcgaactcctgacctcaagtgatccgcctgctttggcctcccaaactaatgcatctttaaaaacaattcttaccagtaaggaaatttaattttaaagagacatacgtaaataattttgaaaaataagagtgttttgggaaggcagcaagttgatctttttttcccctgatctaatctgattcagagaccatgtacagataatattttcaataaaatatgttatcttctccaaacccaaataccaaaacctgttataaaatggaaatcaaactacagtaatataatttatccacaaaggcatatgacattttatttaaaacaaaaaaatagttaaaaattggagagggaaaaaacaatattttgtttacacaacaaagagaaaaatatttttacctagtctcaattaaatacaaccaaatatatcccattaatcaggggaagaaaaaggaaaagaaaacccctcctgctttgtccttccttcattccagcattcagtgaactgcttaaagttactgagacaacattaggtgcaatctgtagaagttattcatgggagttgaaagactgagttgtccttgggttagcagctctatttatgaagctttcagtgcatatgagtatgtagcagaataacctgagtttcattaaatagttatgtctatttttctcacattagtgattcagtaatgccttttggaaataaatggaaaaatgaaccacaaatgtcagtaatgtgaagtttcagctgaagatctttttgaaatacaaactgcaaacttgatcaattgtcttattttcagatgaggaaactgaggcttaaaaggctagaaggctatccaagttggcatcaatctctgatcaaaataatgtattggggacttcagtgttcagtgttctttcaattttgtgttaaaaaagaaaaaagaacaaggaacaaactctgccataggtccagggttatgaaatgctcttaagcaattacaaacgaagagcagcccactttttagcaacgtgacagaaaaggaactggagcttatttaaaggtgactccaactttaaaactatgttagcttcataataagttgattttcacagacagatataaaagtcctgagggggtaaaaattgcagtaatttcccccaatgatagcatttagaaagacactgaacaagttaactagaatcaataaacttgcaatgttcactactattttaaaaggaagtgatgaagatactttccgcatcagtctttcatgatcttgccgaaagttatctcaccataacttggggttaagagtttctacttcaagccagcagatgctgctaagaaaggcaatgcatgtctgctttatccaaaaaacttttcaatctcctgctagtttcaatgggggaaaagtagcactattattattattttattaggggaacctatcttcccatataccaagaaaatatctttgaactgataataacaaaatagtgacactaaatgatgtgtctagattaatcaatgcatcttcttttgtgtctccagcctcataagctcagtgaagtttcctccaccacttaattttacatttttctaaggaggcagacattagtataagtatataatataccatttagtatatgtatatgcatgtattatagatagattagacaaatatatgatagatatacgatagatagatagatagatagatagatagatagatgatttcctacagtctgtcctttcctcattgatctgcattgacatactatctattgttttggatataccaatgttcactattttaatatattattactttttgatcatgctcatcaattttaagctttgaaaaaaatttctccaagagagatgggataaccaaacaatttcatgtaaaatatttattacttgattatatttatgtgtgtgtgtatgatatatgtattatttttaatccactgaaaatatgttgtcttctgtttaaggtgaaaatccaaattgacttgctccacaaagagttagttatttgaaccagcacatttttttgtccttctttttcttacttcaacactcaggggaacacaatttttaaataattatttttccgacttgtaaggcctaccacatattaaattattacatatatgagattctatggctgagcacgctgttctgttttattgatgtttattttttcttgatctagttccatgtcacctaactgtcacagctttataatatattctaatgtgtgttaggctccttccaatcaaccaacccattaacattaattagcttacaatgtttatacgttataaacattataaacatctcatgtaatttcgcacgttttttccttatgaagatccgttaataaattaccaaaagatataatcagtttattcacttcaataaaaaaaagcaatcactgaatatttttaaatgaccataacttataaatttttttgtcttctgtattgacaaaataaatatacatcacaagttgctttgatctagctttctaaaacatagcaagttatacattcaaatttacttaaggggactttagaatagcccaaggaaattatatcttgctttgaattacattcctattattacaattatttgcaaagttataacgcataaatgagtttgacaattttatcatatcagagaatctggcctcatgccacaacaataatttattagttggaggatagatatacaactatagagatagattaaatcaggaagaaaacaacaacagtgaatgtagttgtaagtgcgctaattctattccaataaacacaggccctggtagagttccttgtaataaaataccaggagtaggtggccagtatataggagttatctggtaaatgagatgaattattctcagtgaagaagaaagtggagtgacctcagactccactttaatggtggctcttttctagaggtgagggtacttgcctgaggtcacactgctattgttcagagggagtcaacagtggacaagatggaatctgaatgtttgcctccagagcctgaaatggactgtttaatttattggttttctttgtatggacagtttttatgatggttaattttcctaaagcaataaaaaaccataggacttctatgcttcctcaacctgatgtttcaagagctggttatccagttggtggattatccaaactgcatgaatcccctttctttccctggctgcctgcctttactgctcaactgcacatccacctaagagcctgcaaacgaaacaggaaaaggtggcatttaagacagccaatgctgatgatgtttttagcaactgcaatgagaacatttttccaagtagacttgttcctgagaagttgtataagtttgttctgtaattttaatataatttgataaaaacaatgtgttataagatttatatttacatatattcaaacagtctcaggtttacattcctgcattgctacttaactacttttactgccttggccaagttgcttattcttactgaaataatttccctctttatcaaatgagattatgaaaacttattttgcaatgttatttaagcacataagtacttgatcctgggtacctaaataaagggtagtcattactgttgctattatgatcttaactgtgtaaggtcttaagggttaagatcttaaatgggtaagaggggagtgttcattatttaaattagtaagtgactactattgaaagcaaagatgcattctgtaaagtaatcacactcaaatcttgatgttgacaaaaatacttctcaaatttcgtaattttatctcatctctctggaactctacattttgactttatctgctaaacaaatagtatttttaaagtaatattttttattttaaatttattaaaggcatataaatgacagaatgagacagtctgtataatgatattaaattgatggaattatagctggatgcaaatacttgttttatttagcttatactgggtggactaaatatatggccttttctaggtttgctaaaatattgaacacatgtaactgttgttcatttctaactaaaagggccctaaaaagtatagagaccccaggttgagaactgttatttttcaattataactgctaagcagtagggtatttctttttaatctattctttaattatttctttggaaagtcccacatgattcagatgtcagatgggttgtgccttttgccaggggttgcttagttaactgtttatttaatgaatggggttttatgtgctactgaatttctcatggcacacgttagaaaatttttggcagcatttaaattggagaactgagaaacatattggctctacggaagctcaatcagctcccaggcaggtgcagagtttttgccaacaaaaattcagtaaaataaaaaatgcaaagcccaaattctcacacaacccaaagaaaactgactttggtgtccaagattaaatgaatgctagatccaggcagctcaggtagctcaagaatggaaggggaaaatgcgtcataactttaggagagaagcaggaatgggaccttcttgttttggtggatgacagtatgcatacatttttggattgctgagaaaattcaactaactcctaaaaaaaaaagaaaagaaagaaaatagtctcatgtaatttcgcacgtcttttccttatgaagatgtgttaataaattaccaaaagatataatcggtttattcacttcaataaaaaaaaaatcattgaatatttttaaatgaccatagcagtcactgagcatcctagaccaagtatccagatggctatgttttttaaatgatttggccagatatatagacattgtataagcattggttaccagatttatttactctgactgggaaccaaaaaatatcctgacatgtcttctgagttctgaaaagtcctaaatgcacatatatataaaattttactcagtagtacaataggatgagaaaaaacaatggaaaatatttttttttaattaaacactagtttgagaaaataaagatgagaatgtatctttcagcaattaaagtgaatagtaccagcctacttatcattactacatgactctccaaactgtgtggaataaaagccatttgcagtcatctcctcccaagtataactgtcatcaactcctcccgtcaatactctgcccttggccagaccatgtcccagcccttctccctgtctggaagggcaatgtcccgagtcaggcttgttcttgatttctcctctcctagatgtagtttctggcaatactggcttattgaagactcctgcattcttgggacaccagtggatattctttagtatcattttcctgctgtattcagaaatggggagggctgtgctcattagcacagcgatgctgacccgacactaggttggccacctcttggtggctacataaacacacgttcctcacttcaggcctagccaacttggctgtcttctatttcggttgtatgttgaacaagtccccagtagacagttcattagagttggccagctacatccactttgcccctaattgcctttgattagcttctacgttgcctggtataattatttttttttaattgagatggagtctcactctgcacccaggctggagtacagtggcatgatctcagctcactgcaacctccgctgcctgggttcaagagattctcatgcctcagcctcccaagtagctgcaactacaggcacgtgccaccacgcccagctatttttttttttttttttgtatttttaatagatacagggtttcgctatgttggccaggctggtctgaaatgcatgacctctggtgatccgcctgcctcagcctcccaaagtgttgggattacaggcgtgagccaccgtgcccagccatcatgttaatatgaatcattacagcacccaacagcaactgtcaagcaccttctctgtgtcccatgcttgttgaacaacaaacttctacgtctcatgacagtcttatgaagtagacatttttatctccatactaaagctcagagaatttaagtattttgtccaaattacacagtaactaggtgactgagcagggatccaactcagcttttatctagcttgattccaaaatcacagatgcgattctagtgcatgctccccaccccatgggatagtagctgagttcctatttacttattcagccctggttctgggcacactttctcaatctcatcatcatgcctttcgtgtatagaagtaaagggactccttatcccttttctctttttcgaccaagtgcctcattaactagctgtggttctcttaacactgctggtaaaaaataatattaataataataatcccccttaggtttcatcctactctctttctctcttgatgtcaggataattgtttttctcctttctgtcctatgcactctgatttagtgtcacacttgttttgtgctcacttcactcttaggaccaaattaccagactacattttaagaaggtacaaacgttgttttgaatgttaagaattctttaagattttctaagttgccttgtaactggagaataaagaatgaggtttaacactaggatgaataacattcaacacatcagttttcaggggtctagagttagatttgatgattacagcctcctgtagtcaataagagaagagagatgtactaaccacacgtagactgggaccatttttttcattgtaactgatgaagcccaaaacagcagggccagaacttgggtgaggggtcaggtaagtgagatactcactttggaacaaaatataaaggaggatgttaaatctcatatcacgacaaatatttcaatgaaatatttttaaaacttaataagaaaaagtccacaatgaacaaggtattcaaattttaaataaagatatagaatctgatttttccttttgcctcaagctccacaatgctttggtagagccctgcaatacaatattattctaagattaatgaactccatttaatacgttggaaacatatttattaaaacaagtgcaagtaactagaatagtgtgggggtaaatttcatcattagatatcattaaaattagaactagaatgcactactaatttttaaggtgtaattagtcattaaaatcacttttattcaaaaataatgacgaacacagagtgtttagtcagacattcttttaaccactttactcatataatcctcatgacaacctgctgatatagtagaaaaggcccactgctacagaattcccaatgtaatattcattaaaatacaatgtctgtggagctgtgcagcacagtgcctctcataaaattagggtccccatttttcagaagaaactgagctcacatagtaagtaccagaatgaaatttagacccagacagtccagatacagagtgcttgttcctaaccatattatagaaacaaaccaagcctctcaaagatcaagtaatgtagcctatttctacctcaacctctgtgtcactagacctcaaattgcaattaacttttaataataatgatcctaagaaactctccaggacactggactagacaaagatttcttgaataataccccataaacgtaggcaaccaaagcaaaaatggacaaatgggatcacattaagttacaaagcttctgcacagcaaaggaaacaataaacaaagtgaagagacaacccacagaatgggagacgatatctgcaaactatccatctgacaagggattaataccagaacatgcagaagtccaaacaactaaataggaaaaagtctaataatctgattttaaaatgggcaaaagatctgaaaagacatttctcaaaaaaggcatacaaatgtcaaagaggtatatgacaagctgctcaacatcactgatcatcagagcaatgcaaatcaaaactgcaatgagatatcaactcattccagttaaaatgccttttatccaaacacaagcaataacaagtgatggtgagaatgtggtgaaaagggaaacccttgtacactgtttgtgggaatgtaaattagtacaaccactacagagaacagtttggagtttcctcaaaaaaactaaaaatagaactaccatatgatccagcaacccactagtatatatatacctcaaagaaaggaaatcaatatatcaagaatatatctgcattcccatgtttattgaaacactagtcacaatagccaagatttggaagcaacctaagtgtccaccaacagacaaatcaataaggaaaatgtagtatatatacacaatgaataattatttatccataaaaaagaatgggattctgtcatttgtaacaacatggctgaaactggaggtcatattgttaagtgaaataagccaggcatagaaaggcaaacgttgcatgttttcacctatttctgggagctaaaagttaaaacaattgaattcatagagactaaaaggatggataccggggcctgggaagggtagtgggggttgggagaagtggggatggttaatgggaacaaaaatataattagacagaatgaataagttctagtatttgatatcacaacagtgtgactgtagtcaacaataatatattgtacattttaaaataactaaaagagtgtaattggattatctgtaacacaggaaaggataaatgcttgaggtgatgtataccccagttaccttcatgtgatcattaggcattgcatacctgtatcaaaatatcttatgtactccataaacacttagtatgtactcagaaaaattaaaaataaaagaaaataatgaccccaagagtagattctgccataaattttacagaaaccagtcaaaatttgttatatatattatatgtaatataaacacatatgtatgtgtgtataatacatatataatacatatgatgactcgccattgaaataaccttgagagtcactcatactaacttaagaactgcaatccatctctgatattcacccgtctacaggccaaatacagaaactagactaaatacctaaggtatttttataaaattgtgatggatactaattctgcagctcacaggcattgaaaggccaattgaattcagacccctggccctgtcattaacttctgcaggtgtataactggtattcttgtatcagacagccaatgtcatcaaaatggaatacaacaaattgttatataaaacattttagctctccacattaagtagcattataattatatgatgaaaccagagcactgtgaaggattataaaaaagattaaagaattcagaataaacacttgagaccttgtctaatacggatgctctcaagtaactactgttgccaattaacgctgctcatatacatgtggatttctgattatctggtttactactaaattaaagagcaaaaaataaaaaataaaatctctaatgcctctactgtagaatatttctattgatattttggagggatctataagaagccaatatcaaagcaggaatgtcttttagaaacaagatagatcaagcttgtctcttgagaacatgttattctagagaggaagaaggagtaagacatgggctggcagcagagtactgggggcggggggaagaatcaaagacagagaaatccagtggaagtaaagtatacgaggcctttatgctacacaaaatggtgggcatttccatagcactggtacacaggttggtgctgttaatcataccttattaattgctattagtaatctcatttagaattaatttcttataagtatcgtaaatccaataatctgctccttcctccttatgctaacatatcacaagagaaaaattttaccctttgtgaatttagaggtgttttcatgactagatgacttattcaagttagcactttgtgtgaatctttgctttgctgtgtggttgagtggcagaaagcaactgtaagcccaggagctatgttgacatgtgtctcactggtcaaataaggaattagatatgaatgtgtataaattatattaaacccatccagactggaggaaaacaacctatttgataacaaatttataacatggcagtcatgttatatatatataacatagcaatgctcatataatcctgagtcttgttaaaataaagactcaaagtgctgctacagactgtaggatatgatttattttgatatcaaagtgttttccgcagcttggttacctttgtgatttggatcagggaaaggtgtgtaccctatcaccttaccctatgctagatagatgtaaattttccacagaaagaagtggtttgggtagtcactcagttactagattcagctgtttttgaccaagccacaagaaataactcagtaaacaaaaactctttgagaagcaggtctaagtttaaatcccaaatcagaatgcctacactggaggaaaaaatcagtttttactggccatggctttagctataggcccaaggatctgtttcttggagagtctagttgataccaggaaggagatagtagttaaaattaatgcaatataaaatgtttcccacagtgatgcttaagtgaacacaagaacaaccctaatagctgattgcttcagaaaagtaaaatataaatggtcattcagaacaacaggtttgcacaggagaagaaactcagtaagtcacgagtttgaagaattgtattaagtttcctgggtcttaagaagaagtggcttctacattcttagacacaatgaggatgaaaagtttgaggttaaacctgtgtattttcattctctgtcaccttaattactcaaggtctcagtgtatttttgtctagtgtactatctctgtccttgttgtttcttgattctcctacccactgaatctatggctgagcacatttgataagtgtgtagttctgttcagtttcggatctgctaagatatttttaaagtacatagtgagatcataaaatgagatttttttttttggtttgaaaaattttgggggacaaataatatttaaaaactgtcaatgtttccacatttcaacattagatgggaggtgcctaggaaccatagagtatattgcagaaaagcaaataactaaaatgcctcaagggaagttcctgcaacacagagaaaagaaaaccattcagatgcttgggggaaaagcttagaaaaagggaaaaacaaaaagaggcagctggggtggccttcctccccaacagagctgaacctaagaacatccagataaaaccagagtcagaaaatactggtgttggttccacattcatggggaactctgaaagcctctcagagtaatctcgatttttggcagggtactctatcagtcaaggcctaggagtagatgtggtaattgcagaagggagttatattagagaagccccaaagactctggcgggttgcagagaagtcctttgtattttcaggtggacccagagaaaacaggaggactaaggggtcagcagaggtctggagctcacgcaaggagtcttccagaatcttgagcctgaaggcaaccacaaaaccccatgtcctgaagggcatgcacatactgtgcccaaacaaccagccaggtcattttctaatgcttaaaacatgaggtcaataccagacaggtgataaatatgatgctataccaaattctgctgccagaaatcctctccaatgcgctctggataaaaagatatattaataattatactgttttgttttttaatgtctgatctagctccttctgtttttgcaagcatacttcttagtggtttctttcataagaatagacttatttagcccatctaatatatgaatgatttcaaagttaatgttaacaataatagccatcactgattatttccaatatgtaccagtcagtatgcattgcagccattatcattaattgttatatcaattctctgatgtaggctttttctatccccattttcagatatcaaaagttaggtaactttcctgaagctgcacagctagtaataactcattccactgtatcacaccaaattacaacaaatgatttctaacaagtgataaaccctgacaacctctgagaacgaaaaggccagagaattagaagttaataaaacttactttatttttccctattcaacatttgtattcaagattatttattttcttagtggtcaaaacctactaggtactagaatgagggtcaaggtattgagacattttgtttctagtttcagctctttcattaattgtgtgaatttgagcaagtatctttattgctttttcatctgttcagtcaggataacaactgcctcattttactctcagtattatatgtatttctagccttgtcttaattgaaatacaattggataatatgcaatgtacttttacggtgagttaaaaatgcattattatattcacatataaaattatatcagtccaggcatggtggctcatacctgtaatcctagtactttgggaggttggggcaggaggattgcttgagctcaggagttcgagaccagcctaggcaacatagcaaaacctcatctctattaaaaaaatagttggacatggtgatgtgcatctgcagtcccagctactcaggaggctgaggcagaaggatcgcttgagcttgtggggttaaggctgcaatgaaccgtaactgcaccactgcactccagcctgggtgacagagagacactctgtctttaaaaaaaaaaaacggaatctaaagtcaaacacatggatctctgcctaggtctcagatgaaggacctggatgggaaaacatctcatttctaagtctatgtgggagtggtaacttttaaattaatttataagaaatataaatgtattagaaggtataaggttaactattagatagttaattattagaacatttcagatgctaacaatcaaatatgatatttttatccatattacaaccaagttaaggtaagaaatgaaacagcatctcattggggtggaatcccaaagagatgtaaacctgagtagtttcaaaatatgtgatggagaatttgaaaatctgcgcttatagattctgccaacagcggatggaagatatttgaaaataataataataataataataaatacaataataaaatgatacaaataaacaatgcactgtaacaactatttacatggtatttacattgtattaggtattataagtaatctagagatgatttaaagtatacaagagaatgtgcctaggttatatgaaaatactacacctatttaacataagggacctgagtaactacaaattttgccatgtggatgaggaggggtcatggaaccaatccccctcagatggttatatcatataacaaacatatgtcttgttatttgtgttgttgcatatttaagaagtctccaacagtttttcccaggactgggttttaaaaggccttaatctactgataaaagctttgtgcttaccctaaaaagtagtcctcctttacttcttttctagcatgtcaagaaagaaacacccaggaagacattagacaccctatgcatataaaaatggcaataaaagaaagccccaaatgccatctaaccaatagaagtagaataaattggtgggcattttacattcacttaaatatccaaatgatttaagaggatgtcgctaaaaattggctgatatattggcttttgtaaaaaaaaaaaatctgaattgaaatttggatatgaaccaaaagcttccgtcttcaaggacttttcaatttcctccagtttgcacgtttggaaactgaacggttcagcatatctctaataaaaaaatcatctcccaaggctcctttcctatgcaggcaaaatcaaattaacttcaaacagaagaggtgagatgcatacatagaggaagtatcaaactctaacatcactttgctccagctctctaaggtctcctaacgtctacctaggagagaaatccaaatgttaacttcacccaagatcactctgaaaaatctaaagagaagtgtggcttccaaaagagaatcatactaaattaattattcccctatgctgtcaggatttgcattgacaacaccatacggtagtattctggacttttacttaagaagtgatgacagccaacaagattccaggctccattcaaaggctacaaattgtgcggcacccttgccttgctagctgggcagccatttgaatcaggggattcttgtgctttggctgcagaagttgaaatgatgctctgtatcgtttgagacatgaactgctgcgtgcacaccacacaacgtcccccagcaatgatgcattgcactaatatgctctcagagcatactcactgggatgtattagagcaatgtatcaccaaaacacttaacttacaggatgtattgccacgtgaggtggaaatggttgccaatgaggtgttttaaagataatttctaaagttgtgtattaaatgatgtttatgtcacctttctggtgatttggaagataacattttgagattctgttatgcttgatctttggtattcagtgccttttccccctcacaaaagcactcttattgcagatcatttttaatcggaaaactcagtaattgagcttcacctaagtgtgacacaaaatgaatgaagtttgtgtgcattgctgtgcaatcagccctgaaattcagttgtgggcataagccctggtgctgggctgcatcttccccagggtgggcgacatatgggctagcagtaggccctgggcagaaaacatgagagccaggtagggatgctccctagaggcagaaagctctctctgcaggcacctacttcctctgttccaatcccgcataccgtttaatgacaggctctgtattgctatagttatgtgtgccaaagaattctgatctctctttttattgcctaattttattagataaaaggatggagtaacattagaaaactagcaatttacaaattctaaaaatagatattagagtttctcttattatatatatttttcagattggctaaaatatgttgctggatacccatttcataaggacagagtccacatctgttttgcttaccatttttccccagtacaccatgtctgacttgtagaaagtgttcaataaatgtttattcaatgcattaatagtcatgcttcccttttacagtagagctatttcatcacaactttttctttggaggcaaagcatgacttctttcaagcagaattgccctctctcgtaaccagaaatcaaattgcatctaataatgttacatcatggcagttacttttgaaagagttgttctaacctctagaccttgcttaaagccaacctaggatctttataaatatttatttataaaaacatgtgaaaaagacagcagggagggggagaaagaaagaaacaatgtgattattactagtatttaccagtgcatttaaacttcactagattcatttgaaaatatgtttccatacacatattttcagaaaagtctttattttgtaaagagatatccacacatatgcacatagttaaagctgcagcagtgactacaaatagatcagaaaaaatcatatatggcttatacaattagtgttctcatgtcataatcatattttgtatactgcagttttttagttatggtagtgacaaatttcctggtatatttcctcctcagtaatagattttttttggcatttttgacagtgtcatatattctagtgtccaatataaaacaaaacaaaaccctataattcctttttatagttgcatttcaaactaataccagtgcattcctgattctcttcctattaaatcatgtttttactcttttttccccctcatttcattgtacatcataggtctccaaaatagctttgattttaagctacctaaagaaaaacatttttttacttgtaaattcaatagcctctctttcattaattaccagacacacacaaacacatacatacccctcttgaaaatgcttccagttctcttttatacattctatataaaatagatgtaagacttgcattgccaaggctgaatttgttcgtatccagctgggtcagggtataatatgatggcagctccttttttaaagcattgtcaatttatatttctcctaaaagatggctttcctgacctcccttttaactttctcattctcatccctctggctttttccctctttacctattctcttcccccaacctcctctgtggttaagtagctcttctttggggctttaattagtaaatactgcacctctatgatgtaatttattatattcttgctaatcttttctgacattttaatgataagctcctggtcatcagcagccatattctcatccaaaacttgtatctatattcccactatggcaagtgatagactgctactatttggttgtgaattttctgaaccattattacgttttcaaatctcagcattttttcacctaaagatgattcttggtgagacgcttcacatgcagaaatcaatgaataagtaatgtaagctgagagacaactctgaaactattatggggacgtaaaagattaaattagaacattcattttttgtcctgttactggcacaaataaaatatttgaaatccaaaagaaaatgttgttaatctgtaaatataaaataagtctcatcaactgtaatagataaatgttagctgcatatacactagttgtctaaaaaaaaaaaacaaagattactggcaaaagtatctaattctatgtctcattagacctttatgattgatttcccgcagtatcactgcacggcagcattccatattttagttcctaagatcacattatatatggaattccagtttttctttgtttcacttatgtgtttagctgaagaacattactaagtactttttcaacctgcggccaaggttaacaccgtgtaaaaatgccaataaaggagaatatactccattatatctattgttatgatcaacaacttgggacatatataaagaaaattctgccataatacatttagtcacggtaatagtacctgactgaaacacacacacacacacacacacacacacacactaaatggtatgtcttttgaaaggaaataactaaattaaagtcatagcaatccagaatagtgatatatgtgttgggaagcccaagtttttaggagatggaataaattgttaaaacagttactaaccaataattttagctataatatgcaataatgtcatctaattatctttttgttggagcacttgtgcatagatagatactataaagtctgacgtgagttccttaaattatatttaaatgtagattaaaagctaggaaaattgacattcagatttagcaaagaaagaatagtattttcctactataatgttacaaaaccattaaagactacaatttggtactgctcattccacaacaagttgttgcagaatattatgaggacacaacggccctgaaaatcttcatttccaatattaaatccaatgctctagactttcttgtgctttttgtttttagagcccttgaacaaaactaaacaaactttcaatttctcttaaatcactctttttgatttgttcatagcaagagcatagtgtcttggactccggaaaggctcagttccagaaagtccacataggaagggttaataaaacaacgtttgataggggtacttaggaggattcttttgaagctgcatttgtacagcaagcccataactttttaaaaaatttgttttgaggtcatgggagattcatatagaattgtaataaatagtgcagagagatcctgtgtgatcattactcactttccctgaatggtaacgtctttcaaaactatagtacaatatcacaaccagggtatttacataaacacagtctacctatcttaattcagatcctttacttttatactcatgtgaatgtgtgtagctgtgcatgtgtgtatttaatttcatatcattttatcacatgtataggcttgtatatccaccatcaccatccctcatttttaacagtgtatgttataataaattaaaaaaaatgctaaagctttttaatttatattctagatctagatagataaaaagctaaagctttttaatttatattctagatctagatctagacaggcatgagatataaatcattcatattattattattttgattggggtcactggaaaggcattgatgagaatattacatgaacgaaatccacgcctccccctacaacttgctctcaacactgagggcatctggggttagacttcaattagataccatgtaaccatcacttcttacctgcagcacacatttcattttcagatttattttcccttaagctgcatttcctattttgacatgcttctctacagaaatcatccaagatattaatattttcttaagtcatatgatcctaatcttaatgtcataaaccccatccacaaactgtgggtagagcgaaatgaggcgtcttgttttgcaccagtttttaaagcagagcaagtgctttttgggctacaggaccaggaggaaaactgattattagctattgttttctgatactaagtctaggatgggattgattacattttgtacttttattctagaggtgatgtgactaaataggaaagcctgtattagactcctaaggagacaaaaaagccacaaagaaccctaatctaatttagagtgtgatgcagggcatggtggctgatgcccgttatcctggtacttcggaaggccgaggcaggaggattgcttgaacccagtttgagatcagcctgggcaacacagtctctaccaaaaacaagcaaaattagtcaggtgtggtggcatgtgcctatagtcctagctatttgggaacctgaggtgggaggatcgcttaactctgggagattgaggctatagtgagccaagatcacaccactgcacttaagcctaggaagaccctgtcttaaaacaaatacaaaaataaaaaaatatatatattttggagtgtgagtgtagaggaagtgagttgggagttcactgtataatgaatacagcaagattcacaaggttgcattattgtcatccagctttttcataaatatgcatgtaatatgaaggtgaatctagtaggagaatatgacaatcctaccactggaaaaagcaattgaacatcaggtgcatccttgtccgagatctacataagaaagatggcaatgtcactaaagttatcatgaaagggttatattttctgatgggggattcttcagaagaatgttttcaagcagcaaggagatttttctgattgaaattatttatttgctttatttcccttcttgcacaatcttttcccatgaggtttgagaacaggtcttattcttctttatatttccctcagattttagactggctagttacatgaaataactattcaataaatatttacagaattatatcatgcctaaatttcatatttcctgaagaaaatgcacacccatattttaaaagaaaacagaagttggaaaacagacctgcaaattataaactcagaaatcgatgtcatccaatgtatgatgctgggtctattttttaattttagctccgttgtttattgcaagcatccatccttcctataaatccccacacctacatccataaacaaagctagctgaaacccacagcgatctgggtttcaacgtgtttcaaaataaaatcatttaaaaatgatcagacattaattcaacacattggtgttaattaactaaggtctgaaaatgtctataattatttttagttgttacttgattaacatagagaagtatatcactattattttctctagaaataaaactgagtgggacagattatgagacacttctgactcacctagttctccaaaagatgctggaacagagagctacgtatgaacaagaaatgtgtcaagtgaaggaaggttggaagaaagtagaggggtatatgctggacaaaagactactcaacccagtagtcaacacattctagatatctgaaaactgagttttccctctcctttgtggcagtctggttcaagagggtattgttctctctccactgcttgtctcctcataaatcatctgagcagaagggcttatttccatgctatgttcacagctactataccgtctagaacactactgggtctaaatacatactaatgaaaataatggagagaaattaaatataagttgctatagtcccaaaagaactcttagaatatggccatacacatgagtaaattaccttaatcgaaggtaatataaccttgaaaatgtaacaattcctttaaaagtattaaaaaatacttttttggaggacaatatactatgctgagacaaatcaacagaattatgagttttggatttgacattcagcattctcatttacatttgacacctataaaacagaaatatataaatttatgaatacacagaagttccctaaggacagtgatttttgtctatctgctgtatttcttgaattctattgtctggcactcaaacatatatgctgaatggatttataattaaaaataaaaatgtttggctagtgaaaatatcctttcttggcctacagttttcaggttaatgtggcagcacctcgtatctatgcatgccaaaaccctaataatgataatccaaataataacactcatattgctattcccactttattggatagcttatgtttctctcttcaaataattaaaactcaaataaattaaactggccatatttcaccatccctcagattcataggtaatataaaggataaatcagtagcccagtaagagacaactaaaaggttgaatttattattctttgcaaccaataagtatgggctgagttcttaaacaagagttttctgtgataatttttattaggtgcaaagggaactaatgaggagaaataggtttaaattgaaggtgagaatttggagggatcatgagaaagaatgtcatgatgatgacagaatggtactagcaagagtctttggagtcttttgagagtgtcaaggacagagtgggcagctacctgttctggacaataagacatctagctagaaatgatggagccaaaccaggttatctttaagagctcaaataaagtaactgatttatccaagagcatacagttacttagaggcagatccaagactatatgccatgtatataaactaggtgcgcttggaaccatgggctaggtcatggtggagagtgacatcttaaaaatgttaaaaaagctatgccgtatacatagtaatatttcactctagtacatcatcacagagagaatatggcttttctgacataaatagtcataaattagtgaaatctgtttgagaacatacaagccccctgttcgcaccaatttagttttgttaataaccgggaagatttggttgatcttcagaaagttttcttagctgcaggattagcaaaaggattcctcgctataaattgcagctttgatttgaaatattagtttaatagatggctaacatctttcagatcctaaaaataagtaataaaaaattactttgcagggcacaagggctcacgcttataatcccagcactttgagaggtggaggactgctagagctcaggagttcaaaaccagcctgggcagcatgccaaatcctctcacctgtggtcccagctacttggcaggctgatgtgggaggttcgcttgagccagggaggcagaggttgcagtgagccgcgactgtgccactgcacaccagcctgggtaagagtgagactcgtctccaaaaaaaaaaaaaaaaaaaaaaaaaattatttaccaggtgaaagaaagaaaacagaagagaataaaacaaaaatagcaaagaggaaacaactacgaacagagacaggggaagccactagcaaaactagcacataaacataggctacgtagcatctctgttctttattaaccacactttgggatctgccagaaaaaaaaaaaaaatcaaagtaccttatatatttaggtttgtgtttatttctaaaatacttatatgacaaaagtactacctcatatcaaaatattaaaacagctttgatggcttccagttcccccgctgaaccatatggtttcagttgggtttcagttgcccatcaacccccgcaatagctatcagaaccagtcccacgtaccttacttcacagctgtcactcacttgcaaaaattctaatgtctaatcacagtacacttgggttatttccctaaggaacccacactttgtatatattgtctctctccctctctttcttctctcttttctctctgatcccattattcattctattcattcaatactttcacctcccacctagttttttttttttcttttagagacaagttctgccgctgttacccaggctgcaattcagcggcatgatctcagctcactgcagcctcaaactcctaggttcaagcaagcctcccatttcagcctcccaagtagctgggactacagacacctggctaattttgtttttaattttagtagagacaagttctcactatgttgcctaggctggtctcaaacttgtgagctcaagagatcctcttgcctcagcctcccaaactgctggaattacaggtgtgagccaccacacctagcgcctctaccttttaacctgattaacctactcacctttcagaactcaggtacatcaaagctaaaaaccgttccctaaaatcctcctctgggattcttacagcaccaagggtgtactcctatcatagaatgacaatgaactgttgcatttgtctccatacctgccagtttccacaaggaatgttacatttactgaggttagagactacatcatgttaatttttgtatcttactgcctagcacaacactcgatatataggggtactcatctaatgtttgaagactgagtaaatagccaagatttattgagcaccttctgtacccgaagtggtacaggcattgtactaaggatattatattcaaggttcacagaatctatcaattccttctcccaatctagaattttctttgaagaccccgaccagatgtcctagccctcaccatcttccaactatcaataattagttagccatgcctctggcacatgcaaaaagtaagatgatgatacacaaaatattaacataaaattattacaagtatctcttccactgtatcatgtgcttaaaatccctgatttctattcctcaccttgaccccaagtgactagtgatgagctggacatttggttggagcccaataaatgtttgttgaatcacaaccatggaattgacaagagtctagtgatctttttcctcttctaaccatacagaaagaaaaagtctacccagtatactgcattaatacgtccttgaaaaattctgatttctagtttgggcctcaggatacttttgaaggagagtgaagaggttatgtctttgaattaggagagaaataatttcaccataaatccccaaagataatgggttcaaaggtatgttgccctaagaaagttattttatttttgtttgaggcaagccgaaaactatcccttcaactcaatatgctaaaaagatatccttcaactcaatatgctaagttgtttgtgtggccatatgttcctatatttctaggtcagtcttgatcaaatacttttcttccatgcaccccataaatacacttgtactcatcagcccatctgtcctgctttccttggcttggaaactgtggtcattgaaaaagttctatttattccctaccaaccatctatctttttttatgtttaacaattttaaaattatttacactccctttctgaacaaaaggaataaatgggcagctattggcaaagaagataaatatgatgagctattctatgttgacatcaaatgacttagcaaagtgcaagtggtggagcaaagaagagcaggttttctcctcatagtttaagggttctgttaccttaggttggtaaaccaaaatgaactggtcttggaatgttcaaggtcagtattgatgctgccactatagtttggtatgctggtttaaaatgctgcaaccacagtatatctacatgaatgtgatggaaatatgagagttcacagtatatctatatgaatgtgatggaaatatgagaatctcagccccatgtagaaatgagaaggtaaatgtatcccatacacaaaataaaatagatgaataattctgggatgttctcgagtgtggcatatagtcactgacatggtcactgcagtttgatgctgtttctcaaacttgagtcgtgcacacaaagttttttttcataaaaataaaagttttaggtccctaagaataaatttacatacctcaccctcttcccacagatcctgagcattctgatttgaaaaataatgtagtagtagtttagcccatgaattctagtatcagatctggattcggtgttcggtgtgcttagtaaccgcaaaacgttaggcaagttaacctttctaaacctcagtttcttcacatgtaagaccgggacaaaaaaaccactacccttaagtaaaataagccagacacaaaaatacaaatattgtatgattccacctatatgcagtatctaaagtagtcaactccagagaaacagaaagtagaatgatggttaccaggggcttgtgggagaagaatatgtggtgttgtttaatgggtgtagattatcagttttgcaagatgaaaaagttttggatatctgttgctcaacaatgtgaatatacttaacgctaatgaattatatactaaaaaatggtcaagatagtaaattttatgtaatttgttttttatgattaaaaataatacatgcccaacaggattacaagaaaactaaattttaaaatatgaatataaagtactttacctaatacttggcaaagtcaatgcactttataaatagaggctattgaaaataaagcaatcaaaattttcaaaagtaataagcacacagaaatttctactgattccagtaaacaattttcattccctagtcactatttttaattggtttttgatggggcctcagtcaagaagagcagtgtactcattcagatgattcattcatattgccaacttcagtgattgccatgaaccctgttctttcagtgaagcagtaagtggtaacttgagaagtgccagcctcctaagaggggtcactgagttacatttggtcacatctactcaggcattctggtaggcaacaaccatttcaaaaaacctactgagcagagccacacagattttctttcttctggagaaaatgggctggtgacatgtctgttatttgaagcaagaagccaaagtccttctcaaattgactcccactcttacctcgctgatacatcctttctcacttaatttgctccatctacattagcctttttcagtatgtctgaaatgccccaaacctacttaccctccagggtgtttgcacttgctgttctttctacccagaacgttcttcctcaatatagccaaagggatcaccctcataccttcttcaagtttttgctcacatgccactttttcagtgtagctctctgtgaacatcttataaaaataattgccaccatcttcttcttctggcccagggacatgtacttaattatttccacagtaataacagccacagataaattatatattttaaaaatttatctagtgtctgtctccttccagtatagtacaagctctataaaggtaggagtcattttcccttttgttccctattgtataccgacctataatagtgtctggtataaagtatgcacatattaaattttttaatgagtgaatgtattggtgcaagccttattcaatatattaaaaaaaaaagtagactaatcaaaagtattctccccacaaaagaaacatctaagaaaaattagtggcttcacaagcatacccttattaagttattttccattaaactcaagcccttttccagttcagtgagaggtcttctgtttctctaccattaccctaagtggaaggggttggaaaacatagaagctaacacctcaacagttgttgaaaccaatttgggaatgtagaggtacaggtagataaatgtagttaataatgtattcatttacaataatacaaatttcctgttatagtaattagctttatgaaaatattccttagattcctggtttatgctagaaaataaaatgtctataaatattattatatttgccattggtgtcaatacatggcttctgttttgtattaggaaagataatttccaaagaaagaaaatactagaaagaattcacaacagtgagacacaaatcctgagttccaatgcaatcttgtctctacccagctccctgaccttgggcgagacacaatcttttggtgtgtctggctgtaacagttgggttttgctgcaaacctacttaactccagtgagcctcgatttcctcattggtgaagcgagcataagaatccctgttttggccaggcatggtggctcacacctgtaatcccaactctttgggaggctgatgtgggcagatcacttgagaacaggagtttgagaccaacctgggcaacatggtgaaacaccgtctccactaaaaatacaaaaattagccaggcatggtggtgtacacctgtggtcctagctactcaggaggctgaggagggaggctcacttgagcccaggatggggaggttgcagtgagccatgttcaggtcactgcactatagcctgggtgacaaagcaagaccctgtcttaaaaaaagaatccctgttttccctattgcagaaagttgccttgtaactgaaaaccaagactcataccatcggtgatatgctaggtgaagttaagtggttcaaaaactgtatttaatttctgaattatagttatttggatgtgtacttggagggaaaaaagtataactagcatattaaaattgtaaatatatgaataatatttaggatgagattaatttcaaaagtaaattgtttaaatgtaaaatattaattaaatgataagatagagaatacatatatatgtctcaattatgaaagtgatatacatataaatggggtttgtgaaaaaaagcttgaagaatcaatgttgatggtttgtgaattttctttccaaagttaacagtacaagccagggtaagatggtatttatatattaagacaaatgcaaacaaaataagatgaaaataaatgtaaataatatgaagtattatgattattttagtaagaaatgatcttctttgtgagtgcctattatattctaggcactcaataagactaggcattttatctgttagctaaatgcttgctagcaaactgactgcaattgagttagagcaagttgattgtttcctacatcatacatccaggccataaatccagttttgctgattctagcctatgttctaggagagttaaaattttagaaacagcatccagaattcaataaatatatgtttttaaaaaaccaaaaggcaaattccgcaaatgaataagctgctttttttaacatgctcctgatggctccctatggcaatactgtggaaaaatagaatctgagccttatgaacaggaaataataaaaaataacattaaactaaatagtaactgtgacactgggtctttgacagagctcaaagattctgcacctcatgaaatcatatattttaatgggaagtgtgtagaacatatacagtgtgtataaacattgtgacagtataggaagtaactaacaggaactctagagtgctgaatgtctgactcctccgacttcatccattactgaaaaatttgtaatggtaaaaacgtgccttcagtaagttatagtatttctgttctagtctgttcttgtctatttattggctttttggagtttacctagttacctattttctctgagtcttaattttctcagattaattagaaattagttatatttcatcattagatatctaatgatgagtttgctagtacaatgccggttagactacccacagtgaagaggaagatgaaccctacggctcagagtaccgcggcagatcatttgatgttacttctgtgaagcgtagcaagtcaactaaatactttgacgccagtggaaatggcgataattatagtagcggaggtgaagtaggctcgtgtatccacgtctatccctactgtgaatatatgatgagctcatacaataaatcctaggaaaccaattgatttcatagctcagactatgcccatatacccgaatggttctttttttccagaatagtatgttacgatatgggaaattatcccgaagcccggtaggatgagaatatagactttggggtgaccgaagaatcaaaataggtgttggtacaggatagggtctccccctccgactggatcaaagaaggtggtatcaaggttgtggtctgttaataatatagtaatgccagcggccaggactggaagggagaggaggagtaggactgctgtgattaggacggatcagacaaagaggggtgtttggtattgagatatggcagggggtttatgttaataattgtcacaatgaagttaatagcccctagaatggaggagatacctgctagatgcagggagaaaatggtcaggtctacagaggctcctgggtgggagtagtttcctgctaaggaaggatcaactgtccagcccgttccaggtggacatggctcactgcaacctccccatcctgggctcaagtgagcctctctcctcagcctcctgagtagctaggaccacaggtgtgaaccaccatgcctggctaatttttgtattcttagtggagacgtttcaccatgttgcccaggttggtctcaaactcctgttctcaagtgatctgcccacatcagactcccaaagagttgggattacaggtgtgagccaccatgcctggccaaaacagggattcttatgctcactttaccaatgaggaaatcaaggctcactggagttaagtaggtttgcagcaaaacccaactgttatagccagacacaccaaaagactgtgtcttgcccaaggtcagggagctgggtagagacaagattggcactggaactgcaaatgcctatgatttgcctgaaaatagaagggagggatctaactattgtctgtttcctaggcacgtgcaccctcattagactgtaagcaccacatgaagtcagaaaccattaggttttattcactattatatccttaatacctggaatacagcagatttttcataagtatctgaatgaatgtatacacaaatgaatagaatgtatttatggaacacctgtcatgtgacaataactgtgtaaggttcattgctcaagtatgaagcatagtaaaataaatgaagacaatatgtaagttttaaaacaccttgtaaatgtaaaatgctacaaaagcatttttagagttttaaaaaatcatttacttacatgcagttttaaatcacagccctcaaataagttccaagtcagagattttatcaagattgtatttacttttttaaaaaatggagttttatgctgctgtggttatggaatgtgcttgtacaatatatatatacatatacatactgtttgatgtagctctatacaatgctgcttctttataatattgcttatgaactattttgtttaatgccactgcgtctatgaaacattatagactattctgttagtatgcacagcttttcccatgaccttaatacctttatatacctaagcaatgagagtgtgggagaatgtattgcattcccctggacaactaacattaactcactgttacagacctaatatgtgtgccccctctccacccatattcagatattgaaatcctaactcccagtgtgatggggcctttaggaagtgatgagctcatgagggtgaagactcatgaatgtgattagttacttccctcataaaagagagcccagagagctcccttacttctgctatgtgaggatacagcaagaagatggacgatcatgaatcagaaaatgggccctcaccagacactgaatcttccagagccttcatcttggagttcccagactctagaactgtgagaaaccaatatttgttgtttgagctgcccagtctatggtatttttgttatagcagtcagaatggactaagatctcaacatactctaaatactctcagcaattggctcaccatactctaaataatataactccctgccctgattgaaaatgttatgttccaaacacagtctcccccactgaggtctctgtcttttattaagtgttttaacgtagtggttgacaaaatatatacaaataatattgatcaacatgctgcaaagaaaaaagaaagtgcccacagcactccaggggttcaactaacaaaccagtggggagatgaaatagaatagagctggttctttgaggtcagggactgaggcttattcaacattttatctgagcttgttgtttattcaacattttatccgaacttggtttctagcatgtagtaaaatgtctgatgactcgacaaaggaaaaaaaaaaatagatacctaacataagaagagctattagtataaagactctgaagctgactgcctcttcataattaggacagtcaaggaaaattctaccatacactatatatcagatagatagatagatagatagatagatagatagatagatagatagatagatagatagatgtatactagtcaggcctttaaaaaaggacagataatgacctacagaaaggaaaaagtaagccaaacaatgatagtgatgtaaaaaaatgtgggtcccaggaagttctgagttatctatttttatttatcataatgcctatgatttccttcttctttgaagtttcctcacatcttattccagttctcttctctgctattgtgattctgtccggtttcagtggctcttcccaagggggctgacgacagcgaggcctctgtgctgtgctggggaggagggtgacccctatctgggacagcacatggttctcttccctcagtggatgctgccaaagccgagcagggaaatgcgccccagtgtgcatgctaaatacaagttaggcgcccttcagcgaagatttcggcttggcttccttcccttggctattaagctacattcccacaaaattactacatgtctgaggtttctaaaaccttttgtgtggatctcaaacagttactgtgttggatccaaatttcgaccttggttaagcaagcctcaaatccgttccaagctgctccaggcagtgatgctccaaggacacccgatgcaaggaggagataagaataacctctacagcttggtgatcacctactgtgtgtcagtcatcgtgcttcactctttgcatgcggcatctcatttaatcctcactataaactgtgcttgctagctactacgactactctaattaccactaatttacagatggcgaaatgacagtttaaggaaattaagaaacttgttcaagttttacaaccaataattattaaaggattaaaagtattgaaaccctagcagtagacttccacagttggcaagggccagggcaaatgacaccagagtgatctaaacagcctgagtaataataaaagccatcaatccagcacataaactgcctgcactctgtgcatcccaaaagacaaagagaaaagtagtaggccatgtttctttatgcatctaggtggcaagtctatgagctgagagacagtccctctgtgaggagaaacagaagttcacaaaacagagggcagggaggttctcttagcttgtggcaggcaatgagtcaggagaggtaacttttggaacagagcttgctcttggcttagggagtaaaaagtgaaaagacttccaaggactaacaggttctctccttacacagggtaatgaaggctatcacactcagggcttagactttgttgatttatagactttgtaatctattgcagtgagcttgactgttttgattctttttttgatacaggtatctagttcaggggaaaagatgctcagagttagaacccttgtgtatagtttgagtatgtggttagcgaaagcctagagaaaaaaattttgggaaaacaattttgtccaagtgcagagaacaaaacttgcattacagcaccagcagcagaaagcttgtcataaagatggggaagtggagcagtttcccagagcactttatttaggaaggcctcgtagccaaatggaccataatcaaggtggtgatcaataattactactctaaaaagcccctggcataggccaaatgaacctctctttcctctcccttcaccttgatgctctgctctcaatcactacaaaatgaaattctcccagatcagagtctgtagtttttgtgaacaaagtcattgatctctgatcgtgtgttattttttgtgaaacttataaacttaagcatgattaggtgaatgaatactgtggcgggataaataaggttacccaatcttatgtaaatgcacaagaatatgtttggagcatattttcttcattccagtcagcccagctccacctcagtacttctgcattgacaaatgaattgaaaatgaacacatggagtctgtcatctagtcccagcagggaactagtatgatatacttaaagggcactgaatttacaagcatgtatatttctctcatatttttctatctttagaataatataaactgtgaggtataaaaatatggtaattcaacttgtctctttgatactatcaattttaaaagccatcaaataagaagatttagatgaagaaaaggaaaacactttatgaatcaaatagactgaaatgcaatattatatttggggttctatctgatccctgcagttagtgttcttacagagtagattttgtggattaattgtgtgatgctattttatttgttgcttgcaaaggggaaggtgatcaaaattcttttgacttatttaaaaacatctatatattttggccacgttttaaagattaaacaagtgttttaaatggcacatgatagttgttattacatccaacatatctaggctgttaaaaacatcttattgtatgacatatattgtaaatgttaaagaaaagtaactatcaccatatgcttacagttgcatgaggatgatacccttgataccttagcctctgaaaaggtataaaaaaaggtaaaaattgtaaaaaagaaatatattaataaacattgatacattattttgaaattgacaatctgaaacaatgatataaacaaatttgattttgcttggcacttctccttcctgctgccatgcaaatgaagaaagacttatttgcttcgccttccaccatgattgtaagtttcctgaagtctctccagccatgctgaactgtgagtcaattaaacctctttccttcataaattacccagcctcgggcagttctttagagcagtgtaagaacagactattacagatataatttactacatatcacaactatagatattcccatacggaaaatgtatatttgcatttttaaatgtatgctcgcatttccttggttttgtggttcatatttggtagtgaggtatatcagtcatatggtcatatttatgtaaactgaaacctaattcatatgtttctaagttcctgtgccctaaaaaaatcaacatgcacatcagcactgtcggggaacctttaacacctgtaggcgtaagtatgggtgagtcatagaggaagtcatttgctccagattattaaacatggaagaaagacctcctgataactttattacacatgataacgtgtgctaggctaagagagagtcattaaaccaaaaagcaaagccttctaataaagagctgaagctgaagggaaggactaagaaatgtctctttctaaggcccatagaaatagtataaatgtgttgtgtgctacctaatcattgaagaaataagatacatttaaattttagttattgattctattcacgctaacagcattttgaatcctataaagagaggacaatcctggggacttccttgttttccctttttgccatctttcaccacagcgtgtttttacctcttgtcttactccatcctatctcaacaccaggggtgactctcatactgctcagggctaatcactccacgatgctttaaatccaactcatttattcattattcatattgtgtcttttgtccacggtaccctctgagcactgagaggaattctaaaatgaataagagttgacctctcttcttaaaaaaaaaaaaaaacaagcaaaacaatagtgaaacaccagagcggagatcttatctgcacatccagattgggaaagctggtatgttggggtgcacaaacatggggtgtgtattgttatgaggacatgtggccacctggaataaaatagtaaggagggcttttgaaatgatggtgagacctcagtgtgctgagtataagacactcgcccaagaaagaggagtttttcttaggctgtgacctgatttgacagaaaacatattctgggttttggaagaaagaaagaatttgttctctggttattattattatttagatatgagatgccttgatgttatgcaatttttctctgtactacttttttgcaagaagtggggcatgctccaaatcccttgattatgatttatgggccagggtaaaaaaaggaaaaaaaaaaaaaatacccacctctcctcctactccagtttgacccttcccctctacctttgctccaggtgagagaagcactaaatcacagataagagccagagtaacatttatagcattgcaaagatgccacggtcagcatttgaggctatgagtgtggcaagtcctcccggacagatagacctgagattaatagaaacggatcaaagacaagtacccaggaagaatgattccaggaagattggaagggctgcctcagaaaatgcatatcacttgtaattctgccatagaaagggagaatttgaaggcataagtctctcaggtgttttttgactaaagtcaattatgactttagtttctactgccattattatctatgttccttaataattctccaccagttctgctgtagcaaggagaagtgagaaccaaaatgctaaaacaatgcaaaaaataagcaaaagctttaatgtaagaataaacactgtgttatagaggctcttatctttccatcagtttcaacttctctctcctaatggcttcccaacaatgtcttggttatttcctctaagaacactaactttgcataagcatatatattcctagctagagtagactggtttcatgtttgttttgatggcactgttatgatcaggcatcagaagcttctcctcagccttttacttcttccagcaacagtccttctctctctttttgctcatggccaactttctaagaaaaacaaccaaataaaaatacattgcttctttctcttcttcacccactcttcataacctcttacaatctgagttctttggataaatatttttttcaaagatgcttccactaccttccactaccttttctcagatcgttgtcctttctcagatcttctcttttataatagttgtctacatcattcacgatctatcccatgttattaaaaattgctgtgttttggagcatcttctatgtggttctttgttgatgtacaccatttcaaaatgccaaaataaccctttgttatcctactcccctttcacagataaatcacattaaaagaaattatgcaatttgccaaaactgctggacttacgtttggaatagaaatgtctaattccagatctctgactctctccactattccactgtgtctagacagtgatactgtgtagttcacagtaattttattacaactactagaagaaagggctcagccaggtcaaaactacgaaaagctttgtatatagcagaacagatggtgaggtttgcccgttctcccttggagaagggacccatctgtctatctggcttgacagccttcaggagccccacctgacatggacattcagtagggatttccctagtctgcctggaaaataaaatctatttggattgctcctcaggtgcctatgaggaacgtgggaaaattcctaggactttttttttttttttttttttttgacccagtctcgctctgttacccaggctggattactgtggcacgatcacagtgcggtataacctctgctcctggactcaagcaatcctcctgagtagctgggacaacaggcacacgccaccatccagttaatatttttgtattttttgtagggatggggtttcaccaggctgatctctaactcctgggctcaagctatctgcctgcctcagcactcccaaagtgctaggatttcaggaacgagtcaccgtgcccggtgggacatgcttcttaatgaacaaagtcatatggagggtcttgtcttgaggagggacatggctctgtcttaggctttagttgggtctctgttatagctagctcagaagagactgaccctctagccatatcacaataccccaaacctttgaatgatgtgtcagcagggatacagtctctcttatctactactacagcagcctgaggatctactttcaaggttctatctcaccctctccagccataaggccccctctcaagctgtttcctcttgtgttaactgtcattcagctagtgccctaccctgggatacattcctttcctctgatctcttctcttccctgtcttatcttcataccttcattctctaaagtgggtgcatctcaatgtcctgatggttctggttttctcccacgtctcctcattaaacttcccagaatgagcatggcatatccaaatgttcaacacctcctccatgtgaatggctcctcatctctcttctgagaacctgttctgcattcctctttaactgcatgtttctgaagcactgcaaaaataggttttcttgtttgctgctcggcagccaacacacattcagaatgctgctcagtgttcaataaatgtttgttaagcaaataaatgagtgagtctaaaaaaatgatttgagtctccccctgtctgtcttcattaccttttctgataaaatgcccattcccagcggggcacagtggctcacggctgtaatcccagcactttgggaagctgaggcaggccaattacctgaggtcaggagttcaagactggcctggccaatatggtgaaacgtcatctttaccaaaaatacaaaaattacccgggcatggtggcaggcacctgtaatcccagctactcgggaggctgaggcaggagaattgcttgaacccgggaggaggaggttgcagtgagccaagatgtgccattgcactccagcctgggcaacagggcaaaactgcgtctcaaagaaaaaaaaaaaaatcccaaaagcctcaatacctctacccggtgaatttacagaacaaataaatgaatgagtccaaatcaaaactaaattttgcctgcccttatccagtactcttcctgccactgcactgacatcacagcacagaggagggaaacagcccttagaatcacattgatttagtttgcatctttgttcagtctcttaacaggatgcagccttggaaaagttacttagcttccttgagcctcctctataaaaaattaaaaaaataaaaaataaaataaaataaacttttttaaatcagaaataattactcttcaagtttaaagactaaatagcatgtgtaaaatgccccaaagccatttatacacatacttataagctgtaatcctaactctcctatatatgtgtgtatatatatatgtgtgtgtgtgtgtgtatatatatgtatatatgcgcgtgtatatatacatatatatacatgtatatatgtatatatgtgtgtgtatctatatacatatatattcatatatatgtgtatgtatatacatatctatatatatatacatatatatgtatatatacacatatatatgtatatatatatattttatttttgttttgtttcgttttttgagacagagtctctctgtgttgcccaggctggagtgcagtgctgtgatcttggctcactgcaacctccgcctcccaggttcaagtgattctcctgcctcagctgcccaagtagctgggattacaagtgcccgccaccacacttggctaattttgttttgttttgttttgtacttttagcagagacagggtttcaccatgttggccaggctgctctcgaactcctgacctaaagtgatccactcgcctcagcctcccaaagtgctaggattacaggtgtgagccaccatgtctggccaactctcctatttcttttaaagatacatcaactacctcatttaacactcacaaaaaccgtatctgtagatacttttatgtctccaccttacagatgaggaatcagagggactgagaaaatgacttatttgcccaaggtcacaccaaaataaaatcctaggcagtattactacagagttcatgtaagaaatattcttagattgcaagctcactaagaaagccttataaaaattcagcccttacaaaaatgggcaagccacaccgctccaaataaattgtgcctttagaaggtggtcactacttactgaagtaataaagaaatatgtttacctgttgaaatctgacttctcggttcaatgctcaactattttagaagaaaatttgtatctctaacaatgccaaatgcagaataaatattcttgccttgaaaattatgatataataaagaaaacatacttgggaatgtttttccaaagacataatgagtattgcatgaaagaggacttttaagttaaagtgagaaacagaaataattcaagggaaacatgctttactgaaaattatataagtcaatatcccagaaaccaagtaacaatttattcgtcagaataaggaatacatgatcaggaaatttgtctggctaattgaagttgaagaggttgcacttgatgaaaaggaaatcatcagaaacgcctggatgtttcctataagaagctaaaatatgcattataattccagctgtggatagaaatttaatgcatttttacaaggtacaaagggtgaataattgttttgtcagttgatggggtggattttagttattttaataactataacctaattgaaggaaagcagaatggcatatcagaaaatgggggatacaaaaccaaatggtggaaagcaaattgattgcttatattagaaattaattatatattaaactacccagagttctagataaaattaggaacaaaaataatattttagaagagatgtgtctgactagccaaaagcaaggagaaatgcagaatgtcactgaaaatctaaaaataaaagcctgaggtaaagtgattatttcctcaaagaataaggatgcacataatgtatcataatttcttaattagagttctatgacaattgtagttacatccttccagggatagatatattatgacttgcaaagtttgctaatggctgaaaataaacaaaaaaaaatagaaaaatttctaggtaaaagtagttaagactagctttttttttttttttttttttgagacagagtctcactctgttacccaggctggagtgcagtggtgccatcttggctcactgcaacctccacctcccgggttcaagtaattctcctgcctcagcttcccgagtagctgggattacaggcgtgtgccaccatgtccggctaatttttgtgtttttaatagagacggggtttcaccatgttgaccaggctggtctcaaattcctgacctcaagtgatccacctgcctcagcctcccaaagtgctgggattacaggcataagccatcacgcccagccaagtcttgctttttgggggcaaggaatagtaataaatgtaaaagacctgttttatggaccctggaacagctcatgactttacttagaagtttctacagaaataactaaagaatgacatttctccaaaaccagttgaagaactttttagttagatgatgacagacaagaaagtcaaggttaatttgagatatgctggtagaatcctaagatcattaaagctctggtatgaataagaaaagagaaaatgacatgaaggattctgacatttagaaaactagcaatgggaaaatgcctttcacattctaagtttatttgtgaattaaaaaaaaatgaaaaaagaagtattgggttatgttgtagatgcttctaccaatatggttattattttattaagttgaagatcttagtgaattcatcaaggatacctgactgatgagacatcttggcaaaaaaaaaataataataatttggaagaagtcacttaatctcactgtgccttaatttattcacctatttaactacagggtttatttccctaaacagtatgatatatactctttatattttttctagtgttaacattttaagcttatggaaaaacatgactacctacgagaaaaataaaagtaaattaaatcagtgtgttgtgaagatcccatgtgtttcagcattcatcagactgaaggcagtctccaaaacatccaaacagggtttttgagaatttaactcttggatctgttcttcaagtagtataatacgtggtttgacatgcatgctagacacctgtttttcaggatggtaccaaaacaacagaaattctgatgaattatgtcattcgagttatcacaattgattattcaaataactctccgtaattatgatcttgacttctacaatgtaattataagaaagtcagttgttcaaagatatccaaaatgttcacccttggcaagcgatggatgggaagagtggtgacaagaatctgaaatttgaaattaacctgatgtatttgtaagtttttcctaacaatgttgccgtccattaaggactgtttttagtggactttcttaagcttgtatagagttgacctgaaggatttaaaaaccatttcagtttattcagtgtttgccatgtatgccatacacatcatacactggagtacatttaaatatcattaaaatgtaccactgcataagacaggtctgctccttccttgttctaaggtaattctgtttcatgggttagtcagacacaaaccggtgttatcacacagaactgtcacgtatttgatctgcaatgttcaccggttacatggagctaagaaatatacagaagctaatagagttataaagagtctggaccaagaatcataagacccagttatgagttgttaaaagtgagggtgaaacatgtcccttcagttttctcattttaaataagactaaatgatctcatcttttttattttctttaaaattttaaggccttatgcaaaaggctgaaaatctaaatggctaagatttaatggaatccataggatttcaatgagatttggaaaattcatcaactatgtggcacagaaaatacagacagcacacatgtactatattctgtatgggatatcaggaccaaaacaaaacaaaaaaaatcaccatccaggttgataaatggaaaaaagagggtagagatctcttcctgatacatcctcagagaagattttggcctccctaaaaattccactgaaagttaggtgtctctaatgttcatttttcttttttttttctctcaagcttcatagagatcctctatatttaagtttcagttttgtttatctttaaagatctcttcactgttcagaatttcttttccagaatcaacaatcactttccaaaaattgctcttatttttaaattttgtacattattttttccatcaagaaagatgattatcaaaaggaagtttccttccttccttccttcctttttctctccctttctgccccctttgctcccttcttcccttcctttcttttaaaattactgatggctcagatacactttctattcttcatagaataaaagggaacatgtattctggcaaaaaaggaaacagactttactgacccagaaaagaaagcatgttttgaatctcatccatctcttccactggcattttaatgtcctcccataattacacactgcttgcttagcatgtgtgatcataggaccaactacagggatggcttctcactctttgatttatattctttaatggactccagccctggggccagcagagctagaacagaagacgcagtctgcccctgatatttcctggtctttgccaagagtttgcagtcaaaaactctcctagaaatcatttcctagagataatcattcttaacatctatcctctggaagagatctctcacctgttcacaagcaccatacctctcagagaatcaaacaattatttaaaaatggactatgaggcaactgcacacagagcttatccatctacctttgctagaatacagagaggcatggagcagtggaagcatatccagtattttgaatttttaaaaacatcatgtgttttgatcatataccctatgactggactatgggaccagcttcaggtttaaagcagtgaagctgtttgatggaaacctgtaaaacttaatgagaatgctgagctctagcatcaaagccgttggctggctcagaaaggctgtggggacgtgggcagaggcagacttttacatcttgtgctgcttcttgataatctgattcttggatgctttgcccaactttacttaaaaggggaaaaagaaagaaagaaaaactaagcaggcagataggaatctctttcaacacacttttttcttaaatttgaagaggatttggtttgttagtttgcttttgatcaaggagatggtagtggtagaaaattcttgtctctcttacctttttggaataactaaggtcacttagtgtgatatgctgggacccctttggctagatgacttttcagtaagaactttaagaaatttatataaaaatgttttctgtgtttgcaaccacagaacttaaatattattgtagagagggaccttaaggtacacagagattaatgctttcacttgaaagatgaaaaccctagtgctcatagaagttgaataaaatgcattgcgttgcactccacatagactggtcaaccttgatcactgggtagtctaaacgattaaagactgcatctcatgaagccagttttgttagttccttcatgcttccgaccactcaagctccccactccttttcactttaatctgaagcatatctggtttgattgctttgtttgggcagaaatatgtaaattttgcttgtgtttgtattttgtattcttctttctccaaaactgtaaaaagtcaccttaattctacctttgaagaatctctacactgtatctcccactggatctgtttcagtatatttacatggaggcttaggctcttttgatcatttattcctataaaatgctgattctatgcagagttttctagaaatatccatggcagtgaataataaacagcagccttgattagggtgaagttgtttcccttgcatcatttgcttctgtatcaccttatatttctgttaaaaatgcgggtctactgttgaatcagaagcaagggggacatgaagctgcagtttaataagctctcagatgatgcttatgcacaaaactctgaaccactgacctacagggtaaaacccaattcctttcctgcagcagtcacatcctgtcattactttatccatttcaacatcatttatccaaacttttatccagcacaattattgacctcttttccccatgcatcttttctccagacacactaattccagatataccctaaacacatcatttattattttacacctgcaccttttctccaacttttcctgtctcgactcttatctctatttttgtttacttggtgacatactacttttcgttcagtgccatactacttttctcaaatgttacctccttgggaaagccttttcctaaatatttctcagtcaccatccctatactgcgttgcaatagaatgtagcataaatctctcttatagaacctgtttcatttgaatgtaattacaatgaatctacacaaaggttatagaatacctactatgccccaaattataccattaaagaaataaaagtcacaatctctaccatcacaaaaattactatccagcttttttcaacccaaatcctcatctgaaacagagaaaacagaaaggtatttgagtatttcctcaattctcccaaggaggatacataactagcaccattacatacaacagatgtcttagggctttagggtttcatctacttgggaaaccccagttgatcaaatactggtaaaattacattacagtagcaataaatgctatgatagagataattcaaaggtgagatgaaaaagcagaaatatctaattgagtatgtgtttatctctcctcaaccatgtcttaatcctgtttctatgcttatttagcatctagatcagtgccaattatgttgtggtcattgaatacattttattattgaattaaaggcattgtaattcatttttattagtgtgactctttggaatctggccgaggcaatgtgaattatccatatttgtaaatccagcatctagtcagtgcttaagatactgttggcactcagtgagggcttgtagaataaatgaacacatttggaggagttgccctattctccagtagaaactcaatagcaatgacaacaataacccaattaaaaatgggctacggacttgaataaacatttcttcaaagaagaaatacaaatggccaacaggtatgtaaaaagatacccaacgtcagtaatcaccagagaaatgcaaattaaaactacagtgagatatcacctcatgcctgttaggctggctattattaaaaaagacaaaaaagaaaaaaacaacaactgttggagaggatgtggataaactggaagctgtgtacactgttagtgaacatgcaaaatggtgcagctgctctagaaaacagtatggaagttcctcaagaaaataaaaatagaattattatatcatgcagcaatcccacttctgaatattcagccaaaaaaaaaatgaagtcagaatttttaagagatatttgtactcctatgatcactgtagtagtcttcacaatagccaggatgagcacacaacctaaatatccattgatggatgactggattttttaaaatgtggtatatacatacaagggaaaattattccgccttaaaaaagagaatcagccaggagcctgtaatcctagcactttgggaggccaaggcaggcagatcgcttgaagtcaggagttcaagaccagcctggtcaacatggtgaaaccccatctctaccaaaaaatacaaaaattagccaggcatggtggcataggcctataatcccagctacctggcaggctgaggcagaagaatggttgaacccgggaggtggagggtgcagtgagctaagattacgccactgcactcctgcctggccaacagagtgagactctgtttcagaaaaaaaaaaaaaaaaaaaaagaaggaaatcctgcaatatatgtcaacaagaatgagcctgaggacattatgccaagtgaataagccagtcacagaaagataaatactgcatgattccacttacaagaaatatctaaaacagtctatgtcatagaagcaaagaatagaattgtggttgccagggcctggggcaagggagaaatggggagttgccaatcaataattataaaatttcattatgcaagaagaataaattctagagatctgctgtataacattgtgcctctacataacaatactatattgcacatttacatatttgctaagtgggtagatcctatgtgagctgctcatacaataataataataataataataataaaataaaacttctttcatatattagaatatattcatttggctagatgacatagttatcttttcccaagccacccatcaattttacagtcagttcttccctctcagtaagattgaaaattaaagaataataaagttttagaattgaaaaaagtgatagttttaatttgaggatcagaagtaatacttaaagaaaaactactaggaatgcaaaattcttcctttgtggttaatctacatttataactattccacttgacatttaattgcttcgcgtgttatgtgtatttcaaagacaaaaagaaagagtttattaagactgcaaatgaagtgaaaaaatgctgcatttttctgggtggacagtaggggtggtggtggtattttcagtgttattgtcatctaacgaagcctaatttagtttgaatatatattttggaacaaatagcctccaaacacaaattcagtttaggggaagatagtgtgaaaagggataaaatgccataaaattctgatgtcctaaagaaaatgtgagagtctgggacacctccttgttctctgcaaagcctgccgccagctcacttcagacaaagttgtctttttataaacatgatgtaagcatacactcacaagctctctggaaataatgatgtttctacttgtgtcagttaaaggcatccctttgttcatctaatcaccaagaaaatttcaaggcaggtgtgcttcagtttagagaggtgccgtacttcatgggtgcctctaagggactctttacaaaattcatgctgcagaagcagcattcccctaaatggttgcttaagactgcaaatccccaactgtccaatttatatccaaggaagagtttactttctttagggcataagccattatattacaaagtcattaaaatggaaataaatacataagttagcaaattgtggtaaggtaaaataatcttatataaaccatggcctaaaaataaagaatatatacagaattcagcatgaggatattaccatacagaaatgataattaaccaaagtaaacctgcacacagtgattttctgcattttggcaagtgaaaaatttttgctatgaaagcaggactctaaaaatcaaaaaaaaaaaaaaagtaaaggagacctagttttgaattgatattaaaacacacaggcattttactttaatggtcatgggcttaggtccaactatttcagaatccaaagcttattacttagatagtcaacgcacatcattccaagactgcagctgctcctaatttggattgttaggggattatccctataagagtcctcatggctcatctgccctcagtgtaatcagatgagaagatcctgacttccatctccagaaagaaggccaagcccacctggggcctgggggtaaatgagaagcccacatgggtaaatgagagcttctgtgggatcttgacaccgagatgctgagactccaactgtaagcctcagagtcactactgagctacaaatcagcagttttacatttattatttctaaaatctggatttgagttgcaatcaaggtatatcctgatttagattaattggcagtgtttcgtgatccataaaataattgtgcaccaatactgccaatgatgacaatataatatggtggttgacgtactctagctcagtgattttcaaactttaatatgtatattaaatcacttggggatcttactaaaatgtagactctttcagtagatcatgggaaggggcatgagtcttttcatctttaacaagctcttaggtgatgcacatgctgctggttcacatccacagcttgtttagtaaatctctaggtatgctatgagttgttcatgggctttatttccttttaaactacctaaaaactacagcttttagttacatgtccttgtttaaaaattgttcctatatcttctatgtagctttatatgcacatattgttaaacagataataaaccaaataattattaaataataactaaaggtaatgttaatgaaagattggtttcaatccttgatgatcacaccttatagcctggataccttggggaagaaaatgttactgaataaggtcaatttactctttcaaacaaacatttcagacgctcatatgagactctgcttggtttacaggtagtgaacacaggcagggaagactaattgcttctgaaaaataatgcgaaatgaaatctgatgatgacaatgataacattcttaagaactaaaataattacttgtatttgaactataaaaattaactgactattcccaattcagttcctttacaaggtacccatatttaaaaaaaaatccagtttcttatttatctctaccaatttttgatacattagatagtggatgtcatcatttaggatagcaaaatggaaagcacactgggcttggagtcaataaacagaggtttccttctgacttttttcacatattagggatatggctctgataatattatgtatgatttgtggtctccaagttaattcaattttctcacaaagctcttagaacaattaaatgaaacaacttttaatatgagacaatgtgtgcaaaatctcataaattcatctgcaaccaggacaattcacatatttgtaggggtcagtgtaaaatgaaaatgagaagccctctgttcaaaagttattaagaatttcaagatgacaagaagaagatattaaatgaagagcagggcccttctatgtgtggagccccatgtgactgcataggttataagtccatgagaaggccctgtctgcaagataattgtagctaatcctcactatattaatagagtattaataaagtttatacttgattgagatattacaatataccaggcactactctcagagcctcaattacatagtctcacttaatcctttacaggggaaagaaactgaagcacagaaacatcaactatcttacctcaggtgatacaactaccaagtttaagggagccaagattggaatctgggagtgtctgattctaaagccattcatcttaactaatttaatgcaatgagttatctataaaaagttattgttattcctgtttaattcaaatttagaaacctaggctcacaaaaatacgtccatatttcaagggcaattcacttactatgaccttgattaaatgacctatgtcaacctaattgtcttatatccctagtactccacagagagcctggtacatagtccattgtcatgtactatatataaaactaaacactcagtcaccaatttttctgtgcacagaatatttactccacaaagataaaaatctcattttcctattattcaaaatcacatgcttcggaataagagtattattttcatttaaaagcaattaatttgttttaaatgtgtttcaagagtgatgattttcctggggaaaaaaagacaccaattaacatgcacagaaataatttccttccaaacataaggactttgatccaaagatctaaagacaagagtatatcatctcataatagaaattaagaggaactccaaaatactcattttgttttggatgaacttcagatttttaaaaaatatggctcaaacttagttaagtaacaaacttaaatttatatgaaggtgtttttctttttcttagcaatgtgttttctgatccttcatctcattttatctttcctattcttttccaattgtgatagtggaactaattcactgagcttcagtcccatacaatatcatgcccagtatacaactgagcagagagacaaactcagattacttgattaccttgtctttgaaattattactaatgtcctctgcaaagctaattacagcttccattgtattattagagaaatttttcatacctcacttaggaagcttgtattgtaaatctatacttatttgcccaactctctctccagattcctgagtgcattatcttactcatctatgtgccccagtgtctagcacagagcctggcacatactataaatagatacatatatatatatatatatatatatatatatatatatctgtacaaaacagaatagccagatcacttagcccatatactatagtcattactagaacatagcttgtaattatatttatatatatatatatatgtatatatatacacacacacatacatttatatatattttttgagacagtctcgctttgtcatccacgctggagtgtaattgcacgatttcggctcactgcaacctctgcctcctaggtttaagcaagcacgtttcactaattttttgtatttttaatagagatgggatttcaccatgttggccaggctggtcttgaactcctgatttcaagtcatctacctgacttggcctcctgcagtgctgggactacaggcatgagccactccacacctggcccatactagatagttttaatgttgattaacataatgcacacatgcaagtgttaatgcataagcaaatggagcaatttaaacaagatgctctggtaggtgctgaaattaagagaaaatgttcagtctcagacattgttcattgctgctttctactgggctgaaaaatgtcatattctataaaatgtatcaagtcctcagaattaaaatgtcactgaaccccctgacagaccatgctatgctagcttgatatttgaaagcactacaattcattatgccaactgctgatactgttccaggctatggggcatctgctgaaaatgatgggaaataaaaatctgtgggtcccctggaaaggaaagattctatgtttgaaaagctgaattccagacaagaactcaccagatgctttgtggactgaagagctgggttccatttccttggggacctgagcagatgggactccctgaatccactttcaaagaggagtgtctatggcaaggtgcctggtttctgccccaattgtttatttcccttgcctccaaggctacaatgcacagaagtgaacttatccttagcaatgtatagagccaatactttagaaaatctaaaaatctagaaagtacttccaaatgtgttttctgtgcattcctgtttgtatggctggctacacagtatggaaaataaagcaagcattatcttagtttgccttaagaggaggaaaagtgtgcaggctgccagagtagggaagaggttcacagaggtaacagctccagaccaattcaacccggggagtgggaaagattccactgaaagctcatatataactaactgggcatctgagaaatatttcctgctgcttcttctccccaatcagatcttcccttctctgacatcccagcaatctaggctgcatttttctgttttcttttccctaaaggttcctacgaagctcatttcgtctaattttatctttataaaaatactgagaatgagagaagtgaagtgagattgtaatatgatacggggagcaacacagagtggcagttacgggcaaggatttcgctctcagattatttgggtgggagcttagttttgttacttactaattattttcccctaggtcagttacttcacttttcctatctccatgtcttcatttgccaaatagggatagtatttatgtgtacctcttttcatgcttagagtattacctttgcaattatgaagctctgagaaactggtggtgcatccctctctgcaatataataatcataatgtattcaaaaaagggctagtaaagacaaaataccagaaatccaccaaaaacttgttttttttcttcttcttccattactccctttctgataggtttgaaataccaagtatcaaattatttcacacagtttcatggatttgtttttgcaaagttgttgttttactgtgttcctgatgcccccaggcacatgcctcttgggtaactcactggatgttgttgaaattttatgagaaataaaaaatgcttaatatgttattattatgctttctctggaatatgctgactcccttaccccttcagcaaaagctcctacttttcatgtacatttgtatagagcctagtacaatcataggcacattgaggcactacagtgtttatgccatgggggtttgtttgaatgatctgatgcaggtaaagtgctctactaacaggactatcaactcagggatggcactcacagccatgtgttctgttgaggtctcatgagttctcatttgcataagggaatgattattattaacctgcgtgcgttattgtgaagacttttaaaaggaaaggaggatttttgcagtctactattctacacatgaaaggaggcaagggtaatcgacctctgcatttaagtactgacactattacagtagaaggactgaaatacatttcaatatttccgagatctagaagaaactaggctgggcctataacaaactgggttaatgacacataagaatttgtcaaagcctttgacatttccacaaaccccatctagctttcttgttaaagttttcaaagcaaaactatcatcttccatgttttaaatcaggtagaaaaaaaatttctttctatacctgaacttctgccaaaaacattaagcccatttgcctattctagatgggctaaaccagcctctctctgagtcactaaaccaagaccttgcctctaggaatacagcacagagaagctagaaaattgtcattcagccccaagccatcatctctagtgctcactaggctgtacagaatagaacagtcagagcacttagctcaaatatatactattgttattattagaacatggctactttgtgagtcagcccattccagctgacacaacaaaatgacatactgtatagtgcatactgatcctacatgaaacacttttaatataaaagttagcctgtagccacagtcagtccactggtcaaaaattgagcatctgctgcgtatcagcctggccaatgcatgagtacttgagtgaagggacttctttgcattttctcataggctattaatcttgcgggcattagcaaaatctatcttaaaatgattcatacaggccaggtgtggtggctcacgcctgtaatcccagcactttgggaggcccaggtgggtggatcacaaggtcaggacatccagaccatactggctaacatggtgaaaccctgtctctactaaaaatacaaaaaattacccgggcatggtgacgggcacttgtagtcccagctactcgggaggctgaggcaggagaatggcgtgaacccaggtggcggagcttgcagtaagccaagatcatgccactgcactccagcctgggttcatataagtgaagatgtatcaccacataaaatcaaggtagtattatccatagttctataatgatatggtaagtaaaaatatgtggatctgtatggaaaatgtttaggaaaaagtgaagtgggaaagcaaaaagcaactgtcttcccgaaagagtgagggatgaggcatatgggaaggtcaatgtaagtaaattgtaaaatggtaccaaccagtatatggaccatgacaaaataataagagaagagaggcaataagtcagggacctcaacaaggaaaagtctagaggaaatgaaaacctggggataaattgtttaatcatgactttggaatccatgtgagttctctgccaactaaagtagccctccctcctctcatctggcatgatttccagacatcactgaagatctctttttcctccaagttcctgctaggttaatttatccatcaggtccaaagccttttatcccaaaattggaataaattggaatgcaaattctgccatgagattttgttcttacgtgtaaatgacagatactctattcctctctgagcaaacaggaaaataagcaaaaaaggggaggagcggggagggatagcattaggagatatacctaatgtaaatgacgagttaatgggtgcagcacaccaacatgacacatgtatacatatgtaacaaacctgcacgttgtacacacgtaccctagaacttaaagtataataaaaatatatatatatatatataaaataaaaaaaaaacagaatatccccttttggaagtagaagtagattaacctattaaactaatatcagccattcaaaaaaaaaaaaaaaaaaaaaacttgaggaaccaaatttgatgaggatggtcaaccacagaagtgcataaattgagaagccttcaaaactttctaaaactttctctgttgtccaaaagaagaaagatagggattaaggggcatttgcaggaaggaaatatttcatctctttcccagtgttgatgctggtacactgtgatgtgggcacttcatatggcagaggagatcacacagatttcattaaggaatcaatcattttttcctcaaggaaaggaatcaagcattttcaccaataaggtgagggaaaatgcttacaaaagataggatattttccaaacctcatctacctcagtagcatcttccagatttgtggcaataaatgtttctaagtgtaattaaaggctgagccgatctaattaggttgatgaaattttcagtgggacttcattccccttagcatttcactcattttttttctctctctctagaatacttccttaggcttaatctgagcaatttttagtggcagcattctaagttacctcacacaggcagtgtctccactctgattgtaaaacctccagcaggtacatatgactaaaaacaaacttcaaataaaggattctaggttgttttatttaacacacagtcctttcctacctcttcagtttcatttccttactaacaaactacgttaaataatgttcactctgcaggagggaaataagcatttcagagcatttcgggggcacaaagagaccaggaaatgcataataattgcaggaacaggttctgagggggagattaatgagggagcgccatgacccttcctgataggtcagtgactacagaaacacttatacgatgaaaatattgggatagaaacacatactagtgagattttcatctatctttaaagattcttaaaatatatctagtgagcacctgaagaattaactgtaagacttttctacaggaaaatgctttccaagtggtctaaggtaaatgggcaagatgtcctcatagagtctgagcatctcagacaccatgatttctctttctgcaagattttctaacctcctctccttttgtagcagtcactcaaaaactgcttgttagaaaatttaattaaatataaaatgatcgaaaattcttaagcaacatatatttcagctcttactcagtgttatcaaaatgcaaataatataaacaagtatttctgtcaaaacagtgttgcctttgcaaaaatcagatttagaaagcatatttttttaaagacctattatcttctaagaatttcataggtatgggctgcatataatggcaatttattatttataatttttctttaactcttttttttcaaatttaaacctgtgagtcatttttcaatgagtacagatattttcccagactttgatttacttgtgatgaaaatatgaattatttaaaaaaaactactttgatctctatttgaattcccggccattcaaagttccttgtcattttaaacaaagcaccatatgaagttcaggttaggttttaccaaattattttgagctaatcttattttattttgaaatttgataatcacatacacaaaagtaactttccaattgagggttagttgttctacgtgcaagcaaagtctcatttcaaatagacattattaaatgccatatagggaaagacctaagttgcttctaaggaatatgagattataggttgtttcaatatgttgagtgatttccttttttttctttaatctgtaaagaataaatgtgtaaattcgtgagagtgatatttttatgccttgaatgccattgtttacaatgaaatagaatcggccatttaaatattatattttccttgatagggttctgtattctaatcctgctggacccccttattactcttggtcaagtaacttctctaggtctgtttccccaaaggaagaaagttgaacttagaaaatgatttccaggatcctttccattctaacactccaaaatttcttccatgacttcagacaaggtgttattagaatctccttcaagactggttatgctaagaggcactacatactagactgaaaataaaaatgccatcagccaataaatgaagtcataattaagggtttacacatgcagtgtgctatcgaccaggaagtccaagctagagttcaggaaaatttacatagattttactgttaagagagattctgtgagaatgaacatgggtatatccctctcttttcagtaacttcacaaagctgacctatttgaagtagggtgatttaactcacaatccatgatactttgtcactatttcatttcagaagtaacaagagcagggccttctaaatagataatggttcagacaggatggaaactatcaacaactaaaaagccctccaaagtgctgggattacaggcatgaaccacgacacccagcacgttgggaggccaaggcgggcagatcacttgaggtcagtagttcaagaccaccctggccaacatagagtgaaacccgtcactactataaatacaaaaattagctgggtgtggtggtgcatgcctgtagtcccagctaacttgggaagctaaggcaggagaattgcttgaacccaggaggtggaggttgcagagagctgagatcatgccactacactcccctggggaacagagcaagactccatctcttaaaaaaaaaaaaagccctccaagtgaggtatgttttgatttatagattaattgtgctgatatccttccaaactccagtgcatcagaagaagtaaaatgaaaaagattacacaagtcaagaaaaaagtgaccgtgcttcctcagacacacaccccagatggggaagacagagttggaaagtgtccaatcaataaagaagagtgaattgtatccaaaccctatagtgacaacagcacaagtgaatcctccttttatgagtttagccactgtgaactaacatgtcacttggaagaccacctaacttattttttggtattgtggtttttctggttaaaaggccaatataaaaaaaaatgaatactaaggtaaggaatctttatttatcaattcataaattagaggtgttaatctgaagcacggtttaatttgaaactgttattttagattaaggcaattaactacagttttatacacacacagaaaaaaactgcctcacttatgcagaattatcagaagattatgtgtctcagctgaactcaaggattccctgcaggaattactattattattatttggatgcccaagagttctttagttagattcccatttctgctagagttccctcgattccccttcctttttccaatctaagcaggattactcttctctgtataaagcaggatgtagggactgattatacctggcctggctcacagtgaaaatgaggaagttggtacaggtgattggggatgcggctctgccctccactttccatccctagaatggagtttcagaaatcttctaaaaatatctaattattcttttaccatacctgatatgctttctccatccctgcctgtctaaattagtcactgtttgagatgctcatattctgactcttctgtgtttctctccttgtcttctagaactctcactcatctcaccctctttttaaatcaaataactgtgttaaataatttaataattcattcctcacagtctattattcatttgtaaacattgttttagtttgtaacaaatttgagagtttgtacaatcttttaggaactctaacaaacatttctcttgcaaaagggctcttaactatggtagttaagagcacaaggacactgaaatcagacttcctcgattaagatttagactttcatacttgttagttgtgtgaccttcctcaagaaacttacctgcctcaaacctcagtttctttgtctgaaacatgcagataataaaatgtctacctattttgtgaggattcctgtaaagctcttataatagcacaaaataacagctctggaaatattagtactataataataataataataaataataataataataattagattatcatcctctacagagcttaacacaaacctggatcatactacatatttgtaaccagtaaaagttactttctgaaaggcaatctatcactcctactacaaagcatgggtaggtttggcctttcagaactgcacctcttcatgtttgttaaaactattgcacctttaaatctcccttaggattattctatatacatccacatactgggcaacaaatcaaccagtatgttcacataaagagaagacagggaaggataattcagtagtaattgtttttccctaatgcttaactgaatcaagtttatatgattaaattatttacttcagaataaaccaagtacatcactgcttaccaacagcacctatggctaacagtgaattcaaagttatttaactttgatgtttagaaatctacaccattaaattgtaggcatacaatgtaagaggaacctctggttccagtagcccaaagaaattggattgtgtctgaatgaatttttttaaagacagcttttatggaaaatattcattaaaaaatgaaattcagggacttcttcatctttctctccccaaaacccaacaaattccaatcttatacaaagttacaatacacaactacagctgataatgagggatgaaattattgatgtcatttagtttgatgatcttgctcagataaatatcaagtaaattcaccagataacatttacttcctccagaatgtgttgaaaataagggaagaaaattatgtcattatatagacttattttgttttagttttgttttgaattacatagtcgttgcttctcctataggctaattgctttttcttcttttttcttttaatactcaaaaaagtcatcactgtatgcataacacctatggcatttaagtagaaataagcaagtaaaccatttagctcaactttagacccagtatctctttttgtttgactttcttttatagctaatatcaactgtccacacaaatctcaaatgtaaattacttacagactaataaagaagaggaacctaattccttcataatgatctatgagctgtttccctcccccaatcctacataaacaatagtagaatattgaatttaaagttgtgccgtttgactctggaacatcgggtcttcagcaaaggtgctttcatgctggatctgaaatgatgagaccatgaattaggaatgattctgatggcaacgatatttacctctttgagacagcccataaagttgttactgactggtgaccctggaaggtcggctgtgctgggactgcctccaacatagaaaaagtcatcagaccccagcatggtataatcttcttgcgtgtagcccgttgtggtaagaatcccatccactgatattgtcacctagataacaaagcacagggaaaggacacgctatactcagacctagatactgtaatcctgggatatgcctgttttgtgttttgcttttgtttttttgttttgttttgttttgcttttttctttttttctgtttgtttggtttttgtttttagacctatgacggaacccattttcatgtctgtttgaggtttattcttagattctattcaactagccctaagagatctaaactagttagagagttaactgattattgaactagtgtcagcatcatccctactgcaactcaaaagttattgagcagacacaaaaatggtgttagtaaaatgcttcctaggttagttttgctggtgtacatattagtaaggtttagttgtctgttattaactaatcacaacgtgcaccttgttaacataaaaggcgcaagctatttccagcaacatcactatttgcactattgagcagcaattgttcagcatgcaagtgcctaagtccatgccaaagggagagaaaaggcaaaacaaccagtagaagcggcacacgctgatgtgcacatgcaggaggtacagtacagttcagaaaaggaaagaaagaaaacagggagaaccaaaggaaaaacataaaaataaaaacaactgctttgtgatgacgtaaagatgagtgggtgtggcatctccagcattcccaaatcaagtttccatgccatgcatcatgaatggttagagactggctgagctgcggtcactcgggccagccaccattttgtcttatcccgtgttaaccacagctggatgcaaaacgttcgaaacgttaacgatgcccctacaggtgagttggaaaacagaagttgacaggaacaggtaaaaaataagaaggtcaacaacagatgaaaagaaggaggtcaaagtaagcagaagagtaccaaccgcagttcctcttttgttaatgatgtctacagttaaaagaaagaaagaaaacacacggcaaacccaaaataagaaacaattagaatgatatctaccgaacaatgtagtttgtttaccatagcgtgtccaatgcctgagtgctttgtggagaaggggggagaaaggaaattaaaaactgtgaacagaataacgatcgttacttaaaaaatatgatggtctctaccatgttagtacattttttgattcaggtaacggttagtagaatgaaacattccatgaatgacatgttagttattaagcatgttagtaacatagaaaaagggcaaaaaaattttacaagaaaaaagcagactaacaagtaggcctcccacagaggtaatatttttcctgctattattgttcataatttgctactagacagaaacagacacatgacaatgttccctttgtcttcctgagtacatctgagagacattggaaaagtctaaaagggattcaaaggcctaaagcgtttcagctgaccactgcagccctatgcccatacttgacccctcctccaccctggcccaccccagccccaggaaattagtaggaatcagttggcattgccctactactcaattttacagcatacaaggactcctcctcaacttcaaaacttccttcggtcatattgatggactttagggtcacagtttactgcaatgaaacaaagcaaagatcctgacacatagaatgagtagaatggatttgtgtttaatctgtcctgctacacatgcaccccggctgtataactacagtttcctttgagctaccaattcgcagtttggtttgtaacctgagcaaaggcaaatctagaaagtggactccttgagcccccacccttccttctgtgcttctctcaaatgagcctctggtttctttgtgcatatctgagagaaaaaattaaaaaaggaaaaccaaagagacagacttataggaaatccatggtctacagttatactgatggtggccaatcctctccaaaggcaggtggaagcatgcagggcccctcccatgtcaatgagggatctggaaggtctggggttctcaagaatctttcagttttatttgtttgccttagctagactaaatctacactcctaaagctcctttttctttctctagctcagatagtataaacctttcagaacaggaaagaaaaggttagacagttaacagctctgaaagagagggctgttttggtaaaggaaaaccagagacaatccggtcattctgcaactgttcagagaaacaacaaatatgttaaggatattagtttaagatcagcatgtacggcaataaaattagtcactgtcaacacttaacaaaatgatacactgtaatataaagtttcacataatacccaaaacttataatgttcaatataaaaggacaatctattcattttcattcgtatatatactgtaatcacgtattcattaaaaacatacagtatatgtagacccacagatttagtaaatagttgatattttcctagtatatagcatcttgaaaaagtttttttaaaaaaatacaattaaatagaaatgggcacctagaagattaactggcctttccagagtcatttggggtttaacttaaagcatctatgctaaaaataaaagtatcttcaaaaacagacccttcaggagatatgtaagcccctaaagaaatttttcccctcagggacttctcttgtccccattttggggttgggaggaggagggagtagggactgatacaatcccaaatcacaaacactattttttcgactacaaaaaaggaactgtgacttaatgaccccaatgtgcatgcttccaaatgatcaccatgaaaactacaatttaaaattaaacaaacaaaaaaaccaaaaacacaacaaaatcacacacatcacaggaagggcaggtcgcagggatatccttgcagcccttttggaaattttcatatggccctgtatcaaaatagcctttgggctcccagaactttctagatatgcccctgctcaagtatggcaggaagattcatctcagaagaagaaaaagctaatttgcaagtgactctgaggagccctgtatcatgttgttagagtatttaagtaccacacacacagctatagcgagaaacaaagccagttactctcttatccactgcgctgttacctgacgcagattcctggtgactttcacatcatgccaggcattatcattaaactttccattcacaggctccactagtgcttcaaaggcccctgatcccaaattaatgaccagagagacagctccatttttcagggcaagattgacataatcagccgatttcccagtgtgaagcatcagtccattcctctgaagggttttaaatgacagagttatttcatcactgctgctttgaatggggttttgagacaagtcgtagcagaagtattcagatcctttgaacgtggcaatatattcttcttttcctagaggaaaacagatgatacatacataagtaaacaaatacactatgcaaatcagcaggtcttaacagaaacaatagctaatcactccccaaattaacctgcttaattagatttcatgacatgaactctgtctcagtcaaacagtactgtacagggcagtattttttaaaaaattttattattattatactttaagttttagggtacatgtgcacaatgtgcaggtttgttacatatgtatacatgtgccatgttggtgtgctgcacccattaactcgtcatttagcataactcatcctaatgctatccctctcccctcccccaaccccacaacagtccccggtgtgtgtgatgttccccttcctgtgttcatgtgttctcattgttcaattcccacctatgagtgagaacatgtggtgtttggttttttgtccttgagatagtttgctgagaatgatggtttccagcttcatcacacgtatgtttattgccgcactattcacaatagcaaagacttggaaccaacccaaatgtccaacaatgatagactggattaagaaaatgtggcacatatacaccatggaatactaggtggcagtatgtttttaataaatctcaactattgggccatcaactgcagtagctaaagctgacattcttgaaaattcaattaatttttcagtatcactgcaagagctctgatcagagaaagtagttctgtgatatctccagggcatgaatcaggtaccataaatgcatattggatggttccactctgctgacaacaatggattccaagatgttttcaacattctctccatccaactgaggcattattttaattttcagtgaaacatttatgttcaaagatctttttcaatgaagagacaaacagttttatcattgagagaccatagaaaattatctggtaaggagaaagggaagaaaaaaagatagaatctggtctgggagtaaacagacctcctacagagcatgtgcattttttatctctggatggagggagtagtgatagaaagtctaatggagtcagctggattactgatctattccctggtgtagttaagcagatggtagggctggctgttatgacactggtaagaattctagcacatcgtcatggggatagcatgtaaatgaagtctcaacattttctacgtatcttattctttaccagatttaggagtaacaaggcggctctcacgagatgctagacagatcaaacagaaaggtggatatttggaaggaacagtcttctcccactgatgaggtgagttgaaccaaaggaagaatgtaagccataagaccccttgactttctaggcagtaatgatgctgtgccaagaaaaatgagacagcatggttgggaatcagcttctgataaactataaacatataattataaacggtactggagaaacttaatctgtcccactggcgacatactatcactattatgcccccgagagggttgatacatcagcaggtgttgcattctcccctgtaataggtttttaatctcaggactattttcatttgattgtcaaataactcacgtcctggaatcagagctcaaatcgctttcaacgcatcagtgccagatgatctgccttcctggatgtagaaaatggccatcagtggctacaggtagtcaaaccatagcaataaatatcacggtgagcacctacaggtattcaccaggaattgagccctggaatattagtcattgactactagcaaattattagccaagactatcagtcagaccaaataattctgagtaagtcataggaaagacctcccaatctgtaatagtgaatccctcccattcaaacgctcagaatattggctgagcacctcccaagtgttaagcccagtaccagttattagagataatgaagtgaacacaatggacttaattcctgtctcggaaagttatagtccaggtgtctgctcccctggtcagtccaacatggcaagtggttcaatattgggcacaagtacaactatatattactattatactgagaggaaaatgtgggtcaaaatatgagtttggattgtaggttggccactagctgtcactagaacaattatttgcttttcaaattttggtttctgaaaatggttagagataccaatctttcagaatgaatgtgaagatacaatgagataatgtctgtgcagacatctggtaaagttgatacgctggtgataaatagtcaatgtcttcctgcttgcctaattaatgtgataaatgtgataaatcatctaaaacaaacaacataaatcgtatgttattatgaaatctagaattttctctttaagataaaaaacaggacaaggattcccactgtcaacatttatattcaatgctacacttgacattgtagctaatgcaggaagacaagaaaagtatatgaacattgtaaagattataaatgaagaaaatcatgtgatataagcaaatatattgcacaaattgaaacactaaaataatctacagaaattatttggcttaataagagactttggaaagaatttagagttctgtgtactagagacaatcaatgtttcaacatatgtaaatagattcatagattcaatgaaatcctaatcaaaatctcaaaaaatttaaaaaaacaggtaaaaagctgattcttcacaatctatgagaaaaaaaaagagtcccaaatagccatgatatgccagagaaagaagatgaagtaagttgcctgcgtaaagatggacatttattacaaaattatagtgctgaagaaaatgcattaggataggtaaaatgaggagaataacgataatcaaacttaaaatattcttaagcatatatgaaaacaatttacactgtcaagcatttcagataagtgtgcaaaagatagattagtcaataaaggttactgggacaatcagttattcataagaaaaaagtgaaattggatctttacatcctttgttcacaaaaatcaattctacatggatgcccgatttaatttagagaggcaatctgtgaaaacttgtcagacaataaagtttgatatggaagaatggaaggacttctaaaattagcataaaggcactaataaatattgatacactcatctacattaaaattaacaatgctgggtcatcaataataccatagagtaagaagttaaataacaattttggagaaaatattttcacttcctattaatcaacaaaggattataatccagaatatgccaagcacctcagcgaatcaatacaaaaataaagacaaccaatgaagaacacacacaaaagaaatgtaatttcatggaaaaacagatatgtattgcttatgaataatgaacagatattcattcctattagtattcaggaaatggtaaaaatcaaactacattcagataccatttcatagccatgaaattgacataaaacgaaaagaaaagagaataattccacattttgccaaggctaccgaaagtcattcttatatactgctgatgctgataagataaaaattgaccaactgtaataagtttcttttggcattatgcaatcccatgggaatttcacatattacaaagaacttgggtctcagtccttagaaaatagttaaccaggatcagttaactaaacatttgccaattccttcaactcatttgtcattgcttattgttctgctcatttgatgataggtagtcaagtgggttctggttcatgtatgtgtgtgtgtgtgtgtgtgtgtgtgtgtgtgtgtgtgcgcatactaataattatatatgaaaacaatttatattgtctggcattgcaggtaagttagcaaaagatacagaggtcactaaaggttgctgggactattggttatctataagagaaaaatgaaattggatctttacatccttttgtttcccagaatcaattctacatgatgaaggatttaatttagagaggcaatctatgaaagcttttgtcagacacagacacacacacacacacacacacgagagatccacttatctgaatatggtatttgcaaaattttacattcccactgaataagtagatctctgagtcagcaggagccttaaagacaatcctgcagcccaacccattaatttacattattaagaaagcgaggctcatggagtttatatgaccctcaaattcataaaatgtgacagtaacagaagtgggactaggattcagactactaatccagatactgtctaacatgccacaacacctgtgtgtcagacagaagtgatatatagcattgtgaaagaaagaaaaaaagagaaaaaaaactgtttgtgaagatatgtcttagtaagaaaataataactgtgttttagtctacttagtttaaaagagcaggtaatatattaagaaagattccacttagataactaaattataaagttttggagcttgaagagttttggtccagtaagaaggctgtagaattttatccaagatatcttgtatcattccaaatctgcataactcagaataaatctcaacaaaggttttgtttgccagataatgtggcatacccaaggggttaaataataaacagtttgcaattcactatgtaataaactttgaagttatatgggtgttgatgtatttttaacactatgatattccccttacttaaaaatgaaaatatatcatttcttttgtattgtttaattccaaatttaagtaattcaaatttacattaaaggcaaccacatagttttggaaaaaattcagtctgtggaatatgcaattaccttaaaatgccataaatgggacataaatctaagcagggaaaatatttcttcctatgttctttttcatgaaagaacatatatactacatgaaaatacaaaaatcactttttcacaatatataagaatattatgtttcatctaatcatttgctaccttacaatctttgtaagtaagctttgtgctattctataaacaaatactaagcagcagagtgtttacatatgtgtttctgctgaacacttaaagaataagtctacgtccatttttaaatacaagtcccaaataacttttgcatttctactatgtgctaaaacaacgaaaatgaaaaagaaattagacccaaagccacgtaaatgtcaataaatacttatatctaggatacaaagagacctcttacaaatcaataacaacaacaacaaaaaacaaaaacgcaacacaagccaatgggaaaaaaatgataaagtagttgaacagacattaaagtataaaaggctatcttcaaagaaatgcaaagtaaaccataatgaaataacagcacactccacagaatgaataaaatgaaaaatacaaaaaaatccagtgtcagtgaggatgtggggcaactagaactctcatacattattggtaggaactattttgtgaaattgtttggcattctcttttaaagctgaacttgggcctaccctatgatccaccaattccactcataagcatatatccaacaaaaaatacacatatcatcagaatagcatactagaatgtttacagtgttaccctgcataaattatctaaaacttaacactactgaaataacaaccaataatagaatggataaatttcagtatagtcacacaatagaatattaaataacaatgtgaatctatgagctgcaactgcaacagaaatacagataaatctcacaataataatgtttagctaaaaaaaatgcctgacacaaaagagaacatagttctgattccatttatataaaaaatttaaaaacatgcataactagcctctgttgttgtaaatcaagacagtggctatgcttggtagagatggagaggggatagtagtgaggagaactcttggggtacaattaatgttgttcttgatttaagggttgcctatgggtgtgctaagcgtgtgaaaaattaatttacctggacatttatgctacatttatcagcataaatactatatttcaataaaatgtttgaataatctggatgattaagcataaaatgaatttgtctgatgaagtattttcttcctgattaataagatgatatgagaagacactattcctattaatgctactattaatagtaaaagctaaaataaagccaatagtaataatttcaattgtcactttttaaaacttttcaatgaatattaatatcctttaattaccatttgctcttaagagtaatctctcaagatttaaaaaatatatatatacgctgcttggtagtaattgtttgaagatccatatcttaaatgtgttgattaatggattgattcaagatgaaaagagcctctatttctagccacagcaatgttatgataaaattgggaaaaagtaatatttaaaaatttgaagcatctttccaatagtctacaacaattgattttatgttgccacacagttggaggaaaatatttaagagtctgccatgggatttcagtcccattccatatccgacacactataacttagaagaaaattcacagttcttgctcatctaattttctgagagtaagctcaactttaagatttttttgatataaaaacaaacttcttatagaaaaaaaagttaaccattactgaaccacttcattggatgttgtagaaggtgttcaatccttagatggtagattgaacaaatggattggtttcaacaccaagaatcactgatttctactttacgggaaaaaaaatgttaaacaaagataggttaaatgacttcctaagttcacacaaaaattgattctcaggacaatgctcctttgcattaccagtgcatagaatataatctcattaatttgacccaatgcctctgtatcttctaacttcactgaacttcttcaccaaataaataatctgcaaggaaattaccgtacatcttaaagacaaggatgcctgcgggcagaacgaagtcccactgtccccagttacatgaagaatgtcaagtcatttttgtatgccaaaaaactagccaatattattattcttgattatattgcttttcatacatataatcccaaatcacacaggttggaaggttttactatagttatatgattcaaagattatgttcaacataaaccagaaactaaaatcaatatatgaaaaaacaaatgaatgaaaaaagatatttgggtgagagccctgcttcatttatttttctattctagaagtcaaatacacaaaaatattgtgccaaaaacatccttgaccaagcagatgtacacattagaagtctgcattattaaaacaaataagccaggctgtctctgctataagataaaacaactttagaaaagcagaaaaggaatgtctgcttattgaaattcatatcaaattaaatcctcagtccttaagaaatttactattatcttatttgccacgaactgtgtaactgagaaattaaaacaataaattgattattacaagtaaaaatcacattactttcaagggagagtagttcactcattagattttctacgtaatatatgttgtaaaatattctaaaattaccaactatttttcaacatatgtaaattctgagtctaacttctcttgttctgcagcgagtaatcaagatttataaaatattcactcttcaagacttatctcacttaggtaaacctcgagaccaatccagaaataaattgccaagcttctatcaaataattcaaaaggagacccaggactcttgatgatacacttgaagtcactaaatatgaaaggtaagttagacttagacattatttagtccagtgccttcatttattagatgaacagtgtcagggcccaacagacaaaactatggtcacataactaactgaggaaaagtcagaatataatccttgccctcttgataacagtctcaggttcttcctaatttctagatattgccataaaatgagcttctaattcattaccaaaaactaaatgcagcttaaatttgaggatatttctgcaaaagaaaataggacatgttccaaaactctagtacgataattttccaatcttattgtgcaattgatttgcatttgttaaaataaccaaaggtgctgagaaccaaacaggccattctgtgtctggctggactgactagtcagttctacatataaaatgagacacacagggaaaggaatgaacaaatgatcctggaattcattaggtgtgcaacatttcaatttctgggactgactcagattcaagtacctacaatgtaatctataagaactagatgctgtatcttttaacctgaagaaaatcattaacacaatcaaaattaaaagtagcttcatgaatatggactttataaagattctctgcaagaaatttgaaaatttctgggtgccaattaatgattacttaataaataagtaaattataataatgttattatattcaaggagatgtataggtattttgtatttataaacagtcctcatttatgaaatggatatgaagtaaataaatttaactatgaaatcatcttattaccgacttggtcaaggcaatatattctgagcaatttatctatttaaccaaaccccaaagaatagccaattgcttctttctccctagaatcagactggggtggtctgtaactctaaaaatctataatttaatttatgcaaatattgtggccatcttgtaagctgttctaaattatagaatgtatttttttaatatacacagatgatagcatcttggaaggcaagagcagaggaaaggagaattttcacagggaagaagaaagagttggtgaaagtgaaattgctttaacaaaataatgatctctatacctccttctcgaactgtggtttgaaggacagtatcatcagcattacttggagcttgtgagaaatttagaatttcaaggccccctcgaccccaacttactggtgcaaactctgtattgtaacccgatccccaaggtgattctagtgtacattaaagtgtgagagtcttgttatgaatggattcttatagtgctgcaatttagaacatcttttaagaattataaagacaattttgtgtctcttgtatctgaaataagtattaaaggcaaaatatatattgatatcatggcactgttcttaaggaattaacatccagatgaattattttgcatcttttcattggaaataaaaagcccggggctgggtggcgggcgaaagaatcagagagctctgatcagtgtgtagatgtatcaatatctatttaatatgtactccagcagagagtccaggctttaaatcattggaagcaatctctcaatttttattctcaacatgtttcacctttaggcaatattacaataaaattctctgtgggtttgtaaacttagtgccactcttctggataaatgtaaagggtgtataactcctggtatattctaacaagtcatcattattggtgaatatacttaacaagtttcatgcaactgcatttacggttctccctagaaatgtctttgttcatacactgctgcaactgaaaactatcatgcattctggatgtaaactgattcaatgaaaacaaatgggcctgggctgtcacatttccacttactatagtcaagtgaacttggaacattttaaagttagtaacacttagaaatgcaagaaatatatactgctaactcaaagtatcctatgttttaaaaaagaatgacagttttttaaaagaaagaaaaaaaactaaaattatcttgatatccccagcacattaagtagaggagagggtaataaatatgtgataagtgtaatgagaaatcatgctggatgggaagaaatgtacttttgtaactccatccattcgtgtgcttcatagaaggcttgaccaaggctttttggtttattttgttttgttttttttttcagatggaatgctactttgttattaaaataatgcaaagaagtaggtcagtatacactaaaatcagtataaaataagaacacttgaattgttgcataccattcttcacagtaggagcacaagagaaggaacactgaaaacctatggcatatctttgatttcaacacagaaagagcatagaatccaaaggtttaacacatgcaaatcccctattctagatattagaaatacaacagtaaataaggctctcagggtctccactctcatcaaaccagtgatggagagataaccataagtgagtcaagtataagtgagttatatgtgaaactgagcaagcaaaagagtgcaatgagggtgtgcaataactgagcagggaagttgttttagatgattggggaagctttatgagacaatgatgattaaattgagatcttaatgctgaggaaccacttgtgggaagatctggacaaagaatagaaagaataggaaaaaatccagtgagcattgagcacagtgacactggggcaatgtgggaatacaatgaaatcagagctgtgggatggggctatgtcatgtaagtccttctaaattttgggcaaactctttgattttattcgatgcacaatgggaagctactagagttttatagttaggggaatgacatggtttgatttacatctcaaaaatataactctgtctattgtgtggaaaataaactctgcgtaggcatggaagtgacagcagtgagtccaacatttatgaagttatagaacataggagtacgggctatgaaattatacatatctgggttcaaatcccactcacatgagcagttgggtaaataatcaccttaaagtcttagttttcttgtcagtaaatgaagacaataatactaggatctattttatagggtagttgtaaggattaaacaatatatgcataataagctttttaaagactgtcaatccatgggatatatttgtggaatataaacagaatatttatgtatatatgttatatttcttcatctactgcttttaaccattaagttacttcttttccccatctcttaatatcttgggcagaatcactgaatttgtggtcacttttggtttttaaaagtttgggctaatttataagttaatcatgtcatcatttttagttgaagtggaggaggaagatgtagtatgcctctaggtgtcttaccatcaccgccccctcaagacctggcccttccagtttattgggaaggagctgatgaggggaagagaaaagagcagtggttattcatatagtcctctttctgtgggctgtacctgcttctctggttcacccttactgacctctgctgcccttcatgcagtagactcatgagtgctccatgtgacttcccaacagcagtcaacaacatgagagaaattcatctgtctcatcccccagctcatctcccagctctaaccttcacacaacaccccatagcatctggctgctctaatcccctggcccagctagtggccttcttgtgagtaataccggctaggtggctcaagccaaagactcaaagggatatctcctttactgatgcctgtgggcattctggctgcaccgaatgttgctggtacagattaaattcttcttttttttttttgatagagtctcgctctgtcacccaggctggagtgcagtggcgcgatctcagctcactgcaacctccacctcccgggttcacgccattctcctgcctcagcctcccaagtagctgggattacaggtgcccgccaccatgcctagctttttttttttttttctgtatttttagtagagacggggtttcaccatgttagccaggatggtctcgatctcctgagctcccgaccttgtgatctgcccgcctcggcctcccaatgtgctgggattacaggcgtgagccactgcgccgagccagattaaattcttcttgtcccctctttctaccctgccagtcctcttcttccctcctcagaaaggcatagggcaggccagcaagtctgatgcatacaaagtcatgcattgggaatgcagaacaccagctttcatttctttcccagcatacacaggctctacatgtgattctatagtttcttccctcaattacttttggtaaaaaaagctaacctcttcattaacaatatgttttacagagcctatgccttaaagactctgtgctgacctatccgtcactgcttaggtagataagggaggtgggaagtggggagttagaagtagttgaagggtcagtctttcggtcctgtagtaaatgctgaggaaggttaactggccagtttagggaggttccatttacaatgaaggctacttaaattcttttctttcagaaggttctaatcaacaattctatgagaaaaatttccattcaacatatggtggacaatcaattaatgttagatattatgatcattattattaaagtaaccactacatttaaaatcactactcagcaattttaaaaaatcagctttttaccaaatgttttattgcccagaatatcacgatgcccaacaccctcattctaggagcacttggttaattaaggctcattacataagaacgagattgaagtattgtaaatagaaaaaaaatacatgtttctattgatggtttattcttttaaacaagtttgtgcctgagtaacttacaaaataattttataaaatatttgctatttatttatttttttatttgctcagggaaacgcatcaggctaagaattacgagagtgaaacactggtttcttcttggacacttttcagctctgccctttaccaccctacttagcctcactgggcctcattttccctcctggcaaagtgacacagtcagactaagtgatctccaatgtttctttccattctaaaactctatggttctataacattctcgatttattgagccactgtttcactgattcattcaataaacatttattgaagcccaattctgtgccaaactcaattgctctcctgctgtcaaaatcaggcaacatgctagagttaaaatgtctttaaagatttctgatggctgctgcttttaaaaggaacttcccatagcaacccctacctctttgtgcttctagagctagctctcctattattctgtgaggacttacaaattcagaaagacaaaggaatatggaaaggcctggtattcacaacctactagatgtaaatttcctattcctaatcacctttcttccacaacccagaaaacaataccttcaatggatttgctagtgttacagattgtgtttgattatttgtccccaaatttaaagtacttcttcatataattgcaaatatacgcatagaaaataaaatattttaaaagaaagctaatattatatactataagtcttaatttgagattatacatatttatccaataaaagtatagaaggatcaatcaatactgactagtgtttccctatgggctccatggatagagcccataatttgaaattaggagccctaggttcaattcctcactttatggttggtgctatatgtccaagagcagtaaatgtagctgagtctgactttatttcaatataatgaacatagatattctgttatgctgcattttcagatttttaaaaaattaagatctttaatataaattatgaaactgttcttattaattatatactgggtcttccataacttcccgttaccccatctatcatacctgtattgaaaacatcattaatcaacattctctagctcagtatttttcatcccagattccctatctggtttgagtactgttttctcaagtatctgaagggtagtataaaaccagcatcattccagatgcataggagataagttatttcattaaataagacagactccttagggttttattcccgtcccaagttcaacagagttacagattaagtgcaaacacacagaatttatgagaaagacttgaggtaactcacagaatagaaggaattgctaaaccacgaattcttggagaggaagatactctgggtaaacccaaactcttgaactcacagttcctggtctcctctaggtttgcaccactcatataattgagctccagtgaacttgaggtaattcttttcaggttctgaattccccaaatcagaaaacttggatagctctacttgtgttagaagccaattcccagatcagtctttgtggctggaatagggatgaggggacaagattataaagcagggacatgccagagaatggctgtgaggggacagcctaatcattcattaacacctggtatggtccacaagttagtatttagatctagtatttaaaaaaaaaaattttcctaggatgatgaaattattaccatctcttttttagttttacctttgacataaatttagatcttaggatccaaggtaaataatgaatttcagctgaattgtgacaagctttatttcaattgtgcatctttatcagagatctaagctaaacacagaattataaactttatagttggaagagggagatccataacatttacgagactttctctggtgcacaggcgaagttgggatgaaaaactgggtctctagatcagttgactcaaaacagagatgatcatcagaatcacctggaaaactttctacaagagtatatttccaggaaccctacccacttccactttaacaatattggggtggatctcttgctaacatattattatttttttagtttctagttagttccaatgaccagtttattttaaaactcaatgttttgcagtttttgcttttaatttttgttaaagaaatgggccttctctcaccttattctccatgaaaataattcacatcccaacaaatagcacaaaatacacaataaaatagacacattataagagaagcaatcaaaaagcagagcacattgtcactacttagtttggaagcaatttcattggttagagaacattctggccaaactgaataacactacctcttgaatatgtagttataattcacaatacttccattcacttctcagagtgagcgttctctggtctcatggataggacgcattccacattcacaggctccaattgctttttttgttgttgttttcttttctacttgtgggtaaaccaaataccatattaaaacaaattatttctccttttaaagatcattttccttgacagtatatggcaaaaatatttgatatattttatagcccatgcttgaaataagttgtctcctccaccattaaccatatgatatgccttccctaccaacaattcacaaaactatacaagttaaagagatcttccattcaagggctttgaaaaatttcttcccagttacccaggacacatatacaatacctcagctttctaccctcaatacactcttctacttgtgataggaatagaaattcttctaaattgatttcataatccaccaatggttcaccatccaaactttggaaaacacaaacgttattcaacctttccattttatacattaaaaaaatgaaggtccagggaagttaatagacttggcaaagaccactcagcttatgaatgcattggactagaatttggctttatgaccctatatcctgtgttctttctatcacacttttatgcatttatcatttttttctttctttctttctttcttttttttttttttttgagacagattcttgctctgtcacccaggctggagtgcagtggcatgatctcagctcattgcaatctccgcctcctgggttcaagcgattctcctgcctcaggctcccaagtagctaggattacagactcccaccactaggcccagctagtttttgtattttcagtagagacagggtcttaccatgttggccaggctggtctcgaatgcctgacctcaagtgatctgcctgtctcagcctcccaaagtgctaagattataggtgtaagccaccatgcccggacacttttctgcatttttaatgccattttggatagatttaaatggacatctttacagtttcaggatggaaatattcattctgtaaaatacatgacagtctattttttcatcatgacattccatcctaatttgatccctatcctagatacctaattttataactccttgagaaaatatataaaattataccttcataactttcatataatcaaacaatattatcatttttctgttacaatatcaaagtgaagtaatcatcccaactacctcaccatatttgcactaattatgttagcctctcaacatcaaattttgttttttgcagtttcttttcatatgtattattataaaattctttgactcaaatgttcgaatattcctacttaaaaacagataatggattttattttgatagaattcccacaataggaatagactctatatcattttgtaataaaaattacattaaatacacatcacaatcttgacgagaagttaattattagcaaatgctaacaattaccaggcatctcaggctaaggtgatgtgagaaaatgtctagtattcataagttgtcaaattaacatcaaagcaatatcaactaaagagcattaaaaaatagcaatgccttggccccagaccccacctcaatgttctcttttaattatcaccataagacttgggcactgggagttttagaagcttctcaggtgattctaatatgtggaaatggtaaaaacgcagagtttagagagatatgacctaggcattcaatgtgtaatatctgtggctctataactgtataaactttgtgtaataatatcacaaaaccttatggttctttaaactaaaattatactttagatatgatctatgtataatattgccttaaatttgcatactgcttatgtaacttatcaggaaactggcatattttctcttataaaggagaaacacttaaatgcatttcttcctcccctttcccaattaatatatgcttagatgttacattatcagactgacctttgtaagcatctgattttaactctcaagctttctttgtaagggccaatatttatgtaaaaccacacaaatgaatatgcaatcccagaagaataaataactatgccaatattacatactgcctttgcaaaggaaatatcatctgagagtaatataggattgtatcttgcgactgacttagacaatcacatttgcccagatacagagaaatccctaattagctaaattcagttgttttcaattttttctaaatttatgatcgtagcctatctctaaaactcattgtacaaatatatatgctttaagtatttctggtgaaaccttatgtaaccattcaaagaaggcaactgtcgatattatattctaaagagaaggtcatggaagaaagtcttgggataaaataagtagataaagaaataaagacaaagaacaagagctagtcctgaaacagtttaagagaaaagtagacactccatccatcagtagcttttcctggataggctcatctttctttaacaagttgacacatttgcaaactgcaggctgaaattttaaacgtctaagctgcttttccttcttctaatagaaaaggtacaaaaaatggtttttgcttcctttactgctgtgccttaataaacatttggctcaaggttttaaccaagccaaatgttgactaaaagcctcctcataaaaggctttaatacatttttgcttgtgttttctttacatgtatttcaatttgatgacaaataatttcttccccatttccctcatttgctgctgcatgttggactaattaaaaagcaggctctttggaagctggaatgagagaaaatggaagagtgggcaggtgggtcaagattgaatgtccctggctctggcaatacataggattctcttcagtgaaacattctccatctagctcagattcaaggaaggcaccgaagaagcccttcagcctttcctacttcaggtcagagttctttttatatttggcatacaaccgagagacatcagaattctatacaaaatggaaagttttattcttcccagcaattccactgcattctgtggcctcttggtgctgtgggcagccttagcagatttgaggcatctcttagggcaaagcggttttgaggtattcttggcgactgggaagaataatttaacttctcttggaataatatcacattcagcagaaaagatctgctgtgctcaaggtcataaatcttggctctgtgaatattcagttattcagcagaacagccactccaagccttcagagcacttttggatgctgctgcaggtgtttcctgtagagaactccctgacatccactgagttcttgcatctgcctttacccttcttgatgctgtccattctgctctctgaacaaacatattctcttacacttatgcacatgtatgaaatcctagagatttccctgaatcaacatatgcatatagatatatgatggacagaataaagtatcaagggataaaatatatttttaattttgtatttcacttgaaaattgtaaggaccattttataatgtattgcttgcaaaataagtcatggaagccctgaaaaattaatcaattcactaatcaaagaaacatatattaaagacctactatgcatgaggcaccatgctaattgctttgaagaagacaaagttgaattagacagggatccagtttacaagatatttacaatgcaaagggggatacaagacatataaaaggctatggaacttaaaaagaagaaaaaacaattctaaagtattgagatacatttcattacaaggcaaatcttagataacatcttgaaagaggacacatttaaaatttaggagatttgaggaaaagatcctccagagtatgatataaaaatgagtgaaggttttgaggtgagaaataaaattaatgaaatttgactcgatctaaggtgacatcatgaagaataatggcaaatgaagttaataagtttgtttcaggccagcttgtaaaaagtccttgaaaaaagaaaaaggaattccttatatttttattagaatatccatcttaaagtgaatggtgaattattgattggcatggatttagggacaattgcatgtcatctttttctgttattagtattactgttttgaagaatgcaatctaccaaaattgaaggtaatagtttcaatgtaaaaatatgcagagttaagcgtttggaaagcactattcaggtttagtatataggaggaaatagggatgggaatggtctattactagacatttttattcttcctacttatcaaatagaccaatatgtgtggaggaaaagccttcttctaaaaagggtttgttttacactacctgtcaaagaggatattggttcactcaaggaaactaagttatattctatttaactgtgagatatattccaataaattgcagtaaacataatcttaaaatattataaagaggcctcagattgtttaaaaatactatattgaatatatgagaaataaaagctcaagatattctttaaagtatatcctatgtaaatgccaatttttctttacagaataaatctaactacaaatgcatacagggcctaaatatatttttatcttgattttgttccttttcttgtgtttaagagccctgactccagaatcacaagagacaaactgccacttcatcacttattagcgctgtttgtgtgggcaggctatttaaacattccaatcctttattttctcctcaataaattgtaaaaaaaagtaatgtttactcagaggttaatgagttgacacttataaaattattagcatggagcctggcctcagatatcattctcttctgtatacaatttttatgtgtttgttctttaaacttataaatcagttccatcagactttttacttcatggcaagctgcttttatttctaattaagaaaacattcctgactccaaaatttataaagactttttctctcttttcttcaagtatttctataacattgtaatgcatttagtgtttatccatatgaacggtatgatattggaatctaattttacttttccacatgtataatcagttcttccgatactgttaagtattgtatcctttatgtaattattaaatatcatatataacagataaaaaactctgtatgtacttacatcgatttctagactccattttctctaaacatcccttgtctgtttctgtgccagaactagactgttttaattatagttgtttcatagtaccttttggtatcatgctggtaacttccctaaactgttacttttctcaaaaaatttaggcttttataaacatttagcttgcatatcaattttacagtttgtcaagtccctaacctcctccccaaattgagactgtgaattgaattgccctcagtctataatttaaagtttgaatcatcctattcagaggcacaaagttgttggttttttttgtttgtttgttttttacttattttggttgtgctttgtacccttccctaaagtgttattattttctttatgtaaatcttacataaaaccagtattttttaacgttcaggtaagatttttatattcctaggatcttcatgtggaaaaaaaaaacttaatgatttaaacagctatattaacttgatatatgtaattatttgagagaaaatctagtcaataacttttgccttcccactccagacttctaccctgattatgttaggtaactgaattggaaagaaaaatatttattctttatattattttttctgatctgaaaaagatagcttgtttccaccagatacattcatattaatagccatcaagctatactactttcaaattatatttatgacaataaatgattcctacaaattttagagaagactatcaaaagcaaaagaaataaatacaaaaattaactgggaacaaataagcaacccctggaggattcatctctatgaccctacagtccgaaactaaagaataatacatcctgatggacggctatggaatgaaataaaattctctattaccagttcactagaagaatttttttcccccaggtttgatctctttatttagtttatcctccaggttaaaagaaaattattcactattactcaccaataactcagtaaataaaaattttgcaaattcagccatttcaacatgccagggaatatctaaaggtgtatatatacaaatatttatatataaattttgcatatgtatataaaagaaatatatatataatatatatgaatataaacattcaggtaggatatttatatttatatataaggatatataaataaaaaatgtatttatatttctttttcaaatgcacagctcttatatacatatttctttttcaaaagcatggctacataaatttcttcattttgatgttctgcttctcttcagtttgatcttgcatatcacagtgcatttataaaatctggaaagccatctaaagaatttcaaactttctgaatacaaaatgtctttttccaccagacaagagtcaccccagtcactaaacaaattgaccaatttcagagtatttcctgcttctacttgttactgatgcagcatctggctggaacagagtgcgactggatgcagaaaagttcatgattgcttgattgactgattttgatgttgaaaatcatgtaaaattcatatatattcaaaatgtgattcaaaatagatatccaaagacacatcccagaaaatcagtgtttttctataagctacattaaaagtttttctaaatcttcatttctaagaaaaaataaataatacaagaatgtatataaataagaatgctacctctggaattaatagcacctgcatctgtctacctctttagcaggctttagttttctttctataaatactcgtcatcacataaactataacgtatttatttatttctacatctcccatgaaaacgtgagctccatgaaggcagggacttttgttgttatggtagtcgtcatggtgattgtttaccactgcatcccagggactgggagagtgcctgtcatgtactaagcattcaacagatatctgttgaattaattattcataattacttaattcacaattttaacatgagcataagaactaagatcagaccaaataagccttttcaaaatattaatgaaattttatattattattatctactacccttttaaactttactgtgcttaaaagaaaaaatccagcttgattacagagctcaaagaatgctattgcctgaatgtaagatcgagaatagcttttctttacatgattcccagtctaaggagagaaagcagatagtaaatcacacattaaacaaatcattcaattacattcgtttaaagtgctgctacctaggaaggaaactgaaatgtgccttgagaacagatactcaactggcatgctggaagggcttccctagaaagggatggtttggtttctaggacttgaagaataaggtctaaatcaggtagaaaaggcagggaacattccaggcatccacaaagatatatagagaggctgagtccaggaagatcttgacaaactctagaaactgtgagactggtaatatactattaggttggtgcaaaagtaattgcagtttttgccatttcttttgcaccaacctaatagaaaagaatcagtacaaaacaaaaggccgctattctggtgtcagattttcttctcacactgaagccagctggagtccttagaactttcctgaacttttctgcatccagcagcactctgttccaggcagatgctgcatcagtaacaagtggaagcaggaaatactctgaaattggtcaatttgtttagtgactggggtgactcttgcctggtggaaaaagacattttgtattcagaaagtttaaaattctttagatagctttccaaattttacaaatgcactgtgatatgcaagatgaaactgaggagaaccagctctttggctgcagatctgagatctttctatgggaggacaaaaaggagctaaatcacattaatctattttccacactagtgacatgaactaggttcaattattcaactacggaaaagtcccctttttatgattcctcaaacggtgtaatttttcctgcctctgtactttcatgttgtctttttttttttttttttttttctctctgagctgttccactaggcacatatttctagaatcagctgaagttccaccatgattctctgtttggactatccttcctctgaactcctccaatattttatgcccattactatacaactcttgattgcatctgagtcccttgaggagacagggaggaacaggacaggagacagggaggaagaaggacagactatgcctgtgaatacagagtattttcctacagagaatatttctaatgaagatgtaaaagatccactcaaaactcaagcattatattgtttgagagggcaattttttttttttcaatttaggtggtctgttttatggtttcttctatggaatatctgtgcaacaggagatcctcttgaataattacccgctgaacaaactgtatctctcaaacacatctcaattttagacttgttgtttaggtcattccctggagagtgtcttgaagaagaaaaaaagcggaaacttacagatagtaggcccagggaaaatataaattattttatatccacttttgagggcctcatattttcttggcttaggtactcaggagacagatataaggcataaaatctttaacattattaaaaccaattcagaaaaatcccttaaccttccaacactaaagcagatagagaacatgaaaactatctatggaactgaaaatcagtgatcaatacatctatgaaaaatgttactattttataagacatccaaagaaatacacaggaaaacaaaatagaaatagcttacaacattcgacactgcttgtgtataatcacacaagcacgtggtatcctaactagtggaaatgcaaagtagcgcatactatggggaatataaattggcaactcatataaagacccaaagaaaagctttactcttgtcctcataattccacttccaagtaatacagcttaggaagaaagtcagggacaagaacaaaaatttgtataccaggatgttcattacagccttaaaattcaggaaagtttgtaaataattaaaatattacactattcaaaaacaagcaatttatgacacaacattaggatggaaaatttgtagtcagtaaaaatcatcttttcacattctaatgacagaagaagaaaaatactccttacattaagctaagcaaaataaatgtagggcatacaaattatactataaattgtactgtacatgtgtgtatatacatatatacacacatacaaataaaggaaacagaccaaaatgatatcatgtatttatttcctttaaacctttgtgtactttcccaattctctacaatgaatatttttatgaccaagaaaaagttaataatattaaataattaatttagactcatttcattatatgcatgaattattccacataaatagctccttgttacaatcaagccaaagaactgtcaaaccatattgggatctacagagactcaatcgccaacaacgacataaggcaaaacctcccacagagaccctcttctctttcacataacactgtattttttaacaatgtttaacagttggaaatgctgagaagccacagatgagatcattaggagaaagtattttccatcatgcttttgtcagggaaaatcccttagtagttctatttctgagttatatttttagccaggctgacaaaatttaaagcaaagtatataaaatgtgtatttgcaagcatctttctctaccaaatggaattcactttaactatcacactgataaagatcatttatcataggcttgtcttctgcatgaccctgtatttggagggtgtgagagactacaagacagaagtggtcaggacctcaaaagatggcacgtgagccgctgcttcaaaaaattaaccagacataccagaaaaatatgatgatgtttatggtctgataggcatctctgtgatctgtaatttatgtatcctatctctgtgcaaccaatggatttaatgggtcagcaagcttcaggaaaaccctaaatggatttgggttcagcaaacagccggtcatcacttctaccccatgcttctaccccacttctacccaccgtgctgaactgcgaagccaaggacttgcttaaactatcaaatccagtttcctcatagaacttttggcccttctatttgtaggtccatctttgcctttggttgctgacatcacattcccagggactgttttctcttgtataaacatatatccatgtaaatccttaaaattcatggcctttgggtttttccttgtcagtcaatctgaatgtccccttcctcagatcctaatagctctgagctggattaggttttccctgatttgcccagcagtgaattcagcttaatttaaaatccactctgcctgagagtttctatttttactttatgaacccataggactgatgaacaatagttagaattgtattcaaattttggatagtttgaattatgtattagttgggaggttcttctttcaaggaaaagaatacaaaattaggtacaagcatgtatacacacatacacacatacacacacacacacacacacacacacacacacacacaaagaaatcacaagtatttactgaatacgccagagctgttttctctgagatttctttaggcagttatctatagacattgtcatagaaatgcttccagattacagtgtggcttcctctccttgtggagaaaactctgtagctcccaaaacttcactaggggaggtgcaaatgagaaaccctagattttaaggtgaagagaatcaaacttacattttccatttgcagaaatgtgttcattagcttagtgagattggttggttttgcttcttattgtctgttaccccctctttgcttgagggtggatgtctgtttctgacaatgatttttgtgaccctgaagccatgtaaaatggaactagtaatacctactgtatcacttgattgttgagaagattaagtgaaatcggagtgaaatggattaatatatcattgtctgaaaattgttacactagaaggcaactccttagagcaagggaattttgttgacaaactagcactcttgctgggacatgatacagagttcaatgattaggggctgatttgcttgaggaatgtgaatgaatcatagatgctataattgcccttgttctgtccctaaatgaagaaaaacgaagcagctgtggtcatctacattctcactgtctaatagccacaagtggtctaaatccagactaaaatacaggggactctggttgcatttatatttatcccccagctgtttctgtctccctattttaccaattccaattcaaaatgctcttagccctgaagaatctgaactgcctcagttgtgcactgtcctctgggtttgcagatgccatagaaatgtctgttctgataataatgtactgagggcatcatgcttatttaacctctggtgaggtagttaggaaaatgcttctgatactgggtaagatcctgaataggaggcccatgctttgtgatgccagacctcttgctttttactgcctttatatacatgataaaacatgatttcagtcagagcaagtggtatatgactcctgacattgtgtgataacacagcacattgtttctgtggagaagtcaacacagttctggaaggatgactcgctttccggttttatgctctcttcccctgaatcctcataagaagctgctctgaagtttaaacatcgaataaaaatgcttccaaacaattaatgcgacagcaaacacaccaataaacctatcggcagcagcctcagtattttacctcagtctttaatgtcagcttgcttttttattccagaggtcagaaaaacaaatgctctgtgagctcattacgtgcatgcctaaacaagcagaaaagtaggtgcttttccaaatgccagacaatgaaatctagatttttctctttgtacttcactgtaattcgggtgatagaatacttgctaatacaagctattaaaacaaaccaacaaacagaaatcagtctctcatagcctattttaaaactccctccctgtgttcttaactgttgacttttaaaccaaaaatgccagtcaagaagtacaaagtgatctttagcactgtctagcttaaaatgttgatagttaatatttgaatataaaaaagtataaaaataaataatagacaactcattttagctaacactttggaattaactttgagtagtagaaaactacacaatataaacctgtttttcagtggtttctgctatcaagtgaattgatggattatagtaacctttgttacctggcactcagaatactacttttaagcacaggttcttttaataagaaactaattgatatccataatgtgacccaaataaattgtaaggtccttgaaattaagttctggaaaaaataagcaaattcttaggcttattttattttttctgtaattctttaaaaatgagtgatctacatgtcatacatgtatatggtaattctctcctgtatagaataccctctggccatcctgaaaaataaaattaactcttgagctttatgagattttctaaagaaaaagtatctctataaagaatgttagactgggcatggtggctcacacctgtaatcccagcactttgggaggccgaggcaagaggatcacttaagctcaggagctcaagaccagcctgggaaatatagtgagacctcatctctaccaaaaataacataacataacgtaacatgacatgacatgacatgacatgacatgacatgacataacatgacataacataacataacataaaatacactgggaggctgaggcaggagggaggattgcttgagcagaggagatggaggctgcagcgagctgtaaacatgcactgcactccggcctgaatgacacagtaaaactctatctcaaaaagaaagaaagaaagaatgttaacttgccgacacacatgctctcttccattctttttcctctccttacaccatcccttcttttttccattactcacaatgatgggattagtacagcttgtactggggctttggaactgtaataaacaaggagcaattttctggtcctaattaactcctgttaaaataagcactgcacaacaatagtctacccagagttgcactgaaaaaaaccacaacaatcctaacactctatgaataatgaaccctatttaaatgagcaggttattgtagggtcttaatgagctgctctgtggccacagggcacatactgcatcccagagtaatggagcattttcctgcagacacttgcaggctgggctagcagcagaacagcttcttccctggtaaaaccagagaggtagcatcaaaggtttgttatgtttccattttactttttcacacacctcttctgcaactgacatcagccatccccatccctttttgaaatgttgtcttccttcttttacctccaggcttctatattcaagcatcctcctcctttatatcttttctgaagtataatttacagaccataaaattcacttcgtttaagtatacaattcaatgagttttggtaaatttccagtgttatgcaaccatcattgcaatctaattttacaacattttcattgcaccaaaaagaaactttgtgcccattcgtagtcattccctcttcccacccccaggccaacctaagcaaacactaatctttttgtctgtataggtttgccttttttggacaattaatagggaaccacataatgtgtggacttttagcataacgtttctgaggctccatgtagcatatagcatgtggaacacaatactattccactgtatagatatactacattttgcttgctcactcatcagttgatgcacatctgtgctatttctacttcttgttattaagaatgctgctgctatgctgtgaacatctgtgaacgaatttttgtatagacacatgttttcatttctcttaggtaggtacctatgagtggaacagctgagtcatatgataaatctatgcttaacagtttaagaaactgccaaaagcttttccagagttttgcattactagcagcaatgtatgaaggttccatttatccatatatttactaacactggttattgttgatgttttccattatagccatcctagctggcgtgaagtgttatcttgtggttttaaccatttccctattggctaatgatgttgagcctctatcatttgtgtctgactgttgtttctgttttattttgttttcattcctcgttttagtattccttgacttttgtaatgtcccctttttcctgtatacctatttcctgatccacatggatcatgttgactcccactcatatgcaattaactaccatatcttaatgaatgctgctcatggctcattctcaatctatttatctccatgaagttactgataccatatgttaaaagaaaaactttagacaaaccaaatctagcagagtttatttgagaaaataaatgatttatgaatagggcagcagtctggaccaaaaatggttcagaatgctccactctaccacatgtgcagtctatattcatgcccatagaaaaggaagtaacatacagaaacaacctgattggctgcagtcaatgtttgccttatatagtcgtatttggcagctttcagtctcttaatggctggaggtttagttgctgtgattgattgagactcagttactttttacaagagtatatacttctagtttaggttatagcttgtaaatacaccaacttaggttacaattcactatgtctagagaaacttttaggcaactcttaaattatttatggaggcagttttggccaaacttaattcaatttcatacatatttctacttggaaaaaaggcaggaaaattgaatttttaatttacacacaaataatgaacagaagttcaaatgtaccttgatttaatgcataatataattgcgtgaagtattagtataccataatcgttcataaatatattgcttttacataagcatactgaccacatgatcagacttgcctgttctcttactgtcttacggacagtgtaggattcactaagctgcggtcatttcctctttagaacctagctgtgatcatcttctctgcctgcctcttactttgtttccttcattttcttttgtgacataatggctgtagctgaagcatacaggtagaatctcactatgccccctactttcttctcttttggccttttcatcttttttttttttttttctggttctccaagtccatttatgcatttattcattctttttctctttttttttatactttaagttttagggtacatgtgtacaacgtgcaggtttgttacatatgtatacatgtgccatgttggtgtgctgcacccattaactcgtcatttaacattaggtatatctcctaatgctatccctcccccctccccccaccccacaacaggccccagtgtgatgttccccttcctgtgtccatgtgttctcattgttcaattcccacctatgagtgagaacatgtggtgtttggtttttttgtccttgccatagtttgctgagaatgatggtttccagcttcatccatgtccctacaaaggacatgaaatcatcattttttagggctgcatagtattccatggtgtatatgtgccacattttcttaatctagtctatcattgttggacatttggcttggttccaagtctttgctatggtgagtagtgctgcaataaacatatgtgtgcatgtgtctttatagcagcatgatttataatcctttgggtacatacccagtaatgggatggctgggtcaaatggtatttctagttctagatccctgaggaatcgccacactgacttccacaatggttgaactagttaacagtcccatcaacagtgtaaaagtgttcctatttctccacatcctctccagcacctgttgtttcttgactttctaatgatcaccattctaactggtgtgagatggtatctcattgtgtttttgatttgcatttctctgatggccagtgatgatgagcattttctcatgtgtctgttggctgcataaatgtcttcttttgagaagtgtctgttcatatccttcaatctaatcagtagccaatatagtgattccattcaaaggttcaaacgatgcttaaaccaaaattattatccatttcacactctccaaccaagtgaacaagaggaaagaggagaacaaagcaaggaacaaaagaataaaaaaggtctaattaatttgcaacctggagaaaacatgtcagatcttgatgtaaaatagaaaagtctggaaaattgggattttccaatatgcagttatgtggccaattttagagatgcaataaactgagtgtgattaaatggtaaattggactgatcaggtgagccatacttttcttgtgaaaagtagcaagcatggaaaaaaaaaagatacagctctatttccctttacttttccatctgtatctttcatatttttcaaaattaaaaaaaacaccaaactatttttcaagtattaataaagaatcaggaagaacttcatttaaaacatttttgcctgcccttcaaaaaactctttcactgtttcaaggccattgcttctggaacccagatttgttctagcttacagcctaggaataagaatatatactttcctgtcaggatggcttttgagaaactctgagaataaaatctgacccagtccaatctgacaaggttgctgtgcttgtttgaatgtaaaatgattcacaaagtgaaccgaaagtttttgttaattgttaaaaagcctcagcgctgtggcttagtttaagagctacatctggcattttggtaggaacaaactacttatgaatgaggaatagttatattttttgtgttgttgtttttatttttcttttggggggggagggaagaaagaggacagaagagaactaggacttagtattttgaaaactgggacatcatcactggcctacccaccacataaacgtaactagtgtatatgattttaactttgtaatcgtgtacattgacacttctttttgatattctagatctatacaaagaaaaatactcaaagagatgcaggaaaataaataagaaaagaaattctctggccagcaattatttagcagtaaattgacatataaatgtggtgtaattaaactcaaatcacttttaaacctaattaccgatacaaagaaatgggaaagcatcgacctctaggcttcagaaagcttaggtaaaatcattacaaatctgtcagttgtaccatcaaaataaatctggaatctaagcacttcttatcattttcattgctgccaccctggtctgagttacccgcattttctgggacttctgaaataacttccaaactattgttcctcagacttaccccacctctcatacaccacttcaccccctgcccccaaacacacaaaagcaaagtgatcttttttaaacttaaagtctaatcatgccccttcttggctcaaaacccacccatgagaaattaaataggcttttaaagttacgtatcaattttaaaagtaacacttataattctatactctaaagagtacctgagtctgtactaggacatttgcttccagaagtcatgaaagtggtctgaagaagtcacaaataggagtttataaagttctagaagtatcaagtttctagattcttttcagtttttgctctgtttaaacattcacaccaactgaggtctgggggtgaaaggggaagttaatttatcccctaaataatatttattttgtatacaaaagaatggttaaatgtattcagtagtctaacctgctcttcttggctattcattcctgaatgacaggaattccgtttgtaccaccctcatcaccaccattaatttcatgatggactagctacttcacagccctcatgtccccaccactccattcaagctcaagggctactgaagcatagtagcagcttacaaagaaaaaaaaaaagacaaaacaaactcttagcaataatgttatgtcattcacactagagacaaaataacttcattattagagatgctatcattgaaattaattcactggttataaaaggaaggctatccaagaatatctgcagttttgatgccttggaaaataaaattaaatggaagagaaattaacaataataactcagaaataaacactattaatattttatgtaagttttccaccttccttgatatatgacataagcattttcttaactcaataaaaactctaaagaaacatagaaaacaataacaacaacttgtgtggtttctcgtctctctcagagtaaaagccaaaatcctgaggatagcccgtaactctatacaatctggtccaccatttcatctgtgggctcatcttcaatactaccctaaagcctccagttttgctttagccacatccatctccccattgactctttaataagccagacagttccctggattttggcatttcagtggctccttcctctgcctgctaaattcctctccaacatgttattcactgtgtgctctctcacctcttctaagtctttggtccactaccacctacaccttgcctttacatgccttgctttatttttctccataaaacttaactactgagtataccatagttaatcactcatgtttaaatattttttcgtccatctcctacagtagaatatgagtgacagaggacagggatcttcattttttgtttgtttggtatacccagggcccagaatgatgccatactcatgataagcagttccgtaaagagcgttattccctgtgacagaatgtcaggagtgaagttgtcaagtcctttttctagagaagtggtgggtgttcttgcttctcattaactaaggcacagcctggattgaagagtagacatgagataagagttctgtgttctgccatcaaaaagacaaaaaagaagtatacatcttttcaattcttttatgcttgaaattctcaccttcctttaaatcacaaggataatctgttgacccttacaacagctctgagctgttattatccacaactgagaaagaaaggaagaggctgtggtatttactgaggtcctaaatggcagaaccaggactagtaaaccatgttattaggtttctgcttctatatagtcacaatgaactgcagccacatctcccagaacaataaattagcaagtagacagaagtctttctttccaccctcaaaagaggtttttagcctttacaattagcttttcaataaagatacaagaataactatttcattgatgtgctctcagcagatcttagactttccattatttatttcctttgtttagttcaatgtgaaagtgcttggctttaatcttcatttcacttagttttatcaaaatataaaacccctacatttgcataggctatcccagggtccagaaagcattcacactttgtccatctgatacaccctcaaaacaacgctagctgaggtaaaagcaggtgggtgtatctttacctcagaaggatccttgacctgcccaatgcgacatcagtggtgagcctcagaaacagggcaaaaaaaaattgatctctttagtgtaaactcaatgtttttaatttacaggaaatgcattcactggtgtgtgtgtgtgtgtgtgtgtgtgtgtttgaggcaggggagcaattacataataggaagaaattatctaaattattcttatttcacatgtcttctagaaatataattgtcacttttgcactccacttccacttcctggcaatttttctgctgccataattcaaaaacagactctttggccgttccttcacattcctttcccttttgtctttacagcctcatcacttccttctaccgatcttcatttcctgcttttgagactttcccgctgcctcctcctgtcatcttcaggtcccaaatgcagttttgccagattccacatccaaaattaacatcatttcctctttggctacactagtaaaggtgcttccttttatccctccagatccatatgtagcccaagtttgaagaactttcttctccctttttagagttgtataagcttcctgagagctggctctacaatctccatactctccagcccacatcacagtacagcactgaaaacagtgccttttatactttgggtaggcataggtatttgagaaatgagccatgaactcaaaaagatagcttcagggaagtcatgagcaagggtgacggcaggaagcactgcttgcctttcttcaccacccaacttctgccctctggccctttttcagtcctccactttgctccccactggcatgccacacatgtgagacagcatgaggtatgactactgttccatcaagtagggaggatgctgaatgcatcaatgacacattgcctcaaggttccattccactataagtatataagcaattgttctttggccagtgcatgtttttatgcagtaaactagttctcattttgctggacatttattacaacatttacccattacaaagaacctcattatgtttaatatatatgaaaacacgttcatttgataggcctattacttgatccattttatttgggtatacaggataacacaggatattttccttcaataaaatagtgagaaatttttgatctaagaagcttcaatatcacttttttttttagtacgcaacacattggtatactgtctgggggcaatctatataaatggaatgaatcctacttaaaaatcatttgttgacataaattattgagaatttcatattttaaaaatattataaatttctttacatttagaaaccaaatatacttctataaatgccacacttatttggaatatatttctgtacagtgtaagttgaatattcatttatatttttctgcaaaaattagttgttcattctttaattcatatacattttagcttcctttttcttttttttttttcccaaatccacaacttttaaaaattttcaacaggacttccctttctgaaagttaatgccttgattaacatttcacaataaattataactatgatttatacttgatttttctttgatttcattctaaattaagtttctattttaatatgattagaggctttgaagaaacaatgggatctgggaaacatacttccgctttatattaaaaaacagatttatcattacaattgttccaagaggactggcctttttctattttattcattgatttatcccaacatctagaacagtgcttggtgttcagggggcactaaacaaatacatcaaatgcctcctatccactgcactttacccactggggacttggaaggtcaggagaggcccttactgtgccagacattatagtaagcaatgtcacataatctcatttaactatcataaatattctttgtggtaactttcaacatccccatttcacagatgaggaaatagatgcattgagaagttaaggttttcatgtaagataacagaggtaataaattgcaaggttagaataaatgccttgaagtctgtctgtctgcaaagtctaggctcttaacaacaccctaagttgcctgccttcacccaaaagtattgtaactagaaggaacattaattactcttcctctatctccacactgtatatgaatattcagactgactgagataaaattacttgcaaaaagaaatctttgcaagtcagtgccacaattaagtcacgacctagtaccattaatctgttttggtttttagaagggtggcattctcctaccttgaaacatcaaaactcatctaatgagaagagaccttgttcaagggtaatgtgtagcttgcagttagaacaggtgagaggcttgacagtagcaagaccgactgctggtttacagcaatgtgaatgtctggtgcttggactttccaggaagcaggccagtgccatatttctggctggctgtctctgacttgaatttagggtcctccaagatactggagcactacctcccagaacctcacgtagtccattcatcaatatatccaacaaatatatatatggtgtttcaaatatgtggtaggcactgatctcagatttggatatatggagataaagaaaacaaagtttctgaccttagaaaattcacaatcttattgtatgtgtaggtgcatgtctgcatatacatcttaaaatatcattgcaagttctttgtgtagtatgaaattgtaagggaaaggacatatctttcattctcatctaggttcatgactagaatcttacctcaagtatcaagtggttagtgttcattcttgcccatatatatatactagtatgtacttttactattcacattttacagagaaagaaactgagtttcagagacctccaggtgactggattagcttctcacagcaaatggtgacaattcaaggttgaaagaatctctggtctctttgataccaaagacaaagttctaatccaccacggaagaaaaggttcaggaaaaggttcacagaagaactcacgagatatgtctgtggtcctacttttagacgtgcatttttttgtggagattgcttcctcacctgagcctcagtttaacatgaactgttcaagcgtaacaacaaattaggtgcatgaatttctctttactttttcagaagccagttttattccatttagcaaacataaatagtgatttcctctgccacattgctcaactatagcttattaatggcttccacttttccttgcttgtgccttaagggtcctcagtaattacccaacagctgtttagacacatagccccagaggctggtatggtctcctatttgctacattaggaaaattctatggtacagcaacatgagtgacagcatcaatataccttcataaaatgatgaggttctatacagctagggtttccccttccttctaaaataactttactttttcatgtcatttagaacccccaaaaaaggattactacttctgatgcaccatctgaagactatcctggatacttttatattaattagaaactgaaatgcttgacatgcaaacgctgtggtagccgtctctccccaggcaggcctgttgttatattcatgaagtgcttcctgaaagcttcttagacttgcagaggctgggaagggaattgtttggtctgtccatcactgcaattcctcctatttgttatttgtattattccttaaggccttcactccctacagattctgtgacagtattgatattacaatgtacatagcatatatttttcaagagtctgagggtacatgtacaaagtctatttcaattcctctcaacaggcactgaaatgctataaactaaacaaaatgtccttaccacagcttgcataatgtagaaaagtatatcatctgcaaggaaaagctgcagattctattttgctttcagtattttgaacaccacacctgccctgctatattcagggctagatctttgcacagggagttagtggccacctacatggtatgttttgaaacatacagaaatggacatcttgctcaacacatacccccattaggtaccaaatgctccactttcctatcttcaaattctagccaagtatgaatggttaacatttcaagaaaatgatggtattgtccaaaaacaattcctacaaaacctatttcttctctaattaatatattagaagggtttagggtaagcttctccaaccagcaacctgtaggccgcaggaggcccaggacagctttgaatgcagcccaacacaaatttgtaaactttcttaaaacactatgagttttttttcttttgttttgttttgtttttgcgattttttttgttgttgttagtatattctctgtgtggcccaaggcgattcttcttccaatgtggtcaagggaagccaaaagattgggaatcccttgtttagggcatcaagtagtaaatcctgaacctctgggttctgaaacaatgagaattttgatcagggaaatttctgtatcagagagtaaggtccaacctaatggtagcttataaggaataagatgaggacactagcactgaaggtgtagatccaggacttcccaacttgagacagaataaaacttctctagagatgttgtaaaatcattgattcttagactctacccccagtgattctcatttatttgacctggcaagacatccagaaagcctaatttttaacaaacacacagatgattctgataaatcattaggatgcatggagcactatttgagaaatgatgcccagtaataataaaacaagatacaggtgatagaggccagagaagaaaacatgtccaagacatcttcatctgcttcgcagtgtttcccagggctattgtgctctttgacttaaaccgttcatcatgtccttttgctcattgaaacaccatccacatactatacatattttttctgcctccaaagaaattattttctctagaaaatcaccttgttccttccaactttgctgcttgttctcacatctctgtcttttagattcatgagttttgagaggattcttggttcttctgggaaattaaccttcggactctcctttgtgcttcttagacattggtttttgtttgagcttcagctctgttccctctgttttcagtttattgacctcctctccatgatctctggtaacaaactgcctattctaacctgaccctatggaacctttaaattggagactgaagtctaagttatctctttagataaatagaaaaaattagagaaaatgcaaaaacacatgtttggcattgtactggtttagaattggctaattctgtttgggttggactaatttcacaattacttgcatgcctttaggatacatgacaattaatgtagtaaaggtaatttcaattcattctgggttgcagaaaaatgtgaatctggaactttcaaatgcatatgcataattcacatatgaatcatccagaattcacaatctatgtgtgtcacagtatgcactacatccacttattgattctactgcaattttctgtatcccaaatacaattttgagcctaaagatttaagaatatttttattactttaacttttcttattttagttggctgaaaatacctagaacctatttcccaatagctgaaaccctgctttctgattctatgcatctgaatctcaatggcaccatctctaggaaaattgttacttaaatatttcaaatacaatctttataaagctcctactatggtcaggcacttgctcaggggctaggaacataatgctgaacaaacagatcctctaggagcttacagtctattatggcagacagacgacaaatgcacaattaaacaaaccaattatttaaatcatttatgaatgctaaaaggaatattaaaatttattgcagaaaaccttctgcattttccaaacagaatgcgtaactttccttctccctcttacaaaagaaaataattataagacaaactaaggaacaaacagcatgcttctctcttcaaagaaacttggctaagccaagtaattttctgctatagcagaaaatatttatcccaaatctctaacttaaaaataaacttttgagaattcaaagtttaaagcgtgtgtgtgtgtgtgtgtgtgtgtgtgtgtgtgtgtgtgtgtggcgtggcgggggcgggtgggtagaaggataggcattgggtttttttctctacattgatgatttaaaaaaaaaattcttctccaactttggctccagaattaccatgtggaaccaaaggcaaagcccttgattcgcttgaaaaatttagcaggaaagtatctgtagttaattttgggttacacaatgtccttcactgtctgggcatagaaaagctagctagctcatctcatccagaaactctgccatgagtttaaaaaccaaagcacatactttgatattcactctgaaccaagataaagctttaggttgacataataaaagatggagttaacattcctaaaaaaaaaaaaacaaaaactatgaagctgtaggatatatttcagtcttattttgcaataaaaatgacctaatgctatctatcaccttctttgcagaacaatacttcttaataaaaggcatagagatatttatccttcaaattaaaaaaaatcatgtaatttttggttctttcacatgtatgctttcagaagagaaaaaacaaatcatgttaaactttacagtatcaaatgtgataaactaaaagcataattaacttgttctcttaacataatatggttgttttgctagatcccagtatactactttttccacaggccacgtttttcctcagtatgcacaaatgaaaaagagattaaagaatttgtgtgacctacaataaggtcagcttctaattattatgctaattccatgtactagatttaatagatctactacttttctaccagttaataaaatagactctaaaacactatctactatctaagaagggtgccctctcataccttaaaatactctgtttgaatagctgtgaaggatagtaaaatgtcttactattctgttattgatcctgaattttaaacagataaatgccaaccagaattaacttatttcatgcagcaacatctcaactctttatgttttatttttgaaagagccatttttctgaaattcccctactagataaataatctgccgaatcaaataactgatctattggcaatcccctcaactgaccaaataggctacaatgagttaatcacgcaaaatgctcaccacttgaagtcagaaatccaaattttgtgctctcttcaaccgactctgcaaagtatttgagcttgtgacttatttgagaaagtaacaatttattaacaacacagcgtataaaatggtaggttttgctgtggttttggaggtcagtttatcaaagtgaggcccttctctaatcatatgcaagaattgaatcaactaaaaaacacatgtttggatggatcatataatttaaaatctggattatgcagtgtagaactgtgaaaaaaaggtgaaaacctgctttctattcttggttcaattaattaagtgtgtgtacctcccaccttttataagcatcttcttaagacaccgttgacattcagtaaacaacacatgttgaaaatatgtaatataaaatatcatagatgatattttatacatctatgaaactgcaaaataatcaaaggtaacaagcatacctatcaccccatacatttttcgagcctctttgtaacctcttgttcccttccaccgattctcctggtaggaggccaacatttatgtgttttctgtcactacagattagtttacaatttctagaatttaagtaattgagataataaagtaagtagacttttttgcctggtttctgtcactcaacataattattttgagattcatctatgatatgcacatcagttgttcattcgctctcattgctcagtagtatttcttgcatgtatatgccatattagtctatgcaagttctggtggtttccagtttttgtcttttacaattaaagctgtcacaaacattcaaaaacaagtcactacagtgaatttttctttcatttctcttaaacaattactggggagtataatggctagattatagggtaggtatatgtttagctttttagagatatatggtaggtataggtttaacttttttgagaacctcacaaattattttccaaataattattttccaaagaagttgtaccatttcacattcccatgaatggtatgtgagagtttcagttcttccacattttcgccaacacttggtaagggcatgacaataaacagagtgtttgcttcatgggaataaatgattgtattgggatgtttatatggctgcttcttactctgaagttccatcattcagaatagattatgcaggtaaaaaaatagtcaacagctttaaataccaattgtaattgttacaatattttagaactactaacccagtattctgggtcaaaccaggtagacagtatacattagttccaagttccagagcataaaataatgatgatgatgatgatgatgatgatgatgatgatgatgatgtgtgtgtgtgtgtgtgtgtgtgtgtggtgaagctcatttaaaaaactttattgattctaggattagagaacacacgcatggcgtggtgagagtatataaaagagaaatccagtgaaaaataactcattttgcttttaagtagctttacttgaatgaaatttgctttattaccatatacttcttcattcttcaaaagcaattgggatgctttactcatttatgaacttgtgcttttattctaaagatttaaaaaatttataaattgaaatataaagaatttacacaatttctttcatttttacagacttagtcaagtaaactgcacttttctttttctgatgatgcatcttaattgcatattatcaacatagtttgctattcagcagggacaatttcataattgctatcttcagagaagtaaaataatagagggcttcttctattaacatttagtaaagtgttacaaatagcacttggtgaatgaagggcttcaaattattagaaggacataatattggttacacatgttcacagaataagaaagatatttttagttcctttcagtatatcaatttctgtgaaataaatagcattctgcaagtaatgatatgttactgggcaagtaaagctatgttgttaatttataatgaccaggatagaatgtaatataaatgggatgagcaaaggaaattcgttggttcactgctgcatcaaatctgaactctgagttttctccttatatccatcctttaatgctcagctcaaaatagatctctaagaaacgttctctattgtttccctattacaaagtatattttccttctttaacatactgtatcccttcttatctttaccacctatatgtttctgtttttacccctggctttatattcctaagtattattgcatctttgtatctattctaactgcattaaaagttcccagagttttggagccatagtctgaagttggttaagccccagtgacaaagtttactagcatctttctcattacttacatttgtataatgctttatgtatttcagaaaattttcacatttgatattgtctatggcataacaaaatgccttaaaccaagtaagaattctatacatcactcatcaatgatggtttctcttgggttgtctttgtgtaataagatgctttttagaaacaatgggagctgtaaagtatttcgaatggtatttcaattctagcagtgtctaatgtctcaacgtctcctttctttttcaacaaagcctccattttactgctttccagggtcacacttgattatccattcagagcctcagtggcattttcacagatcatacactatatgatatgtgggacaataaaataaaatagtgaaataagagtgattatctcaaggtctccttacttaatcagtgttctttttttcaagcttaagggaatggctcaaagagtgaaaaatatagtcaacatgtgaaaaatttttgtttgcttctttacagtctacaagcttattaaatcattactgcaatatattctccagccaaatattggtatccataagttatatgaaaggaataattgcatatcatgcagcaggaagaagaaaatgcattgattatgggatttaagaagaaatactgctctgtaactatctgtacaattggtacaataggttgtgttttgctttaaactggacagttgtgctgtgatatcaatatttcttctcttggagtagcttagtacaaccagcggcaaacagtctcctcaattacttcaatgtgtcattcaaatatcatcattttggcgggcattctgatgtgtaaaagtttggaacgcatggatagcattaacagcatagggattcctcctcctcctggttacagagcatgtgtatcagttttgtgccttagagatacagcattatggaataggaatttcaggtgggaatttcataatcaaaggttatgattatggggtgagagaaatgaaggaggaggtaaatagaggaaaggtcagattcaaacccagatgcattgtgatatacaaaaagcataggctgtttttcagtgtcgaaataaaaatcgctgaggatggtgctggtcaggggatacaggccctccaggtgatgaagtttatgggatttgtgggaactggagagaagaaaatctacgcaggagaaatgggaggggaggagtggtggccatcaggaaattgagtgtagccagctggtctgaagaaagagtttactcaaagaaataacaaacaatgcatttggggatttaagctctgagcatgtagaaggcaaggctcagtcttactttagttcgaccccggtgacaggcatgggacctggaacatggtggagctcagtttattaagtgaggtagcaaaaaacagttgaaaaaactcggcaggattagggagactgagctttatctttttaagtctttgaaaagtcccagagaggttttggagtagaatataatttttcctgaaatactcattgcaatagaaataaatagcaatatcaaaaatacaaacagaaactatctttttgtataacattttaaactttacaagatgcttctataatcactatttattatcctcacttggagatacagcataactattaactaaccactgaactatttattgctaataaagtagacagtatagctaagcaagtttcaaaacaaattattttgggtgacacatatcacttgaataaaatactatataatattctaataatgatttttaaaaggtcctttttattcccatccatcattaaatttgtcataatcacatcccagattataaacaatgtaaattaatatggtaaccctcatatatatgtagagatctgagacaaaaattgtgatttttttacagaaatgcatgttggcttttccacagctactcaaaataaataaataaataaataaaaatagaaataaaaataaaaataaaaaaagataaatccaaaaacaacaacaaaaaaaacggaattaatcagacctcaaatttagaatagtaatctccaaaaaggctactgctagcataattttcaaggctaatccaaaaggagaacacaacatgaaccagtaattccaacacataatttttgttatagacaaaataaattttaggagtagttttatacatgtatagtccatattgtcacactgtattcaattatttttaatcctagctgcatatatttatctagggaaaatatgaatcttaagagcgttgcactatgtatctaatgaataaatacaggtcttttctcactctgctatattcctaaagattagttcaaggtgaaaaagcatcatacatgttccaaaagtttgccataaaatcagtaagaagctgttcacatttatatattaacaaagtaatcatttatcattaaaaaaaaactagtgaaaacttaacaagtgctcttccatatatttaatgctatttatttttattattttgctgagatataggtatggctttctgtttttattgtaacgtaaacaatattaagtataactttcttttaaaaaataattttagatttacagaagagctgcagtgttagtacagacagttaccatgtatgttcttcacccagtttgtcctaatgctaatctgttacattaccataggatagttattaaaagaaactaacatggattcaatattattcaccaaattacagactttatgtggacttcaccagtttttccatgaatcttcttattctgtacctggatccaatttaggatcgtacctcacatttagttgtcctgtctccctaattcccttggtgggagcactaaggaaacactgactcttttaaagagtatagatcagttattttgtagaatgtgctgctgtttaggtttgtctgatattttctcattattagattgaggttatgcatttatttaaagaatattccagaagcagtaagtccttctcagagcatgatgtctggaggtaaatgatattgcttggtgatctttgatcacttggtttagttggtgtccgctgtgttactccactgtaaaagttactatgtatcactttagagttaataaataccattggaaagacactttaagattatgtaaatatcttttctcttcttaaatttttacccactaattttagcatgtatctgtggagcttatctgctttaatggtatcttttttgtaattcaaaatgtgtaacttacataaatctttaaaaacatgacttctacaaagcttgtatctatttattttcttcttctggtttcctgacaatgcaaacaaatgttagagaatttatcttgagaacaacatttcccaagttgctatagaaaccaagtaatgaagaaaagactaataacttttctattctatatagtatataagaaatttaaaaaattattttagtgtttaatctgtttggctattttcacagaaaatacattttttttctgtgttgatagctaaaattcagattttccagtagctgaatatggcaaaattatatgatataattttatatacttcttgatttattttatattatcaatatcatgttcaaatcatttttctgataattataagtgatacatatacattacaccaaatttatttaatattcatccagtcagataaatcaatttttgcttattgcatgcactttttataactaaatatatactattgataggaaatggttggagtgtaatttgtagtataagaaagcatgctggccttgaggaaaagcttttttgtatttaaatgtaatgacacattttaagtacaacagtaaagaattaattattgaagtagagatttgtaaattcagcagtaaattttaaccatcaatatatattttgctattttgttaagctaacataatttaagcttctagtaagtatataatagttgtaactgcacataaaactttagagaacaatggaaattttccatcagtgtttatgatagggacaaacccaaaaagaaaatagaatgagcttattacgatttaaaattacctttctgtatcttctattgtcattacattttatttgatctttattagttttcaacttttaaataaactttttaaatattcaacttggtacctaacctaatgtaaaaactacatgtaaaaatcaatgagaacaaatttatggtgacccataatatttaacgattgctaaattgattctgaaaatatgtaaccataatttgctataataccattaatctctgttgactatttacagcatttcataggaacttaaataatttgattttttacacagcaattcaaaattttcttactggcttcttcattatgtatcatcagctttcagctataccaatgttaaaaaaaaaaagccacaaatcacagttagtccagggaaaatttcttgtgaattgtttttgtttgttttttaaagtggagtgtaattgctaaagttagtctaaaaccatgatttcattcaaatgtggctatgctttattctacagagaaaacttgccttggtcataaaatttatgtggtcaagaggtaacacatgcttgatgagcttgatttgcaattttaagttgtggttaaatccctagggaagcacagaattctttatagaggtcttagaacaacaaggctggaaatagtgttacaatcatccactctgatgttatggtcctccacccccatttcagttttcttatgagtaaaatgtgagtatcaatattttgcttagcaaggtttaaaaaaaagaggctaaatgaagacaaaatgatgttcagttgaatttcccagctctgttatagataaaatattatacacattttatgatacttaaagaaaactgattattttgaaatttattaaatatattttaaatggcaacattcagtgaaacttttccatgaggtccctgcaatgggagatctcttatgaaacattagttattaaatcaaacatgcttttgtgtgcaccactatgcatttataattcaaacatatctttacatttgcaaaacactatattgagatcacatctaatgttattcaaccatcattttgttctagcttactaaactggaaaataaactgtttacttaactggtatttatttaacctgaacatatctgcatatattacaaagcagacaataacagtgggcaatgtgatatttgaaaggagtggagaaaatgaagacggtggcaataattaaaactaaaagtagtttagagaagatgccagctctcagatttgcttatttatctctaaggatatatgtgtaaaaatgtatttctattttagcccaaaaattatctagcacaattttaattacaatttattatgtgagaaattatgatgcctttgatactatttaaaaagacatgtttagatctaattattttttctaccaatactagcaaaaagtgcttatttgctaaattatatatgtatttgaatgaaaataatatgaagccagagtcattaaagttataatttacagcaatgcctacagtacagtatttaaattgcttaattttttcctttcaggtagaaacaaatgtaaaaacccaatgattcccccattctatgcagaatacaagagaaaggtaatcttcagtactgctcataaaagatgtttacatttagcagtgtaggaatcatggctgggtgtgcaagattattaggatgcttcagggtggttgctttattttgttttattttgcaggaaattatgtaaccagcaaacagacagaaaaagtaatttgttgggaatatactagcatatgaaaaaaaggacccattcactaattcatccatctatctagccattcagcactgattaaacactttttatttatcagggtctattttacttagtaggaaaacaatgacatgtaagacatagactaccatcttcaaaagcttccaactacaccatggaatactatgcagccataaaaaaggatgacttcatgtcctttgcagggacacggatgaagctggaaaccatcattctcatcaaactcatcacccgcctgtcagggggtggggtgctgggggaggcatagcataatgagaaatacctaatgtaggtaactggttgatgggtgcagcaaaccaccatggcacgtgtatacctatgtaacaaacctgcacattctgcacatgtaccccagaacttaaagtataataaaaaaaaggaaagtaactcattaaaataatgtgtaataacagccttaggaaaagtgtttacaaggtatcatggcatttacagaagagtatggaactcttggtgatattgcctggaagggtaaagttagaatgaaagaaaagtcattctcgttagataacagagcctaaataagggcataagaaacataagttaaaaacaaactaacaaacaaaaactccaagtagtctggacatcagaagcatggaacagaagtggagcacggacagtagaggaaagcacaaccaatgactcaggcaggcagaaaccaaatcaaggaggccttctctccattcattcttaggccgtggagacctgggagtgatttttagacaggaatagcataatctcattggaagcttacagtattaagtatggaaaatagaaaggaagcaaataggaaacagagaggtgagttgagaggctactgcgatagttcaggtggaaaatggtatgtctaaaacagtagtagtgacatagagaagacgggtgacacctgagagtgtttgggagtagaaagggcagaactttgtgatcacttacacatggagatgagacagtggtaaaagttgaaaatgactcccaggtttttagcttgggtgaataatggtgtagtcaacacagggtgaaaataaaggaagaagaatatgttttggagcaaagataataagtttaattttaaatacatttaatttgaaatgaaaatagactagctatggaagaactaaatgaaaatagcccagtgatatggtttggatgtgtgtcccctccaaatctcaccttgaaatgtgacccctcaatgtaggagatggggcctagtgggaggtgcttgggtcatgagggcagatgatccctcagaaatggcttggtgttgttctctgtggcttaaaaagagcccgacacctcttccctctcgctcctgctctcaccatgtggcacactggctccccctgccttctgccatgagaaaaacctttctgaggcctcaccagaagccaagcagatgctggcatcatgcttcctgtacagcctgctgaagtgtgagccaaataaatctctttactttataaattacccagtctcaggtattgacttacagcaagacagaagagactaagaagcccagaaattctacagactataaatgctatttgtgaatcaatagattttaaattaattggcgatactgcttgcgtctaacgtgctcctcaagtattttgggctgctagtcaataatagaaacatagacagatttcgagaatgacttaattcattgtgttagactacaactgcttggaaagcatagtttaaattcatgctgtatcaggaaatcaactagacttggcttgctgtataaataagcagcacaattaggaagaaagaagcatttgcatttggccagtggagtgatgataaactagaagattccttttgggacaacagtgaaatatgttaaatcaagctattccaatgcaatgtaaacaaacaatatatatcatctcagaaattcaattaaaccatgaatcatcttgtcattaccgttactccagtttactgttaacatggcataaatgtattttaagctgttaaacaggggcatgctattctttgaggaatctgaattttatgaactgtcacaagagcaataataaagatggagagtatcagctaagaatatccataattaacaaatcaatatgttctagttatctgcagtgtggttagctccatcaagagcaagataaaggatcaagaatgagaataaagagtgaattaagcagcttaagatccagtcaaaaagacaaaatattcattaataataaaaaaatcagagtcaagtcctgttgcaatttgactcatgtaaaagttgaactcatgttcaaacgtaacctccaaagttgtaggtgggcctagtggtaggtgtttgggtcatgggggtggatccttcacgaataacttggtgccctcccagagctaatgattttacaggatatcttgttttttaaaagagtctgggacctcacccttctctctcttgctccctctctcaccatgtgacatgctgactcctcattcaccttctgtcatgattgtaagcttcctgaggcctcactagaagcagatgctggcaccatgcttgtataacctatagaaccacgagcaaaataaacctcttttatttataaataacccacccttaggtattcctttatagcaatgcaaacagactaacacaagtcccgaagaagaaggttagatagattagaagacagattagtggttaagaggataggttttagcgtagaatgtctgggattgattttcatttctcctccatactagctatgtgaaattgggatgactacttattctcttggaggctcaattttcttgtctgtacaatgtaatatttgtgtccacttaactagttgttatgaaaatataaaacgataatacatacaaactgcttcaggcagcaccatgcatatgctaaccattcagtaaatgttagctctaatgataacagtaattggtattattattataaaaatcaagaaccaaatcatcagaatatatataagcactaaagagttccaaagaaaggaaaggtcaattggtcctgagctctttgttgaggcttgaaaagccagataagctttctgaagtaaagagaaaataagctattttaagtctctgttacaattcattcattcattcagcattcattcatttattttaaaattacacataaaacattgattaatcatttgatggcaggtgctcaaggccatgaaggtggtaagtgtgaataaaataaaggtttgtttttgagaacagtgagatataaagtatatgggcattcacagataacagggcagagggtagatctaccattgttctcatcctactccttctttgctgccaagtaagtatgaactatataagccacaaaggggcatgacagcttgtgcatatccttcagtctttactcttttgaaacattattgttaaaaatctctgcctttagaaatagtaaattataggcaaagaaaaacacggagagcagccaatttgggacattcccaaagtgttttttgttctagctctgtgaagagtctctggtcagattttaatgagttttcaatggccaacataattgatattctcttccagaatttaactttggcatgtctgtgtgcaggctattgaaagactctgggataagtcagtggtattttaacgtgaggatacaaatttcttaagttggctttcctatttcttgacactgtctaagaaactctactgtatttcaatctcttttgccaactagagggatatttttgttagcactcagtttaaaaagcctaccattttgactaaatttactggcctaattcagttacacagctaatcaatttagttaattcagttggtttgtggacctttcattgaattaattgattttttttttacctcaactggctgagagactagactggacttctgggaatgtattctctaagcacatataaaagacaattgttttgtgttaaaccctagtatgtaggccatgacaattttcattaaagaagtccagatataaaacaaaattgtaaatggatattccctttctcaggtcagtatttggaaaagcaggtttcccacccctccatttccaaacccattcctacttcttcgtgcatgtggagagaaccacaagaggcatattagtgcttcctgcagtacaaatcaccacctacttttaaacgacatctcagaaattattttaaagtatgacaaatagaaacatgtattctagaaatcatatttctaaatattaaattttccttcattaaaaaaattctatcatcttagcattcaaaatatattttttaaaaaatatcaattgggtaagggtctgagatattacaagaataattttcttccatcctcccaatagttagtgacatttatttagaacattccactttcttttctgcccaatgcgtctgattttatcaagtcaccattctaaactaagcactgcatctggtgttttgtttggtaagacagatttgtggggcaagttcaccaacacattatgatcaagcattgtttagattaatataacacgaatacacaaggctgtattacaatttaaattttatttcacatgcaaaaaacttcccctttacagaatttagattaatcccatggtttgttattgactatctttagaaagaatcctattattccaaatgacaactttgtaaaaatgcagtgcagctataatggaaagtacaaaagttatattaagataactcctttctgagtacgtgtatattcattttacatgtttcaactagaatcaactcttacaagtctgccttcagccatctgtatcactgaccagcattggaaaaacctcattttcaatttctcggcaccgttgacatttggacctttaatgactcattaaccctttacagcctccttctccagatcttttcaatcacatatgatcatgtcgccaaactgagatatttttgactgttcgttgctagtgcagataatattctctcctcttccattctcccagctcagtgccagactggactgtatatgtatgagatgaggatgataaatgggagaggagagagaaagccaggcaagaggtgggggagtagagcaagatgattgagcagagcaaattagaacccataagttatattttactggttttagaccctaaagagatagagcttagaatgactcaaaagggaatttatgagactatggactgcacagtgaagcattagaaattctagggacagatgtacggtcagagttgggaaggaaggaattgtctacttgttacaaggtgcagtgccactctagagaccacagattggtagctcttggggcatgtacaggcacatgcttaacatggatcgggctacattgagattttcttcttggaagaagaagatgttactgtcagaagagtatgtggaaaagtagattcccaaggagaagattagtaatggggtagatactaaacaatgagatagataccaagtagggactccaggtgatgggataggttttgagcatggggagacatccctctggaaggattcttggagtatgggacaaaggctgaggtcctcccttattttgatgggcacaatcaagccagcagacaaacaggctactcagaatcaaagaagaacaccaagaagtaatgttgtctgtctttagcaaggagcaaggaagagagcataggcaaagaaaaatatctgaaaatgttttagctctcccagaatcaagattttagtgtggtttcattgcttccaaaaattacaaactttccaaacacactagagtaaagctcacacaccacatattaaaatcaatgagagatgatctgtgattactcactattgacatggatcattgatgacagtaagaccctgcaaaataaattcccttactggacttacaaaaacctcacaaaaatataaaagtaaataaaattatctttattctattaataaagaaaatgtatatgaagaaaatgcactttacaaagtataagtaatttgccctgaatgacatggttactgttagaaccatgacttggattcttaaaggtttaatatcctgtcctatatgctatgctacctctaaacatcacctcaagaattcagtagaggccaggtgcagtggctcacacctgtaatcccagcactttgggaggccaagatgggcagatcacttgagcccaggagttccagaccagcctgggaaacatggcaaaacctcgtctctacaaaaatacaaaaattagctgggcatagtggtgtgcgcctgtagtcctagcttggtgggggttggggtggggggatgtgctaaggtgggaggattgtttgagcctaggaggttgagcctgcagtgagctgtgattgcacctctgcactctagcctgggcaacagagcaaagaccctgtctcaaaaattgaatttaggaaaaacaacattacatctattactttttttaaatatacagatcactcactgaatatataattataatatatctgatgcctgtatgaattaacctaagtaaaaaataacactgtttcttctgaatttattttgatttttctttgaatcgaatttattacccaagccactctcaagcatcctacagagacctatgaaggatgagttcttatgtgacttagctttaaaattaaaaaagaaaaaagattttaaaatagcaagcaagcttttgcttttcttaagaagtcaagaaaatggactatagatataggtaaaatacagttaaagagcaacattgttataatgttgatacaaagtcaaacatatgaataaaaaaaatgtcaatcaactggatcctttcaaatatctccccaaacacctggaagatgacaaattttttagattgataacctttataatgtaaccaagaatattacacagcctttgtgagatagaaattgttttaatataggatagaaatgagcagatatcacaatggtttgccacaagtaaacgaatttccttctttggataactttaagtaaagctaagttcaagtgaaaaaaaaaaaagctaagcatgcagtggaaaaaaaggataatctgtttggattcaaggttatgctattcaattctcaaatcactgagcagcatttacagtaaaatgacactctcatttatctcccaggcaagcattgagacctgccttaagatgcaggaggttagtagacttcatagcacttaattttctaacactacaataataatagttaacttagtaaaaaaaaaattctgtgtcttcacataaagtgaatcaaaatatatctttgcatcactgcctactgtaacctcaaggaacttattcatctaccaacagccaagacattaaaaaacagagaagttggtctctcaggatagataccctattcacttaaggtggggcagataatgcacagactctaatgttggatctgtacactattggccccaccttaggtgaattaaaccaacaacatcaacagggaaaaatgtgcaaaaactgtgttgttctcactttatcagtctttccaatgtttaagaagcacagattatttgctcagaagactagaccaactggaaattgaatgatcttgatctcttttaagaaaaaaccatttgatctaaatcttcaaataaacaaaataatttgcaatctgtgtcttatgcttctattttgggagtcagaccaggcatgagctgagtagcccattctgtcttggaggacaggagcaaaagggactgaaatataaagtcacatgtgggcattaaagaacatcctggagtcccaggccatataaaagggcttgtaattagtattttagtaaatactaatgagaatgcatgtatcaacccacattagtaaatattaatctgaagtaatattctaggactatttattaattactttcaactcttcccccaaggtctagtaacccacaaaaagcttgaggaagaaaggaaatagaagctttgctttgttgaactatttgatactaataaatatactgggcagccatgccatttttataactaatcaaagcaagtggtttgatgttaaatcaataatgtttatacaaatttgacttattagatacagtgatagttacctcatggctggaaatcagcatagtaattaaaattgtgttctgatatttattagttctatgatctttggcatggcacttatctttctaagcctcatgctgtctcatctataaaacagaaactgataacaaaatccacctatcaaggattctgaggctcaaatgagatggtacagaaaacataaatgtgcctggcacagggtgacagccaataaatggcagctgttggccattaaagacaaggcccattaatttgtaagttagtgcctactacaaagagcatagattagaattcacacctggattaattaattttcatcttctatgtcctaaaactcattcctccttgcaaactgggtgagactatgtagatgccccagcaaattacccagacggaagatgatgagcaagtagcatctctttacttaaaaagaatcatattttctttccaagaaaatcttcataaaccttagcccatttacataaccaagccatctctcaattggtcttgtttgagtttactatcccatgtcttcttacttttttaaaagaggtaagaataggctttgaacacagaatctggtaatagtctcaaaattatggtgctaaatttccttggcttatcaacattaaataagggaaaggaaaatctactaggagcatcgtgacttggttgacacacatatgagcacgaaaggtagggtaatatttttaactatatttagcgatgttatagcttggggtcagttcagaagcagaaagggtaaaaacaaagcgagtaatggtgacatgcaatattgtcctcattatcagaagataaaaccatcatactctaatgggctgatacagattgcaatttttagtagctgatatttccaagggcctagcaagacagagtgcaacagtacgtgtcacattctaaagtctaggagggaaaccaaagtgatctcagtaacataggaaaaattttaaagatatagcttatatatacattctttagtggactcaatagctgtattaattatgagacatggggggaattatctcaatacagccttgcacataacacatttgtatgcaagttttacacatacatctatacctatatatgcatataggtctatacacaaatattctgtaactacacatatacttgttcattaatcaaccattgagggcctacaaagtacagtgagtgaaaatatatagaggaagcaacactgagctgctgtggacacagaccatacttatcttgaaggtctctatcctgcaatcctaacttcccagagcagactactaatatattacaaagtaatctactttgtaatctgttagttttattgctgacggtattttaattttctgctatttggcatgacgaaccacagaggatcagaggcaaactgttgctctcgcatggaagtggctcctatatgaagacacagtgatgatgacaagaagcaattgctctcttaataagggagaaggatttaaaatattagttacaggccaggcgcagtggcttaagcctgtaattccagcactttgggaggccgaggtgggcggatcacgaggtcaggagatcgagaccatcctggctaacacggtcaaaccccgtctctactaaaaatacaaaaaattagccgggcacagtggcgggctcctgtagtcctagctactcaggaggctgagacaggataatggtgtgaacccgggaggcagactgtgcagtgaaccaagatcaagccactgcactccagcctgggtgacagagcaagactccgtctcaaaaaaaaaaaaaaaatatatatatatatatatatgttataaatggtagatctaggaacttagaaagtacagtagtttagtgtgagggcaaacagctttacatacttcagctgccccaaaggactgactgtattacagcacagtacagtgactgatgttcacaatgatggctttgggttatcaaaaagaagttaactcacgttagcaagttcaatttaacaaggtacgatgtgtgtattattttcaaaatggtaaaaggagcaagaaaagttttcttgcataaaacagaaggcattagttatatggaatgctcacttctgtaaatacatcttccctaatggtatgagatagttagtatacatacccatccatccatctatgcatttcatctttggcaattttctgttcttttagttaagataggttaccgactactcctaccactgcaaatatcaccaaactacaatacagtatactaattactaaactagattaacactgatggctaactttattatttataattgtaatttcagatttcatatgaatgataaagaattctgtaaaattacattattaacatcttagagccaggtggctcatgcctgtaatcccagaagtttgggaggccaagtcagaggcaggtggattgcttgagtctaggagttccagacaagcctggacaacaagttgaaaccccgtcactacaaaaaaatacaaaaatagccgggcatggtggtgtatgcctgtagtcccagctactaggaggctaaggtgggaagatctcttgagtccaggaggtcaaaactgcagtaagctgtgatggtgtcactacactgcagcctgggtgacagagcaagatcctgtctcaaaaaatggaaaatacaataaatttaaaaaataaaatttgagaaaaattgaatgaagaaatatgtaataatgggtggtggtatctgtcttactgcaggtaagttgttcctcaactaactctttctgcctcgaaggtggccataaattgacacatactgataatcgctaagcaactgcatggattatttaatacccgtcaattgtagattatgacaaacataaagagatagtctttgccaaggtccccagtttagattgttaaggtaaaaccctgaaatcttactttccctttcaagtttcctatactttattttagataaagctaaattgacatgtttagttttcataaaattgtaagtttctttgcttacatattactaatacttgaagagtactgggaatatcatcctgtccttgttaacaaaagtgaacagaacatgaaccagagaatttgaacttggagatctagatgatagctacatcattaagaaataaaagtagtcaaatggaatattcagttgtttttcataatatgactttccaaacattattataaattcaattttggcttgtttctctcctaaagaggcatgagccagtttatatactaaaactacacatctcacttaaacaaaattattatttttattattatttcaattaactttctttcatcctaacttctaagatgctattttggttgttctctttgatccgcctgtttttcttttgctctgtaattgccatcacatagcaagatctagcccttagccttctacagtctctctaaaaattaagcatatcactaggtggatttaaagccaacacactcaggaatattcagtagttttgcatgtcactagtttcctgatctgaccttactgccatatcatctggatatcccacccttttcaaatgtaagacccaaattacaactattttttctcccacaaactagtttattgacatcaccattatctccattgctaaggcttgaaaacgagtcatctgtttctttccagtctttattttcatttggattcatcacttttttctttggaatctataatttctatccctttacctctcttctcaatatcctccaatgagtataggatcccttaagttcaggcacaaataacttcagcagtctctagtctcttctctcctcaaatccattttacaattaatttgtctaattttgtttcatcctgtcagtatcgtattgaaaatactaactgaataacttgtaccatgttcttattttgaacctaaaaggtgatgcatcatctttgcatcatcaaaccccaatgtctcatttgcacctggaaaatcatagcaaactggttttaatgtccctgtttccaatatcatcagagcctgcatacttgttgtagtttactttttttcctacactcaagtttaaccgcatcaaaaatatagatcttgcttctaaaggtaatcttgaaactagacaggctttctctaaagtataatttcaggggcttggagctacttacttcctctccctcctgaactgattctctttctgctgtctatggtgccacaactagaaatacatttctccaggtttaaagctgaaccctcataactttccaagtagccttctagcaaaaaacaaacaaagaaacaaacaaacaaaaaactagagttttcttttttttaatatatttaagttggcttttagaaactggatggcagagtgttttatttggcaaacatagtacatttttaaaaatgaagttattatccacatttacacgttaggtttcaaacaaaaacttagatttccagtttctcataaaaaacagttgacgttgcaaccagaaattgcagcaaattcctctcacactcctgagtctttctaaaaggggctactttggagggaaataataatattttagacagttgaaagggaactatgtcactagatacaagaccatgtcagcctctcttaggagaaaatcacctttcttgtttcaggccttctgcccatctgcaaaaacactactgcttgtcttctttaataaatggaagcaatttaaagaaaacaatctataaaatgctacataagaccacattaaaactacaagtaaaaattgacatccaacaaaaccctgctttcaaatacaatttcttagaaagaaccttgattctgctgtatccaccacatctcgagtctatctccagggaaagtacaatagcgttaaaggtaacgggtagagactgttgccaagtcaatgaagcaaagactttctctctagatgcatggaaatgcacggtgatgggttgattaggtcaaggcatcttttgtattatgcatgtaaatgggaattaatgtcctcagagtgccagtagctattttgttgaatttggtaaaaatgaaaccctgtgtttaagcttcaattctctaaagtttatgttgggaggaagatgcaaaactctttatacttccataattaggtattcctttgctgacttatcaattgcctcaacttaggactcaaagtgcttagcgtcaaattgaaagagaacacatcttttattagaattgcttttggtttgtttcctctgataacaaggtaatatctgcaaaccagtgaatattgacactatttacaaccaaattataggaaaaagtcagtagggtatttaaagatgggattagtaatacctcatttacctaggcatttcctgggaaggagcaattctggataactgaattttctctgtacctgaagcttatgcccatttaaacctaaatattagatagaaatcttcataaaatatattaactgctacattcctgtcttcctacatagatacttctaaacataatactatcttttttttctcctgatgattcaggggtcatctctgtgagcattcattactgtaccatgtggttatatatttctatgcatgctttatcatttttttctctcctccctcaacgtcaggctttcagctgtcactttggctgtcactgtgtctcttctcagcttcccctttgctgtttctaatctgtcgtgggctgggaaaccagataaccaagtttattaagaatgacatgctgaataaaagtcagtaagactcagagtgggcactaagaaataaaatgcatgactttaatgtgcagtttttgtgaaaactattttgaatatgcagaggctttttaaatttaattttagattgggcaaccgcgttagggttgaggttgttgtgagaatttgtagaatatgtccccattcagtttcaaagtatttctctgcaggagaccaaggcagttttgacaaacacgggcaagagaagctaagttttccctttggaagcagaggaatctggtagggaaacactcaaggacactcatgtgaggctttaggcaactgtggagatcaaactcttctctctgatcaccagatatcctcttcttcatatcgagatggagggcattgcctgaaagaacgaaaatttagcactaataggtaaaatgtatggattcctgttagaatctctcagaattttaccttctcctttatagtagaatgttggctaggtgagatagaggtaatctgggaagggaaaagtccagaagtcactgtttttcccatgtattaatctacccacttcacttccatctctttctggacaatgcacaaatcagaaccctaacccaacgtttcttttcctgagactaatgctgtccctgaggatagtctatggggtccccaagtgcttgtggcatcctgggcctccccatatcaatacatcaccaccacctgttgttaaaacataggctcatgtattcacttgcttttattcgaatgacttaatcttcatggcctagcaacaaatagaaccctccctacagagccctccttatataccttattattgcatactcactctttttatgtcctctctcagtgcttctctcagtgctcattttaaaagaatttcacctctctaaaacagagtggtgcaggactgggtgggtagaagaaattgatttgttttgcctgcccctgtagccacagaatccagttacagccaggtttttgctgcaatcagtaaggatttctcatgttctaacaaagatgaaagcaataggagatagcatccgttatcttctcagggactttcttttcagtatgacaatgggcattttttgttgttgtttttgtttaaagccaacttacatgctgtacagcaagggcctccatcttccaaacactctaaagagtaaaattagtctgaaatccagtagaagaatactgattataccatcagtccaaaatcttcagggccaccagaaagtgccatgggcttgcggctgctaatcacttagtttggtgctttctaacaaggtgttgtctttcaggttttttgttgcatcacactaagctatgcttgcttcctccgaacacatttaagtggattctttttccaatctggagacttataaaaataaatatacatacccctttactactaatagtagggttttctgcaattggatctaagttctgggagcatgagtcaggggaatcaatttattctattttaggatatgcattgagatccacctcaaaaccttttaaatcaagattcaattaaatttaatatatgtaagtttgttatattaaaaaaacaaattgaaacaaaatatcactggagagacacaagaaaactgtacagtcctgtggtccttattttatctcttctttcagaaatgttggaagccaaactaaaattacaggcttgaaaagaaaaccagttttagaattccatcgccctcaaagatttcaacaatcaaaacaaaaccagttttataattccatcaccctcaaagatttcaattatcaccactacaaatcaatataggtaatcacttgcatacaccaagacaattttactctaaatgccatgtctatatacataactggactccatcctttaaattctctgtataaaaagacccagctcaaagttacattctctttgaagctatctggatttcccagatagaagtctttggtctatatttttaatctaagtttagcatggttgcttggtcttgcactgtcatgtgttgtaccacatgatcactcaataagctttaggtagcaaaagagggagttctttccatctctgtgttctccaaaagtgtctagaagatagtccaatgtaggaaacaaattatatttaagactgtcatacactgctttgtctaaaaaaggagttattttgaaatgagaaaacaaaagctaacaacttccaactttataagcccatttgaggcttcccatcagcttgtttttttttgcttatttgtgtgtgtgtgtgtgtgtgtgtgtgtgtgtgtgtgtgtgtgtgtgtttgagacggagtctcgctcttgtcacccaggctgcagtgcaatggtgcgatctcggctcactgcaacctctgcctctggggctcaagcaattctcttacctcagccctgggagtaggtgggattacaggtgcccgccactatgcttggctaatttttgtatttttagtagagagaaagtttcatcatgttagcaaggctggtctagacctcttgacatcaggtgatccgcctgccttagcttgtattttgaataacaactctaaacagaatgccgtgatgtcaacatttcattttcacatcaaattttaattcaaacccaactttccaacctgtaaaatttgctggtaggctggccaataatatgtacataacctgaaatgcaaaatatgatgaaaagcatagtgttataaaatagaatattccagacattcataaatatggatttgatggcccatactatgaatgattcagcacgcagacctttgaaattgtgatagtcctctttatgtacagaatgaaaaccatccagaggcaacaaaatgtcgaattctctaatccatcatatcatgaagccatcacagccttgcacatgagatttggttggtgggaatagaaaaacatttgcaagtctctggatttctctggctctttactcagagatgtcacatgcatccatgggtttgagaataagtgtaattgaagtgaactgcaatgtgtctctaataagtggctttgagaacatatatttgtgtaggcatatagtacatatctgtactgaagcactcttatcctaagtgtcatcttgtagcacagacctgatcaaactccgggattcaaaatgataatttatttggtataaatgacacaagccaaagaagataaaatatgttaagtacttctcttgattttctcttctccaaacacacacagatattaaataaaccactcccctcccggttcttttcctttaaccatgagaatcactgacccactgtgctctcagtattatccatgtgaaatatctgccccctcatcgggtacaacagattaaatgatgattaagctgagtgttaaatttaggatgttgtttcacaaaacctccctaccttgtagtgacatttttttctaaagacattttcttgtaatactccaaaagttaatgactgaattttagatggaggcatgacgtgaatctcaaatgaccataatttctttataggcaaattatatacagagttttcaaagacgtgaagagagttatgcatcgttgattttataccctaagtgatgattagaagtaaaatttcttagcttaaaagtaaacagaaaaataaaggaggtatctgacatggggaaagaaaatctcaggaacatagaactgggcttgcatactgtatagtacttgaaaaaccgttaagtggaaatgtatgatctcagaatagtgtttttaggcttaactctctgcgataacaggttcagactgacctggtatctcataagacattttgatagcaattcaaataaatgagattttttaaacattgaagttaaagaaatttttaaaactcttcaaatgcttatttttttaggaaggataaaatggtcttattttcatctgtggaaacaatacacatgagcagctttattctgaaatgccattgcaaagatttgtaatgcttttctattgttttacgatcagagttgctgcttttgcagtgcagaacaatgctgcattatatagaatcggcagattgaaccaagaaaacaaaagggagcactgggcaaccatccgttccttttaggactcttgccctcgccacatatcaccagatctctttagttagtcagtcttcttgtggccataacaaccccgagggctgactcggggatgcttccatagaaaatctctcattcactttctctctctgaactaaaactgtagcccaacagctcccattccctattctaagatgaatactaagactcatctgtgaagtcctttcaaatatacacaatttagcttatacgtatatacattaaagccaactccatggtagttatattcatctgaaaatcctttagtttatatcctgcactgattcaggctgtcttggggagatacgtctgtgtgtgaaaacaaaaaaatggcaaatgaattgacttgaggttataaacaaagatccgattctatctaatccttgctaatttcccctccttcttttattttccaagtaagcctagttaacaaagaaattttacagaaaaaaaaatgccttggtaaatattatctgaataatcctctataagaaaagcaggctctatttcataaatggaataaaatgcctttgaatatgattagagattgcatcattatgtcatcctgttttgagcatcattccttttttattttctagtggtttctattttattgttactttgtgataacacactaacatgctatgtgttgtatgttagcagtaatattatgtgcttgtttttagattgttctggatttatcttttcaaggtcaaaacatttcagtctgcttaagaagctactctgtggagatttttttttcataacttctatttctttttaattcccagacatgtttaaaattctaatcagagtgtgaaagccacattcaaatatgatataacacagagaatcaaaatcaatcatctaccacaactttatccctattttatgatccatcaacaaaaagctatttttgtaatctcgttagatttgccagcaataatgacctaagattaaaaattggggagggcttttttttcattttctctttttccccttgggtagtatgattcactctgtgggtactgcacttaaacaagtattcacaccccctctgatctgttcttgtcagctttttcatgttagtacaacaggaaagcaccccatcaatcattgtttcttcatctatcagtcaaaatgttcattttgtgactattggtcctgcatcccaatctgtgacaatctatgagtgtatatttaatttaaaaagagcaatgtgggaagacacaacactttaagtgaagtttgtaaatgagaagagctaaattatcagttactgtgtcaatgttattgatgggtggactagaaaaatacctactggatgcaaagtcgagaaacttactgtaagccctaccccagtcccctaaacccattttgctgctgaatgctgacacttgaatagtttctgataggccaaggtttttcgtatcacaaggagaaagtagatttaaaaggcaaaaatccaaaggagagaatacaaaaggaaaaatatagatcctgtgggcagattttggtagagtaattaacagaaacagagtgcttaatgccaatatgctaaatactaaatgctaaccgaataactataggaggtagactgaggtgccaagattggagactggtgtggtaaaggccagctccacttgacagtaagagtcggatgttaaacaacttgccatagctgcctcctgacttcttggaggtgtttttttagaatataactgtggtcctttggtccactatacctagggacttttggacttcctcctgcctacaattgcgtgcaaaggtcaaataaactggcaaggaacaaaatgtgagaccacaaatgcaaaaatggcacaactgcactactgaaataaatacgttgaatcaatgaactctgatatttctgcattaaaatgcagcttgcaaccactaactgcaaaggaaaatatgaagggaaaataaagagatggtaactaggacctaatatctatattactaactcaacttcagaaagttggtatattttcaaaattgcagatatgtctgcaacctaaagtatacttcatagcatttaattaattaattaattttgaagtttattttagaggcagaatctcactctgttgtccaggctgaagtgcagtggtgcaaccgtagcttattgcagcctgaaactcctggcatcatgtcccccttttacctcagcctcctgagtatctggaactataggtatccactaccatggtcggctaattgtttttattttttgtagaaatagggtcttcctatgctgtccaggatggtctcaaactcccggcctcaagggattctcttgccttggcctgccaaagcactgggattataagtgtgagctaccacgtccagcccatagcattttattttgaggtttagggactaacgtgtgtatgatttagcaagtgatgtttaatggcattttaaaataatgggtaccaaatagaaacgtatgaattgttacttgaatataattaaactttgtaaattaatggattagactagaaagaaaagattccagaaatttgaggggaaaaggtaggttctagcactgtctcttacatttacatattctgtctgtttgggcatgttattttatctttttgcatcggtttccctcttaatgtatgggtgaatatataatagttggaattaaaccataaatcagtcaacttctaagctgtatactataaaaaacatttgatgtaaataataaaactccttggaatctgtccctctttgtgtctccataaccttctatatttgttagttgaaataattatttctaagtctgaggattgtccattcaaggttgaacactcaagaaaactgatttatctctgttcatctctacaaagtcagaatcgaagaagcatcatatcctttggttaaattcaaggtagggaaaagaaaatcaaaccaattctaccaaagaacaaatcaattgatttgattatgagtaggtggaggttacattctttatcttactgaatttgaggtaaaatcggttaatccttttatccccaatattcatatttaatccagaaaatgctctctggaacaaaagtaatcattacaaaataaaggctttattctacattttagcaatagtctttccttggcttataaaaaattaattgcggggtattctcttgattgggtactttagatcctggtgactgttctaactgatggggctgaaagacagttcccttatctcatagccaaatcacctccatgcaaattgatctgggagtgcctttagaataaacacagctggattctctgcagccatttatgggtccagtttcctaggcttaattttgatttataactactgaaattaaattagccatcttcactgcttaagggtggctttgatttcaccagtgcagtagggagactatttaccaacatattttatcagtaacatttcaacctgggtaagggggtggcggtggggggaaggcatcttatctttggtatttgtacttgagattccttcagaatattttaattgtattatttaccgacaaatgtgaggattagattgtcaaatcagactcacatgaattaaagatcttgcccagcatcaagctttgctaaataatttcaaggatataagctatcaagttcagataaggtgcatcatataacataaagtggtgtaccttatgtcatatgctccaggtagccctgcctcatagatcctgggttctattaactatgggtaatcccttagccagagacatcttgctagggacagagatatagtctcttattcatagtaagtaacattagtctatttccatttgacaaagagattagactaagtctttgctttcctctaggagcacaaattattgtacaaaacgagaaacaaaatttgagagattaaaatatgtgaaatatgttaatagttctaagaaggcttttatctagaacacggtaataaatgtcgacgtgctatagtaggaagagttgaagataaatggttagatatcgctttttatccatatgactttgtgcattagttttttgagcctcagttttactaatattccaaaggattagggaaataagcctaaccagagtgactctgatttttttttttttttttttgagatggagcttcgctctttcactcaggctggagtgcagtggcacaatcttggctcactgcaacctctgccctccagcttcaagcgattcttctgtctcagcctcccaagcagctgggattacaggcgcccaccaccatgcttggctaatttttgtatttttagcagagatggggtttcaccatgttgggcaggctggtcttgaactcctgacctcaggtgatccatccgcctcagcctccgaaagtgctaggattacaggcaagagccaccacacccagtcgactatggaaattttaaaagacagtacatatacgtgtgtgtgtgtgtgtgtgtgtgtgtgtgtgtgtgtgtatgtatacacatatgctatatacacacacacacacacgtatatcacagaactgaagaccataaaatgttctatacatatgaaaaaatgagaatttgaaatgtacataattcttcacacagatagctgacagtgttataaatctcctttcttataaataagaaaaacagtctcagaagtaagtaatattctgatggagagttagaaaagaaaacctgtcttacaactctttaaacatgcttctcctctaagctaaatcatagtttgctaaagaaggtcgtgataaggtagaagaaagacaagaaaagccaaggcaatggggtgaagcaggcggagaaaactgtttatgcctcttcttccaatgtctatttattttctttgtggttctgagcaactatttcttcttttatcttgcaactgtcaaagcagctctctgtagagaaaccagcaagcacacccattaaaaccaaagcatgaattttcgggtgaggatcagtgaggctctcttaagaatacctgaattttcacagagataaacatatttatttgatttaaatggtagaaagtgttaattactaagtttcatatactaccaggagtcatagagaagtcattttggagaccaagagtatattcctagaccatgtaatcacatcatttgagtagctgcttactgagtttattcacaatgaaagcctgatacataaattctttaaacagaaaccagtggcattgttaatttccacttttgtttccaaattgttgcttttgtctcattgagagcatattacttacttcaagcaccttaacaaacaaagctgggtcatacacaaacgtcctactgtaccagcaataagacaatatgaataccctgcaacctctcaacaaccagaagacaaagatgtatttggaaggggcagatgggaagtgaaaaagagaaataaaatatactttacagggaatattttgcacacgtaattctgagtgttatatttttagcttgtataaataaacttcattagtcttcattttgaatatacaggaaaagtttttttagaaaagactcattgtcacaagctgataaggtaagttaggacagtatatgattaatatgctacaatgatgtctaagagagaggatgctcattaaatttgtgtgtgacaaaagttggaaagagtgttaagaccttgaaatactggagcatctttcaaagtgaaacttgacaagttagagaaatggtcagatagagaaatggattttaatcagactgaaaggaaaattaatgtattggttttgtcagttgtaccttcatcttgaacgtaatgactgcctgttacttcctctgtggtttcatccgaacctaacgcgacactcccctgaaaggtctcctctctcccttccttgctcttctgtagcccatgcttcacttctcaactatggtgatgttttgaagatgtgaattagattacatcattcttttcttcaaatcctcaaataatatttagaatataattcaaatcctgggttgccatggtctacaaggcctcaaataaaataggttctgcccacatctttgtttcattttctttcttttctctgcctccaggttggcacttttgttcctttaactcttcaatttaccttggtgctttgtaccagctgttcccccaaagtagacagctctccatagctcttcacacggctgcacttcctgctactctcacttaaagtcactgccttgagccaatttcgttaatctggctctaaataacaacacaaccccatctacactacagttcatcctaataccagtctaattttcttcataacacctatcattatctgaaatcatcttagttgtttcactttagaatcctccttctctcatgagaaagtaaacattgtgcgggcagggtcatggtcttgtttgtcctgtacttcccacccgtacagcagtgctggcacttagtaggtgctcagtagatattcgttgacagtataagacagaagtcctcaaatgttgtccaaggacatttggtagtccctgagactttcgggagggccaagggccaaaatctttttcatcatctcacaaatatacaacggtgctgtctagaggccaaaggatatatgctatcacaaaagattgcctgcagaagtagttgtgagaatctagctctcttaagccaaacatcaaagagattgtcaataatgtaaaataagtcactcttctcacaaaattatcttagtgttggaatataattatttttcataaaagtacacaatttattttaacatgcaacatgcaatgtggtggctattttaaaatgaattaataaatatataaatgttttctcagtcaattctcaatagagtaaacactaatacatatacataacctatacaacaaacataaacttctcagaggttttcaatacatttaaaaagtaaaaagggatcttgaatccaaaaatgtgaaaaccactgaaacagaatctcatcaactagtctccattattccctagaaaacatccagtagaactttcttctccagttaaaattgccctcaaagaaggttttctctttcctgatatccatgcttttgctattcattgtttatgaaatgtctgtctgtttctctctttctcatttctccatgtttgaagtacactttaaagctgtccaaagtagtcttttccatgaaatttgactcatagctctaccacaaaaagttctctctatatatacctttagagcattaagaacctatactaccaattgacaatagtattgttaattatcttctcaaagtgcctgtaaatctctctaaaggcagaaacctctctaaagacagagactgtcagacagtcatggtgcagcctgtatgtaccatgcaggaaacacaaaatgatagcaggatctagcctccaacaaactcttttctcttaaaacctagtatgggatgataaagattaaatggaaacaaaagcattggttagctatccacccaaaaattaatattctggcaatattcacaccttataacttttgggattcaccacccaaggtagacagaatcctcaccaccaccagcaaagaagtccaaatcctaatttccagatcctgtgaatatgtccttaagacgtaattaatgttatagatctagaaacagaggaatgatccaggattatctgagtggatcaactcattgcatgagttcttcaaagcaggagctttgtttggagcaggagagaagtggcagaaggggaagtcagagacatctgaagcatgagagggacttcacttcccactgcttgaagacagaggaaggggcacctggaaagcatgaaatggaatgagggcagcctccaaccaaaatccaggccccctgctgacagccaacaaggaaactggaccttaggcccacaaccagaagggagtgaatttagtcaaaaaacccgaatggcttgaagcagacttagcctcagaacttccagaaaggaacatggccctgccaacaccttgcctttggcccaagcagaggacctaccctagacacatgatactcagacttctgacctacagaagtgtgaaataataaatgtagtctgttataagccattgttggctatttttacagcaaccataggaaagtaataaagcactcatggcatgttcaattccaatagcccttgcagcagacacacaaaaccaccaacttcctctaagctccaagtactgcactctgtccactcaccctgctgccttctttaacttacaaattatgcacacagtaggtatgtttgcataattaaaagataagtagaagaactaatagtctttaaaaaaaattgttcctttagttgttctgaatatatgtttgtcctttgataaaggactctttgcaaggtttccgtatgacactttattcttaaaatttttgagcagttaatttaaaagtgaatccaaatggatatccaaatctaaagtcatctaaactgttagtagtgtcaaatgagattgctccaccacaagctccatttggaaaagtaaccagcacctgacctacagctgagttccatgtaatttagttgtcaaagtgatggagcacaactcttccatttaatttctatgacatctgtatcaacttgactgtatcctttgctgggccaatggcaatttttctggacaagatatggtgtaaatggcagggccaaaacacaggagaaaaaaaatgtaggtgaaattttaaaaataagataaaagatcacatgtttcctaggcatccaaaatttaaaccatctatttgatgatattaaactcaaagttgctgtgaccttattgtattagtaataatagcaccaaggtaacaagtccttggaatctttctatagcatagactattaactaggctctaataaaataccctattttgttcccactgcatgtcacttttgtagggcatatcttggagttaagaaataaagattgaccatatttattgatttgctcattctctttagagaaaaatgtgaggataagttttttatttgatacctagaccaatagatttccaaagagctgggatcaagatttttttttttttttgagacgcccggctaatttttgtatttttagtagagacggggtttcaccgtgttagccaggatggtctcagtctcctgacctcgtgatctgcccgcctcggcctccgaaagtgctgggattacaggcgtgagcaactgcgcccggccagggatcaagatttttaaaatctcttaaattgtccgaagggtgcttcttccactacatcatagacagaaataaaatttagttctagttagacaccctgctctttgaaattaaaaaataactacattaaagtaggcctttccttccactgataaaatgttccaaagttatttatcacaccttgtctattacatttttgaacagataatatttctactatctaattttttaaagcataaaaatatacagagaaaagtttcaatctcatcatctctgtctcttatctgtccagttacctgcactcccacaaacccgtctaaaacaactattgtcattattattattatattgactcttccagagttgcttttggcatatacaaacagtattattattactgtattttatctcacacttttggtaacatactttacagacaattcttttcacagaaggctagcaagtcttacggccatttgacagattaaagcatcaaggctcaggaaaattaaaccttttgcctacatatatactgacacttgagagtcttgcatttttctgaatggtattctatttctatcataccttattacctctgttagcacatgattacctaccatcatttattattctctgtcagcgtcctgcatataaatccccatcacaagggactgaaaggatcttagaattcatttaatcttctactcattcagtatttgcatcacatggtaactcccattcctcttcaatgcttggatacctccagtaagttgtaagccctttaaggatgggagacattttctgctattgttttccctctgttataatttatcatctactcttttctctcttctatcaggataattataatggcataatcccttttatgtgacttcccagtcacagttagttttttactataagaataatttgtaaccagtccctcataggatctcagtgcttgtccattgttgctttttcgtatatttgataaatattcaatttagaataatcattggtaataacttctgtatctttacaaactaatgactgaaaataatcattataatgtaagactcctttaattgggtttccaaaaagattgtttcataggaaataagacctacaggtattcgaaggaaaaaataaaagcattacatggtcaggtaagtaggattattagatattcttagaaattcaccgtgtccattattatgtacaaagctcagagaagtggatataactttgtttaaaccagagttttctaaacatattttcacattgaactccttttccagataacatagatgagcatcctacaggccattttcatgaaccatactatggggaaaaacgttgcaaaagaccatttgtttttaaaaatgttgtaatgaaaaaaaaaaacaaaacaaaacctcatttgtattcagcatatgtaaaacacagaagagaaagcatatctgaaagaatgacaaatagctcagttctcttttccaagcttcacaaagctacatagttcatcttctcaatataactcaaagaagaacagagaaaattttctgtatgcacataaatgtattcatagcatttttttgaatttataatgccttggccgccacatctcagactgaagaattaaaaacaacagtatttcatacttttcttgatttttttaaacttctcttagccaaagaaatcatacattgctgtacttacattgtatgattatttgttattttagataactcctcagataaattcactaaattaaaacactgtatcgaatatgttttgcttttttgtctggacagtctttttattgcaacatataatgtaaaaagtaatatttattcattgtcactgttataattatttctctgattttaaaaacagtaacagacaagttttttttcccccaggattctccattatatctaactgaattcccctatcaggatgccctttttgttttgttctgcttccccctttataataggatataaacaagagacagaagttaaatctccagtgagagaaaagtaacacctaacgaacagacaaacaaacacaaaaactggtgacagtctcaacattctcaaatgttttgctcaagcactctattactgttagtattgctcatttcatttaattgtaaataaggtagattttgctgctaagcaaaatgatagaagctagatcttcctaaggacaaacagttataagaacatctgtacctgagggcaaaccaccagaaaaagcaagaaaaactcctaatagtgagacagaatgagggaaaggggagaaagactaaaatgtacctgccaagaaaatggcatatgtttaacagatccaggtaactcttttttgatgattgcagtaacagataaatgcagactgacctctgcaccaggtatttctagatatccagatggcactcaagggaagggagcaaccttagcttaaaagttttatttcagaaggtggtggagggttaagaagaaggaaaggtaaagatgtgtcaacatcatcttctacaaggcttgttcatatgttatagtccatttgagaaaggttcatttaaagtatgttttggtgatcaatggttgcccaaataggccctgcctcagtagagaaacccatggagtgccataaagggcatcaaggatagacccaacataaaagactacttacagtaatttaatagcaacttaattcagatcagagctgtgcaataatgaggaacggttaactatgaattgatgtttattgtatgttagaatttgagctaagaatttaacatggattatagattacccacttaattaatcctatagacaatcctgtgagattcattatactaactcattttccaggttagaaaattgaaacagactgaataagaaacttgcctaaagtcatatcgtttctacgtggtaaaggcaagattcatatccagagctgggcattttaagtttactgtagaataaaataaaataaaagcacaattcaaaatatattaaaatatatctaggggagccagctctgagtttaacttacatcacttctggtggattgaatggatttcagtggtcactcagctatattatatataagtaggaaattttctaggtatggaaatatataaactggatcagattctagaagacagctggtggccaatattatctttattattctctactgatagaatagtatgcatcctcttatatcaacagagaagaaagattataaaagattgatactaatccaaatatagtttttttaaattgtttccaagcttgtcctcttgctggttcacaattgggtcaagcacaatttttaaaaatatatattattcatctttaggcaaagtttccttacaattcttaaatcaaagggagtaggaagtttgcattacctaagaaaatagaaataaaagaaaaaatgaacatggaacagattactatttcaatatgctgcaggatatttgcaaaaatatttaaaagagagttacttttctaaagcattaatttagaagctaaaaatctgaaaattgaattgataaataatggtttcattttaagaaagatcttaaaatgttatatgagaaaattaggtcatatcactttttttttttaacattgttagtcttcaggatttttggcataatttatatgtgtaaatttatgtttttgtcttatattaatattttagggctctgtgtttcatttctttcattttactgctttccttgatctcattacttatgattaattagaatttttcaaaacctaacctggcacaaataaataccaatgaaagaaataagaaaatattggcccttctatcacaattaatgtagcatattaataatatataatattacaatttacaatagtttctaaatataaatttcctcatatttttctcacgaaaacctgtgagttaaataaggcaggaattattattgtcattttactgataaataaactgatctttcaagaagtaaaattacttgcctaaagttatgcagcttaataacttacgaataaaacatttgtttacaatatatacacagaaacacaaacacacacacacacacacacacacacacccatccccaggaactgccgatttctagcataaatctactgtaactcagaactgaattaataattatctagtttgctgataagttgacattttgacaaatgtgtctcagtataagaggaaaccatacaaagatgaatgtatttacaagtttatttgaatcataatacgaatgggcttaacttccaattctttattcaattggtccatattttatcaattttatttaaacaaataaatgggtacgattctattgctttcaatagataaaactgaatcagactgatggtatcaataattatgttaaacctatcaaagtatttgagggctttgtggtagaagttaaatgtgataatccacggaagcacttagcaagtgcctggtatacagtaagtgctccacaattatgtgagtaacatgctgctttataactaatcacaaagaagtgatctggcactatgaataagatatatcttgactttcataattttagattactggataatctcctgaccaatgcagttggattatttccaacctcccacatacaatgtttttcttgaataattcagtgggaaataaaggagataaatgaagtctcagaaaatcagttgcagcttcaacctcattttgacatttccttctaagtacttccatccacacaagtgaaatgctgttgctgcccccagagacaccgctgatgagcccatgcttgtcacctaattcaggaattgcccttatgttgattggcctatggcccatagtgcgaccacacataaaagatctgcacagacaggaatagtggtaataaacaaaaacaatcagaggctctcctacaaattctaattagagataaaggagtcagtaagtagtacaaagaaaagcacaaaaatcacatatggagaaaagaggcaaactgagtaaagttactcagcagtagactagtagaacagtgattcacaaactctgccatggatccccgtcaagcttccaagtgctaaacttcattctggtgtctactagacattgctatcatgaggttcttgttctctcttgagctcttaatcatgtagctattttacaaaaactatggttactgccttctttacatctttgtcaatccttcaaaagcatttccattatttaagtaatgtaagtgaactctcaacaaaacagtctactaactccagggtactttttgatacatatacctgctgggttatatagtcattgcctgttctgagtttgagaagacggttaagacaataatcacatcacgcatgagatacattctagtatattttatacaacaggttagcaaatacttctgttaatggcagggagactgttactttagtaaataacctgagcttattgataagggaaacttgatagcaattggagaattagaattagaattagaatctctaattctccaactggtaaatgactcctctaaatagtttattcaagatgaacattggctttacaagaaatcttcacagccaataaagtagacactagctgtggtttataaaagctgaaaacactattaaatatttcagttctctctgatagtgttatatttgactctacttagccaaacatgtcaatttcataagaaatctataaaatgttattgttaaatgggaatcttatcaatgaccggtgcatttttaatttcaatatgatagcagaaggcaaccaatataagtcatatgaaaagacatatttggattttttttttttttttgctacaaggcaagggtcatctgaaacatttcccatttcatattttgacaatttatccttcattgtttaacataaagccttctagttttccttgtttcataaaatttgaacaatcatgaggtggtagtagcccatttatctcatggtaaatttcaaatgaacttacacatggtttagatgggtttaaagtggcagctgtaatttttgttgggtatatgcagctgtctgtaatgattctggtcatacattttcattcaccttattgtctgaatattttctaaaggaaaataggtgtgtatgtatttgcttggcccaactttgatatgtcttgctggctttcatcacctttggaagaaattgcatttcccagtaagctgttccacagtggaatgataagtgatgaccatcctgtggattttcacagctgtacaaaagacattcaggtgcacttgtcttttgaatcagaacccagttagcccctcgcacatttacaaaattgcttttgggagagtcaaacctggatgacttccaagctagttaaaaataattctgaagaaaagtgcagtgctggttcttggcggtagaaatgtgagttatgttcagctgcagtagattcctttcaggcagttctgatacccatttcaacttccaaatttctggcagacgttatcttgtactttcagcttttttgtgataaacatattgaaaattcagtcaaacagctttttatcatttcaaaacttgagctcaaatttaatcctgctgccctgatgaagcctgggaagctgctagggcattttcattatatccagactggactgcagaactccttgccattcttcaggactctgacagcatcattcatttagaacaatgtgatcgatccagaagaagccagcagcaacaaactctgggtactcatacggaagagcatatcctatctagttgaaaaatgtttccgtcttcattcttagcctagagataaaatatcccatcatttggactttagatcctagaagatcttacagattttcctacagtatattaacagtgtttacatttaaatctcaatcgttagctacagatggataatctccaaccaacaatgttagagttgtctatcattaatacatttcctatttgtaaaaatgtggattgctaactgaacattttgtttcttataaagatttcaggtattatatagaagtaacctactaatctttgatatatgtaggaatagaatactcattagtgttttaggactaacctaagaaaattacgagttcctaagctggccaacactcaagattagaactgatataaatgaatctgaaagttaaagaacaatggagttgaaaaaagatttagaaattatctcatgtaacgattcctgatctaggttcttcaggcactcaaaaataaatggataagcaagtactagtggttcatgaactattttcaatacttataaaattatcatagaaactgtaactaaagagaatgcacaggttaactgaattgtcaattttagcagcatttgattggaattatatcacctctgtggcaaagcttggcatttcttcttattggccaattaactttctatgtaataagatttgttgttgctgctgggaacagggcttgagttttcactgctagagcctcgttagtaagataaaggacttaaagtacctggtaaaaggcaagctgcacagtttaagagaagtttcttgaccttgaattgttgtcctcaacaacaggcagggtacctaagttacacagagggaagacttattttcccataaaacagggtacccttacctaagacaacccaataaagtgtgatgggaaataggacctcacacaggaggagaaagcaaatctaaggtgtaaagtatcggtgggatctagtctgcttctctccattcctcattctagctgtgcatccttttcccactttttcttttcttgaaactactcatgtaaggagccagagcagggatccagggtgacagtgaagaaaccctaggctacagaagcctgaatcaagaccactgtgtgagcttccagccatagctcaatccaggcactcagatcaggaacaagcctgttggtgctttggccattggcattcactgaggagaacagggttctatgcagacatttgattgcctgctgatttctaacagggactgtcctctgttcatggctttccaagagccagcctttatgggagcctctcagaggtgacaaggtcagtatgggcccctcctcacagcactgatgcctcacagatggcatcagctcgtaccacaggcaaccacatgagcttacttgttgaggaatgagcttggtattggtggatggcacgtgatatttgcacacatttattcaacaaatacttattgaacacctgttatatgcttgctaggtactgagatgaaacccggaaccatacattgactctatctttatggggtttacattctagcaggaaaaatatattaagtgtacagttaccaaaaattaccaacaattatgataagtacagtgaaatagaaatacacagtgttatgagacattatagcaggaggatctaatctactctggagcatcagaaacggcttctcagaggaagtagcttgtgaagtttgacaagggtggccatataacctatcatccaaactgaatcacttcagagaaggtaccactttagaaagagggtgccattaacaagtacccacaggataacaggcaccaagaaggatttggttacctgagatatgacctgaaggaataaaatcaggaagaccaagaggaatctgaaaatacccgaaatctgcttctcatggctgggactgttgttttgaactgatcctggcagacttttggcccactgagtgaggactgttgttctatgcttaaggaatgaactattcattggttcaagtctaaaatgttagaactttggctcatattaaattacttgaccattcttagaaggaggccaacacttgacatatcagaacattcctctaagatcacaaggctatcaagaattcaattagaatgaaggtcctttattggcccagttccccagaaatgcattccagaagatatattttgagttgatacatgtaagactctactattactgctcaatgagtgagaaaagagatctagaggtatctgaattgttgactagaaagcatccaccagaacatgtgcaatgaataaacaagattttcctatataaagaaaggttgagagcagataaaattgttcgcttgcaactttacattgtgggtgaacagggagctttcaaaggagctgcagacttgtattaccactgaaggtaattcaactgtcgaccacacgccaggaaagaacctcttaaacagataataagtattcctgataactgccaaagggccttgatatttcagcaagctgcaaaagaaaataaatttaaaaactcacatcttactcaggtaatgcattaactccagatcactacagagaacatttcaattcccacttctataaatatacacctgttcttcatttgtgaggcacccctaacaacacacatacccacctctatgcacagagaggatcttataaacattattcttgctttccttgtacttgggtttgatttctctatttttcagcaagctattagatgtcattaatactccctataatttcaatagtttgttcttttggactaggttcaggcattgaagttaatgtcaaattgacattttttagcctaaacatacttttcccatctttgaataagttaagaataagcattaaaaagtgtcaaaaataaatgaactcgacatttagcttacatatagtaaaaaggtatatcaattatttgctggtaagtgagcacacagggcagagctgataaacatctaactttaagtttgcttctctgctttttttggcaaggaaagagaaaatctttatttgactacagttactttggttttcaacttttaaactagttttttgatatgccaaattcaacacatctttagaccttattaactacctttctgtttgcaactgtatctaacatgttaaattacaaccaggtgcagtaaaaccttaaaaaaatttacctctgtggcccccataatagaaaagaatatttactgactcttctgaacattggaataatgacaacaagcaaacagaattaatataaaatagaaacttctgtgtacttactggtcaagtcagcttaaaattaagctcttgcactcttaacccttaacccttaacaaccctgcgtagcaaacactagtctctactgcaaggctctatctaaaccagtggctgtcagttttggtaagtttaagcattggatggaatgtttattgaaaaaccacattcccaggacccacacccttaaggtctgaaacagccctcaggaatctgcactttcatctgtttaggtgactttgaaatgatagttcaggtactggactttttttttttttttttttttttgagacagagttttgctcttgttgtccaggctggagtgcaatggcacaatcttggctcactgcaacctccgcctcccaggttcaagtgattctcctgtctcagcctcctgagtagctgggattacaggcacatgttaccacacctgactaatttatgtatttttagtagagacaggttttcatcatattggtcagggtggtcttgaactcctgacctcagatgatccagtcacctcggcctcccaaagtgctgggattacaggcataagccaccgcacctgggctcaggtaatggactttgagtatcactgactgctatggttttaatatgtctccaaaactcatgcattagaaacttaaccccgaatgcaacagtgttgggaggtggggcatactgggaggtatttaggttatgaaggtggaactctcataaaggaattagtgcctctttataacgggcctctggaagtggtttctctcttttttgctcttctgccatgttgagtacataacattcatgcccttccactgccactgagtgaggcaagaagcccatcaccagacaccagacgccggcaccttgatcttggacgtgccagtccccagagctgtgagaaataattttctgttcatataaattacccagtttataatattttgtcacagcagcacaaaacagaccaggatcctgacctacattatttcaagtaggaaagataattgtattcttcttaatacttacatctagacacatgctaagtgctatatattatgttaaatcatttaatcttcacaaagatgccatttatgaaatattattgattacattttacagattcagagagtttaataaactgttcaacacattataaacatcaggttccaagtaagaggtgtcagttagattctaaagtcttccctttcctttccaatgctgtatctccgtatatcaaagcaacataattaattgctattttttaaaaaaaattgttcaagcacaaacttacattacaaaacctttcagattcttcagatttaataaataaaatcattcctttcaccaagctctcctgtatcagtgtaatagcagctcagactcttgcccagtggtcaacttctcagctaatcaaagatcttggtttaatgtaggccaaaccaggtcccctgtgtccttatatatccttttgcacttttcaggctttttagatacgttatctcattttattcttctaacggcactaatagatcacacaaaatagatgccatctttgtctgttaataccaaaaatcacaacagggttctcactttgctcctaattcagaagcatcatcatctcagccctttaactctcatatgcagaatttatttgagctgctcccctgccctgtgagcttggcagctttgtgtccctgtgtaacctcatgactgcagccttcatcccagggtgccaacctactcagccaaagatgacattaacagaggatctggctgaaatgccttgacattatttttctctgggaaaggtgtgtaattgcagaaaaactgctccccaattattcaaatttaaacattttatctgatggaaatgatatcatttacatattttgtttcccagtttaaaattgtggtttcatatcttttgtgcttgtatatctgagagttatattaaatttaaaatagctgagtgtattggctcactcctgtaatctcagcagtttgaaaggccaaggcaggaagatcacttgaggccaggattttgagaccagcctggtcaaaatgacaaaaccccatctctactaaaaatacaaaaaattattcaggcgtggtggcgcatgcctgtaatctcagctgcttgtgaggctgaagcactggaatgacttgaacctgggaagcagaggttgcagtgagccgagatagtacccctacactccagcctgagtgacagagtgagactctgtctcaaaaaaaaaaaagaaaaaaaaattacaatggctagccctggatccatttggtaacaatctcattctaatgtatatctttacacagggcaaattttaccagaagccttttaacgataacattttacgaattcaaaagagcctagatctggcaagtgcttggctggcagaagtgaaatgtatggtgtgttcaagaagcatcaattatggctgactgactggaccctgagttaaaagtcagcatggagagagaaaaaaataaatcatcctacgcctttcaaatacacattgtaatgtcccttctacttccacttgacaaatctataaggaaatataggttggggagcatgtgtatgtgtccaaatgtacttcgcaaacaaaaaaaaacagataaattattacatcattaattaacagtggtatttaccaaaacacataacatcttatgtcaatttaaagacctgttggtctattgaggagtagtttgtaactagctaagttcattgataagctaaaatcaaatgtcataggatcctggtcttctttgaaagattgcaatagaaatacaatgtgatgggatttttatatgtttattataacccagatgtacagtaaatcagagcattgctgaatttaaattataccatcacatcctcaacaacgatataaatattgaaggaacagagagataagcaagctatatgaccaatatctaacaataaataggtattaggcttttactttaaaaattaagggcaaattatttaaaatattagaaaaggtagcaagatacttgataaagaatagtgtgaactgacgtctgtcttccacatccctgcccattaccattcccagtagctaaatcaactttagtcaaggttaactaactcctttatatggccacacaggagtcccttggctatacaatttgcactttaatcctctggaagttgcaagaggccaaatgaaatcctcacattcagccagagggaggagagaagaaagccataattcagacctccctgtaatatattaagagaaatctgtcttttttttcagtgtcattgccttggaaggtaaccccttcttgaccctagcatttaaaagctaggttggtgcatgtccaacatcagggtcacagccatttttctgctactcagttcatcttggaactgaaagatagtttcttcccgccatcaatcattacccaaggtaagtgtcacagtatatgggtgcataaggtaaaaacagatgaatattaattggttcattttatagcaccaagtacaatgaacaaaaggcctggagctcagagttggaaactgaaagtttccaggaagaatcaaaatataccaaattctcaatagctatttccttatcttctgacgtgtgctaaattgtactaccaaatgtcaaatatgctgagtagccttggaaacaggctgcaattgtgaactgttagtctaccagagagtcaggatccctagctccatcaccagtatgagcaggataatgggcagatcattctgtttgctttcatctgttaaacataggtagtaacacctagtatatttacagcacagatacattagaataattcagtataaaaagtgtaaaatcagctggaaaaagttaaaagtgctatttaattataatgttatgatgacaaagaatgtgacccataacatccccaaagaaatttaggttaaatttaatatgtggactgtttactggtaaacatggtagaatcatgaataagccattattctatggaaaacaatgcaaaaatttatattaacttcttttactcaaagggtactctttctgtcatccactcaaatagtactgtctagccagaaatgagtttatttttaacactatacaggaaatagcacctcacatatatgtcagtttcagtcatgtggtcatgattaatagtcatcatctgataggcagggtggaatggtgatgtgaacatgggatttcgggttatccctggatccacatctgtattctggtgctttctagttgtgtgacattggggaaccttccactacttgaccttcagtttctattgcctgtgattgtaataaaaatgcttctcacagggttgctgtaaagattaaataagaaactggatgtaaaagtgatttgtaaactgtaaattgtttataaatattgttattatttctatatggatatagagggctcataaatatgccgtctatttctggaaatttaaataacttgtgtaagtttttgtctccaacctaatttcccagatatctttaaatacttctcacaatgaatttccattctactcactgaaagtgaagtcatcgtcccccatcttgtgcattcttgcctttttgcttagtttgcatgcaacactctctcttcctatatctacatgaaaaattcttgatgatcttctctatccatcctttaagtcccaactcaaatgccacttcctctctgaagccctcgctgattattagtttccatatattaatctccatatattgatctcttttctaatccttttgttgcttgaactctcaacgcacttctttttgctgccactcatttaccatttaccatatacacattctttttcacagttatcttttcaaacaaagtttatacatcttatctctaccattagaatacaaggtccttgagattaaagaacatgagttagacctttctagtcccaacaaatctagggaggtgtcttataagcagtagtaaatgtgtgtgatgactgatataaatgaagtaaatgaaaatgtaatgactaatataaaaattggcacaaacatctattccatgcaacaggaagatgttttcaaaaataatattacattccaaaatgattttccagtggcaatttgcatagtgtgccatttcagtgcacatgtttaacagaattagcagaagagagactgatataagacaacccattttaggatttagaaggctaccacagattaaaaactaaaccaatttctgttcacaggggagaaacatttaggaagccgcaatctacagtaactttgggaggaatctgtccattattgactaaattaaaacatgagtcattgaagaaaaagaataaactcaagcaactggctaagtaataatgaaaaataaaataataaaacttggctgaaaaaagataattacagtccacatttcaaataagaaattataaaataaaaacaaataaaacaaattaccttacataagcaagtgatccccatctgccagctcatttgctatgataatgagaacttgttgcattctagttacctaaattatcatatctacttccatctacatataaatatacatctcaatgtaatggaaaagaaatggtttattcaattactggatttccggagctaacaattgttacaatttagttaagtgtcagacaccatgctaggcatctttacaaacaatttatttttaatcctttcaatagtaatcttttgaactccttaactgcttatctcctttatcattaatttaacaataattcctataatattttatgatgtctcttctattagttgctagaactactattctgctctctttctgccatttgttcattcatttattcattatggctaaatacttatttattggctattacatgcaaagtaccatttttagctctaaacaaagagtagtggaaaaagtccattacccaatggagccttcatgttgttactcaattctgtgcactgtgtagtcaaactagattgttagtttcttggaagctatttatttaatttgatttctttgtatcctctggtgtctagtacagtaagtacttaattcaaattggcatgcaatacatatatgttacttcattttaacatgttttaaatattattggattaaatgacatttattcctctactttaaacattataataacactacatcaaattctaattatcaagggaggactcagaggaaagtctaataagccattattcatcacactacatgtacttcctggtaccccaaaagcttgtccccattgaaacacaattattaatgcagattgccaggttgggtttctgttctagttggaacaacatctgtgtttgtaatggccataatgtagctaactgtgaatttttaccatgattttcagtaacagaataaacattctcttgacatttctacacgacaagactatgaaggctatttttaaagtattttgataagatttggcatttgaaaatacgaactcaatttaatatgaaatggacgaatttcacttacaattatagttttaatctgagctgctataacaaaagtagctcaaactgggtgacttaaaccacaaacatttacttctcacagtacaggatgctgaagggtccaaggtcaaggtgccagcagatttcacatctggtgaaggcccacttccaggttcacaggtggcactctttttactgtgccattgcatggcagcagtgacaagggagacctctggggtctcttttgtaagagacccttttgtaaagggactcttttgtaagggaatcacattcatgagggtttcactctcatgatcgaatcacctactaaaggtctcacctgaatatacattgagggttaggatttccacaaatgaattgggaaggcggaataaacatttagtgcactacaacagtttatatgcccactgttctcttcacttttctcagccagacagaagctagggtaatatttttaattcctggtgtccataacgtcagcaattacccgatgttgttttcttcatcacgctttgaaaggcagcacagcataggttaaatgcatggtttttgagccatggtttcagataaaaaataggttcctctctttgggacttttatgagacttattttatacaaacacatataaacatgggtatgttgttatataaatcttgggcataagtgcatgagtatgggagcacaaaaaaaatttggcttagccacattaccgttaaagaaagttggatgtggatcgacacaaataacatgaaggctgggagctgggaagggaaggcatgtttgcagagtaaagaaagatgaagccattctgttctcaaaaatcaaacatgtaaactgtttacagttatatttaatcccccaaaacaacatagttattaatctgtatctgtttatatcacacataaagaaaccagaaacagaaagttttactaatgtactcaagttcatatgatgatttaattcaggatttgacaatgagtacaaagctagatggccaaccaaggacgctcactaattgcagtatgaggaaaataagagcccttctgcagagtttccagctcaaaagcttttaagagacaagccctttgtatgtgtataaagatgtgtgtttgcattcatgtgcctgcgtgtgtgtgaaataaaaatttcatacttgagagaactatggaaaatagcacagtaactcaacagagccattgacatttgatattcttccttccctcccttcctctctccctctcatcctccatctcttctcccttctttctttctttatcactaagctgattagataaaacagaccatttcaaacctctgctttaggatgcgttgcaaatatgttagtttgcatatataaaactaatatataaaagtaaatataaaaatatatttataaatatattcataaatacataatataaaagtaaatattaaaatcctacaacttccaccattgtgaatgcactaaaacacattcaaagaattaaaaatttggaggcttggaggtgtaagattagagacttgtaatctttatccttcaactatcacacatgtttgactatcatatttgagttgtcttcatccctcaactattattattttctgttcattaaacctcttaccataattccagtttaataatccatgcaatggtttgaatgtgggggaaaataatattgtttggtcagtatcatcagtatattcaagcaaaaaattaaaaaaaaaaacaagtatttctatttcaaaataaatatcttatttaaaataagtttcgttttccggctgggtgcggtggctcatggaacctgtaatcccagcactttgggaggccgaggcaagtggatcatgaggtcaggagttcgagaccagcctggccaacatagtgaaatcctgcctctactaaaaatacaaaaaattagccatgcatggtggcatacgcctgtaatcccagctacttgggaggctgaggcaggagaatcgcttgaaccggggaggcggaggttgcagtgagccaagatcacaccattgcactccagcccaggcgacagtgcaagactctgtctaaaaaaaacaaaaacaacaacaacaacaataacaacaatcatttttcattggatttattcttgattgggattattagcataaaagtatctgagaaattgcacataactcaatttctaggtctttatctctctcatcctgaaaggcttccttaggccaactttgcctacttaaatgctttccttatttcaagaccctgttcattcagtggctttcctgaagtctctctgtcatcccaaatacactgcttggagcaacagaaaaggtaaagctgagagagccatcaactatgcccacagtagccctcagacgtgtacaaatacacacagatacatgtttaaagaacaaattacaaaactggtcaatcattaaactcagggtaacacattttcagcctgcacaagatacctagatgtttggctcatgcctttgctgtagatctgtccagcaagtggtctgatttttggatcagaacatgcaatttctgtataactgacacacagatatatatattgtctttcaactttttttttttaaccacatcttgaaccttggaggagttacaatgggaaacttcattttcgaaactcccacaagtaaaatagtgcaaaattcatataaaaccagttacaacatgtctctttcagggtacctccctccctccaatgtaagctacaaatcagccacattaacaaaggtcgcgctgcatcttccagttaatttgaactctttccctatttgcttccatctgtgagcaaacaaaacatctccagtccttaaggggcgcctccccagcattagctgctacttttatgccatactgttggtatggtagctaggaaaaaaatgcagtgcctgaaacaggtatttgcattcctatctacatcaaagggctgaatttttctttcatgggacttagtgttttccagaacacaaaagatccatgcttagccacaatattacattttgcatttataaaccactcttcccagtttctctgagatctcctgcatgtccaaagacactcaagcacttcaccaaagagattctctgttcctgttatcaagtattttaatacaagataacaattacagtttagagaaatgctagaaaaatgcacggaaagctcccaggtgccacttaactctccttccttgctgcattccctctcccaccccatcactgaaacctgagccagccaattagatgaacagcttgtcactcctagatgcagtgcaatgtctgcatcttactgcagctgttaggactgacaattcaattccagtctgcaatcctacaacaaagactctctcgtctggttcctgggagtcagagattctccttgttcatctttgaacctcaaaaatatggatttatcctggagcactcagaaggcttaaatctgtataaatagatagaaacatggaaattgtgaccctagtttagccactagatgactcagctggagtggactcttcggcttccaaggacagctcacatagctgctctctcagaatataccttaaattcccaatcacagagcagggtgccctaagaaccattcaatttccctaggcctgtgaacagcagatttttgccttggcaggttggataatctacaacactctttcatatgtctgtcctgttataaaatcagctctagtttgtactgggctctagaaagcattagagctaagaacaggatcctgaagcatgtatttcagagataactaccctttactaacaacaaatatgtagcatacagattcctctgaggtgcagtaaccacttttgtatttatagttattaaaagaagggaaaacaagaaatcaagggccacctcatttctcatataatgtgttctcctttgtgcctgacagacagacgaggactacatgaagcatgaatcctcaggatacccagtcactaattttttaaagtggaatgagtcctaagtgtcaaggggttttaagtaaagtgaaaattaaagcagttaaaaggaagttatacttaccacttgctatttactggaccttgtggtatgttttttttcatacattattttattttacttcataaaacccaattaattttttcctcataaacatttgggatagatatttttactcatattttacaggtagagaaagttgatatacattaatatgggtgttagtatctgagagaggttaaacaacttcccgaaactagtgagtagcagagctgaaattaaaaacctcaactactacacaccagaattatttaacagagttgaattgtgatttttgcatttctcgggaaatgtcccttggtgaaaactctgagaagagaaaaatgtctgaatttcttctgcaggaggtctctaggctcccactgctctttaaaaatggtgatcataatataagggatatacgtccaatgaatctagtattccatagactctatcaatcttttgcccaatctttgctattcttcaaaattttctgaagctataatttgggcatctccctatcatttactgcattatttctaggctagatgttagtggcaaaataattaaaaaatatggaaccccaaaattgagggtcttcacagcaaaaggaggtgataaacatacaattccccataatacaattaattctgatatatcagcactatgagcagagtactaagagatcataaaggaagaagtaatagcaaattgaaaacaatctaaatcagcaataaaatattggtcaggttaattatgatatatccacacaatggaataccacatagccattaaaatcatattgcagcagaatatttaatgatttggggatacgtttcatatacattgtttagtagacaagcaggctgtaaaataaaagcaatataatttcatttaaaaatatattggaagagtgagaacactttagcaaatgttaataatggttatattaatataaaaaggttaccattattgcttctgctttttgcttttttatgttttgtatagtgaatatgcttttcttttgtaattagaaaaacattcaatacagtttaaaactcaaatcatgttaacaaagacttaacaacaacaaaaatcaatttgaaattctttcgaattggggaaagtaaaattcctaacacacttaagatttatttccacagatggcctcatgagctacaaatacctcactcataaatcgtcttgccttgaatttccactcagtgttctgatatcatgccagatgtgggatcttgccttggtccaactcctcctttgtaattttaaaggcctctcacacttgggatgctgagctagagtcattctcctgcttggtagcttttgagagtgaacagatcacttcgctgtgtattgtcattcagttagtagatgtttctggctgcttcttcaacccatacaatatacctttcctaccaagaaatgtgtgacttctattctctcagccttggtgtaaatccctgaaagtgttaaggagaaaaaaagagcaagaatcctccaagatctataattgcacaggccccaggaaagaagcataaagaaaacagtaactaaaaacaaatgcagaataagacctgaaatacaatatttgaccacagtctaaaagtaaaagcttagaaactggtcaaggatgtcatgtgtcttgtcggttttgaagaactattattcaaagctttccatttaattatggccaaaatgcccaggtctgtttttcttcaaaatccagtgttctgatgactagctacattacccatgcatcttgagatatgctactgggaaaagaggaagaacagtttaaattattgttatgtggaaagtcgggattattaacaaccaacgaatctaggaggaaagccaaaatctgtgaagaaggctttcaatgcctctgggccagctcatctgaattcaagaactggagaaagattttcacttataaagttacccagagggcctggggaagaggtgagtgtcttccagcagctgagcatagatcagtacctgagatcatttacaacctgcatggctgtggtcagaccctaatgcagcctgggctgcagacacaacgtggtcagggtaccaacaggagactcagtgaaaaaggagactgtttctggagaggcctctgaatgatcagctgcataccaaccactgtgttttcgggtttgtttgtgtgcgtgtgtgtgtttcctagtgtgcactgaaaaacatcctaatttatacatgctcatatatcaccagcttgttaattcaacactaaagcaaaaagatgacaggaatacaagttcttgcttcattttttctgttttctctctaatttgtttggtagatgaatggagcatgcacaacatttcagatgtttactcaaatacaagatccattgtgatgatctttattacttttgtaatactaaaacccacagttgtgcttaatcataagatcctctagggtgacactctctaaattaaactaccaagaatttatattttaagtcaagctgtctcctgggtcttaatagtatctgatccagaaaagaaaaaatgagtgttaatagcagggcatacagtactatataaggtgctttaatcatcctaatgaaggaaatgaagatgatgaaatattcctgggaaactttttcatatgcaatgaagcctgtgatgagaaggaacctttagaaatagttttattatttgggtaaatatttctagacttatattcccttattgatatactcaatatcagaaacttagatttattattagagatttttaatccatgattcaaaattgtaataattattttagttgtagctctttatataatgaaattaaactacctgatgcatattaatgaataaataaatgcacttagtcaatctgactagaaaaagatattaatcacgttgtatggctttatatggtaaaacattagctggctagctaaatattacatttttaacttggctgggagattatatataatatacaaaaaagaaaccaaaactatctagacagctaaagaagcaaacaatacacatgaacactattttaaaattgaggtaattaagaaaaaaagaatacatatgtgtgtgtgtgatgaggtattactcatccattcattcatttattaaaaaatatttattgggcaacctgcttgggtcccctttcatgccgtggaagctttcttcttttgctcttcacaataaatcttgctgctgctcactaaacaaaaaacaaacaaataaacaaaaaaactgttgaacacctgatacagggtaggcacgattctaggtggtaggattagaatagtgagcaaaaaagtcaaagtaactgcctttgtggagcttgcttcctgattatcaggttacgtaataattatccacacttggatttgcacattcagatttagattactgtaaatacaaagccaccatgtgtgtgaattagagtaatagaaagaaaatcagaaaatctggttttcaatattatctcgatgtgaccttggccttgtcatttaatctctgaaaaaccttttttttttaacctattaaatgtgttggttggtattatcaaaaataaagttctgtaattttgtgtttcctgatagaagaaaaatatgtttgggctcatgtttatagtgtttatatgtggaaagttttcaacaacttaaaaaaaaaaacccacaaaactctaattgcaatcaacagcaaactgagacaggtattgcagtacttaagtaaagtgatgggtagctcttggcaaagttcatgagaaaaatcaccacactgattacaggtattgtaaagggttgtcagaaacagcaagtaaattgcagagaaagagatccacaaatcctttccttaaaatcactactattatcacggtgttaactgggtaatttttccagcacaaggggcaaatgcatttttaaaaaacataatcagttaaatggtacacatagaaaatgcccttcttacaacagccaatctgaggttattctattaaataaaataagcaaaaacacaaaaataaaagcccacattacatataactacaaaagttatctgtttagaagatagactttattttttcagctttgtaaaacagacttaagaacagaatacagaaatctcagaaatcaagtctcatacagacctaagcaaacctcattaatattcaagataatatttgtaaaaataaactttgaattaatcatgtttgcattatctggtattttcattaaagaacaagagagcatggagttgactataaaatgaaatttgtttctagttgcttatgatttaaacaaaccagcgtcagattaaagagcttttactctcagtaccatagaagctttgtcttggggtgtcctgggcacagtttatgatctagagtcagtgtggatcatatttcccataaattacaatccatttgaggaaactgcttctttaacactgtgtcactgcttgtatacctagcgaggacctgttaatgtgattattctttgtactcttttactcgatcccttaacaacttttatttgtgctgtgattcatgttttcaaagtgctttgatttccattacgtggtttaatcctcaaacacttccttgaagtagataaggcagccatcaagttctctgagcctcagtttccttatttattatatggaaataatagtaataaccttagctgcgcgtggtggcgcccgcctgcaatcccagctacttggaggctgaggcacacataccttatcataaggtttttgtgaagattaaatgagataataatgataaggaggatgatagttacatttcttggtcatttgctatgtgctaaaaactattttaattgtgctacactgttaacttatttaattcttcattgtgaccctaaaaaacaggtgctattatttcctcattttatatttgagaaaactgagtcacagaaaggcaaaacaatttgcccaacgttacaaaaaagtgaccgatctagttaaataatgacagaagccacctagaattatattaacacttgaaataatattacttccctccattagtaaacacaatttcacatcaactaatgatttctacaagactccaatatagtcattttaaatccctaatggaaataagggtaacaaaaattattcagcatacattctatctattctaaataagttgctttgatcctgtacttaaagaaaaataaacaagtaactgaatcttaattcatcaatatcctatatatagtcataaatatcatttgttcaatttaaaagaaattagaatatggccagaaagagtcaggcaagaggactaaataaataagaagtattctaagtattttaaaatgccttttggagctcatggatttggaaggggttagaaaaagagagctgacatttgggaacctttataaaaaaaggtcttaaaaaaaatctatgaagcaagaattatcaagtatcttttaaaagatattgtttgtcaaaaacccttatacttaaagagatataattccttattggattatatttaattttttttccaaaagcaaaactgctacttatgaagtcatctgttaaacaatttatattttattctaagcaaaattccagttacaacatacatgctttgtgaagacacagtcaatgtgttaacactaaagtatcaatgcctaggctataattagtattcaataaatgcttcaattatgaaatatggaaacaagctcctgctagtctatcaacagttataaaatgcatcattacacacacacacacctacacatccttccgtatggctaaaaacaaattttaagttgtttttcttctgccaaaaactatcaaaaaatagatcatgatgatccccaaaagatcaatcactctttatattttaaaaatacatcttaaaaaaacctaacacctagatagtgattttcaagtacagggtacacatattgattaacataatgggaaaattaaagcatttataaagtgctctaaggactaatctactaagaagatttatgtttttaattaaacattttaccatggcaatatataagaagaagatcttggctccactgtcagacttaataaagctagcattgcatgaatcagaagaggagacaggggttttgaatagagaaaggtgggtagatgaggggaaagaatattgagttgggctgaaatcctcatcctgttaacaagtccctgaattactgtcagcgttattgttaagccacagggtatctctttacaaattagagaaaggttacactttatcaagacccattatttctatctgtggaaaactgtcacaacatacttattatggaaacagaatctgtatcattatttaactcccttaaacttaataatcaacagatcaacaatatccatgatgcaaatagcatactgttagatgtagtgacattgtgcactgtacaaacaagcatgcatgcctgattgtcatgtttgagacagagacttcttcatcttattatagacacttatatgactcataatgtccttctgctactaaaaaagagcctgaaaatttggcctacattgtttcagaaaactgagtcccagtcttctcagcatttccacttatcctaataagttaacttataataaggtaataatttgctttacctacttataagatagtctacttctgaggatgacaaaatttaaggactggctttctgagtttgaattgcacacaaagtattcaattgcttttccctacagatgcagaaaaccatcaaccatgtctatgtgtgtgtatgtgtatgtaaataaatttatggcttgttttcccttccatcttttcttgaaataatgttttgacattagtgtaccttaatacatcaatatgtttttggtttgattatgtttttcctgttactgaatgtcctttttggatatatgttagttcttagaaaggctggctatcacctagtgtctataacgttaagaaaatgcctgcctgttaaatatagagacataaagcaaaacaacagctgagcacttgcatcattgttctggagggcaacactgattacccactttagttctgactccaataatacaacttctatctattaactaaataagcagtattttatttaaatgaagactggtatgttttagaaaagtcatctcaggattatagagctagtgtatttaccaaattatccttttctctgacccaaagagtcttgagtgcatggtttatgacagtttgttgaacacactgtgctggaagtaattattatccattatttttagaagggtctaatatgctactgtgaaacctttttttcccctgcatcaaaagaataatattattttactactagtcatatattaaatttcaaaacttgataaagcattatgatccctctaaaatataatgatttataacttgttttcccctcaattttaagttgcattcttatattctatttcttttaatttctaataatcatattttcattgaaacgatctttgttttgattataaattctctaagaactggatgatctctataattgaattattatttccgaaattaggttgaatagctagagtttattctgtgtccctcaataaggtatacactttacaaagtttttctcatttgatccacagagcattttagtttgggtaaaataattatgctcattttgcagatgcaaagttaaaatctgcatagtaagttgtgcagtttcttaaaagatgagggaagtgtcacaatctgtagagctaggatgtgaacccaggaagcctaacttcagacctggggtcttagccacagtgcaagactatgctaaacggcttcagcaagggagcttttacgcatggtcttctgagggtagttgatatggcaattccaaatgatatgaaaaataatgaatcagtgctttccagctgtcctcaatgatttgctccacctgtcttcaggcctttcttttatccatcagcactcttcaccctctcagcacaaagaacagcctccctcggggactgggtagagttgctatctgacacccaaaattcacaccttgcttctttgcattctccctgacatctctattcatcagctcatctgtctgcttcagagtcacaattctcttcaggtttggtttcgaaagcgaggctcaaaatttctgttgttctctgaggctgtggatccctcacactcacaggatgcctcttttcgcatgacagagatgcctaagttcattatccacaggctgcttctgagtgagagagatttcatcctttctaaagaccttcttgactaaagtagttctctttacctttgtcatcttgcagccactctctcgacagatgaggcacccagcatgttctatttccatagcatttacatattattaatagaagcaggccagtatctaaaggatgacattgaagaagagttttttttcacattttaccacagggctctacaagaagatgatcttgccagtgttctcttgaaacaagtttcctttttctcaactcagagaaatgctttttatgtaacatttgtgaaagattcttatggtctactatttttttaaatttcctattgtcggcctgactggcactgtgaaatgacatcaatattgtcagattcaaccaagagtcattatagccacaataaaataccatgtctccagaaactatttatttaagtataaaaaggaatcaagcataactttaatgagatttctcagactgtgtgtctgcctgaaagaaatgtgttccctctgtccagtcaatgagaggatcagagctctttccagctttctctcattacctgcttgttgactagtgcagccttcaaaaagataaccaaagactccctacatctctcagatgctatgtaatttattgtgatgtaatgtattggtctataattatgtcttcattttttcgtccactttgactacaaaatcttcctttatctttcttgttttcttttttttttttttttttgagacggagtcttgctctgtcgcacaggctggagtgcagtggcgcgatctgggctaactgcaagctccgcctcccgggttcacgccattctcctgcctcagcctcccaagtagctgggactacaggcgcccgccaccacacccagctaatttttttgtatttttagtagagacagggtttcaccgcgttagccaggatggtctggatctcctgaccttgtcatccgcctgcctccgcctcccaaagtgctgggattacaggcgtgagccaccgcgcccggccttcccttatctttcttactgtgattgcatttactctgagacttttagctttatccttgactgtaactcaggcaaattactaattacaatcttctttaaacttctgatattgatttctggctttatttttctaatccatgctgtactctgatttaatagaaatttttaagaaacaccaatgaaattaaagtttggctattactttcacataatacatattattcttcttctataaaaacaaacataacaactcataaaaaatgacaagaaatggaaataaaacatagggatcaaactggaatgacttctaaaaatagctagagttactgatttactataaaaactaaacagaaagtttgcaagtcaaaaataagtttattctgattattcttttgtaagttcgctgttcgaaattttaaatgcacttatattcactaccacataccaggaaacatcttggtaaacagagatttttaaatcagagtcagaaaaaaatgttatccggcagatacagaaataaagtgagggatggagaggttgagttaccttattgagaccttggcaagaccaaaagcaccaatgatctagaatggtggctggtggttctcaaggtatagttaagggataatgtgcattagcatcaccataaatgtttattaaaactgcacaccctagaactcatctctgatctattgtgtcagactaagagtgaaacctggaaacctgcatttcaaagatacttcccaggtgactgtgcaacaaaattagagaatttttcatagctatcaatttatagataagcaatacagaattagaaagtgaaaataaagacgcaacccagtttgtacatttaaaattcttctcatccagttgcatgatttgcattaggcatgccttgttttcgtttggctgttgggataacgggcccagttatcttatatcttgtctatattctgttactgtcagagaaaaggcaaatttaagtcttatttgaaatgtgtgccttcatctgggtcataaaagttaggtgtgacctttaagtacttcatagagtcttaaaaatatgtcagtttcacatatatatgtacgtgaccaatgaacttaatatatatcacctttcaggctgaacataaaagcacatgtactttcttagtgtaaaatgaggtagaaaggtaaatattttaaaacataatttgttccccatatttttacatgcatgtgcctatacatatgaaaaaaattgtgtgttttcttcctagaataaagaaaaaaactaagtaaaaaggaaagaagtcatcaactgaatgaagggagagaaaataaattcctgggaatgtactgttcccaactcaatgttctcagccaacaattgagaatcataattactattaggataaaaatacttcaggccaggcctgaagttagtgatcagctgctaagaggaatagtagttatcaacatcatgagaataacagtagtaaccaagcaaagcaatgcggtctgtacttttcactgaatgaaacatcaggtatttagatcatgttttctttctataattttgcacttgttttcaattacagataattatgtacttacaatattgttttatatgttttatggaaggaaagaactcctcctagctttaaagtaaaatagagcaaaactgacttgaccccgattttcctttaaatccgtatctcaaagtattttaaatctgaagtaaagactacttgtgtcaatgcaacatatatttttgtagacctttgttccttgttgtccaccacttctatgtactatatccctctcacatctgcttttatatctatagcatccggcttgcttaagatccatgatatctcaaattaaactaagaaatagaggcagtgaagctgaatgtacaaaacagaaagtttgatcttagtagactttcttccagtacactgtgttctgttttgtgattcacacccaatgatttgtgtattgtaacaactagctcagattccaatgtggccaatactttcaaaccagacactattcctaaccaaaaatatggcaagtatcccaagaacagaattattaatgtaactgtcttgtcattcactgactgaaatatctaatgaggaaaaggcttctattaaatatactataaataagcatttaacatttggagctttaaatgacacaacagggaaacatttgtgtagactgaaatctatttttattgttgattgaatcagcagtttgtaaggctgccaggcaatggatcagtacacttatagaaaaattaaatttaattgtatttattcactgatgaatagaaaccaacccaagacaagtaaaaattgggaaatattttttttattgctcacatcatagcctgagccaaaactgtgttaaattatttaatttgtgtttctcttatattatagcaaatgggagaaaacaaaaaacaaccttcctaaggagtgctgcgtttgggatggcaaataagcattaagtgattaatgcccaatagtgaccaataaataatttagttatctctgcagactttctgttttcttgtaatattttgtttctttagatacataatacacttgcccttaataatgaaaaagtaaatacaaccataatttattatttttattgggctaccagaagtaactgttgtataaggacaccaatgtgggtggataattggcatgatcttccaaatttgcagattttagagaagattaatatttgataatacagtcttaataatggtcgaccattgaaaatgaggttaaaagcaatcaattttcaaaaagtttactcaatggtttataaagatatttctaagaaattgaacttaactagcaaagattatagttttaatctgtacgtaaaatgtattttttaaatcttctaactacctaaaaactctatttttttcacattcgtatattagcatgtatatgtgtgggaggtatagttctgagatgtttatgtttcatagttcatttgccttaactattagaagttattcttaaagtacttgaagccagaaggtctaaaccaggggtgattttgccccccaagggacatttgacaacatgtaaagacaattttggttgtcacaactaagggagggctattggcatccagtgagtagacgccaaggatactactaaccatcctataagacaaaggacaggcccctatgtcaaagaattctgaggccccacatgtctaccatgccaatcttcagaaaccccgtcctaaccttttaaatttgaccttattttcaagcaaatttcttagttcagaggaagcactcttttaaggtagcaacagaatggtgcatgctagtagtgcctctcttgcccagtgctgctggattggtactgaatttaaactagttaatgtgaatccaggaaaaacaagggcaggtcatcatttcaagataaaatgactaacatgaaactttaatagccctcagtgttgcaccgctttctttgtctttctatgacaataaacatcatatttatgattactttgtttttgttaggtgtgaagatagaattctaatgaaccatcaaatatcataaaaaggcagtgagaacaagcacctggctcaaaggtccactgcctgctcatataaggtcctaaattcactctggtagtctatataaaacaaatgagctgtagaaaaatgctttttctggcagtgtacctatgtaccttaaaacatttctcactaggaaaaaaaaaaaataaagcaaacatatacacataacccccccaaaacaacaaaaaaactctgtgttggctaaaatggcagacacattttaaagtatgcagagcatacatttcagtactaaattattgcaaataaataaatccagagaatgtaaaatgaaatatacaggacttcaacatatccaaatgtcaacgaacaacaagtagttgaaagaccagccttttaatatgcaccaagaccaattcttgggctacaatatacctgttcaaataaaacaaaatcaacttaatgtgaagcatgtgttgaaggtactctatccctttaactatctccacttggctgttagagtgaaatggtgttagactattctcattaacttttaaaagcttaaagaaaagccagaattttacacttctcagagctaataggcctttcgtttattgccaatcttaagtaaaaattcacaagtagaaagatgccaaaacatatttgtctctctggatacctttataatttttttttaatttcaccaaatcaatatttacatattttatattttaatttatacttttcatatgctaaaattatttttataatgcacttaatggcttacaaagattaacacaaatagcaaataaaaaataaatctaaaaatgtaatgaaacgtaccaagaacacaagaaaaagagaaaataagaacaatgagatggagacagaaagagaggcacacaatttacagtcctagagactcacttgtagaagccactgggaattttgaaaatgtcagattgtatctcaataaataactataaaatatgagctcagaatataccatatcccatatcctaagacactgcagtccctcattttggtaaaactattgtttgtcttttctttgccatgtcctgtctttaaaaataaatatcctattgtaatttaataactctctttatctcagctatgctacgtccctcaattagtcccatacccaaatggctcacaaacacacaacactcttttcttaggtccagatccacatattcacctacctatttgacatcttttgttatataacctcaagatatctccactgttattgatagctccctctgcttcattctataacctatacatctgccgtactgccaactttccatttttactaccttcatccaggtccaagacattatgatagcaactactgcaatagctttttaatgggctctcagacattcactccaaaatcccctaatctgtgaaagcaaatctggtcatattagctcttcataaaatattaaacagtttccctttgcaattttaaaataaaaacaaactctttaatatgaccaaaaagtattgacttggtcttgaaacaaaacaccatttcaatcacatttcaacccccctgcttcccgtatttcagctactatggaacttcatttccattctcccagctccattctaccataggacctttgaacatgctgtgtttcctctacataacatccttttttcctttacattaaacatcttgtcatctggttcaccccattcctctttctgaattcatcacaaatgtcatttctttagaaaagttttctcagatcccttcactaggcccaacctgcctaagggagtctcatagagctctgtggtcctccctcttcttcctgacatagatgcaattttgtgtgtgtttgtggaacgccctagtgagtgtctttacgcttcacaaggatagtgatatggcttggctgtgtccccacccaaatcttatcttgaattgcagctcccataattcccatctgttatagggcggacctggtgagagataattgaatcacgagggcggtttccaccatggaaactggttcttgtggtagtgaataagtctcacaagatctgatggttttataaggggagaaaccccttttgcttggttctcattctctcttgtctgctgccatgtaagacatgcctttcgccttctgccatgattgtgaggcctctccagacatgtggaactgttagtttgttaaactttttctttataaattacccagtcctgggtatgcctttatcaggagcgtgaaaacgaacaaatacagatatcaaagagggcagaaaccatgactttatttttgctcattactagaccctcaagtctaatgcccgttcttgacacttaatgcctgtccaacaaatacttgccaaatgaataaatggatattatagtggtatcttgaattaagaatgataaaagtcaaccaggcatggtggtgcatgcctgtaatcccagcactttgggaggctgaggtgggtgggtcacctgaggtaaggagtttgagaccaacctggccaacatgatgaaaccccatccctactaaaaatacaaaaaattagctgggcatggcagtgcgtgcctgtaatcccagctacttgggaggctgaggcagcctggacaacaagagcaaaactccatttcaaaaaaaaagataaataaaagttaactatttgagatgttggtgctaatttctgaaccagtgatatacactgtgtagaaaggcacataatggcataaaaggtcagtgtttgaaaattattaaaaggataacataatgccccaagaccaataataaattcttacatatagaactcttatggtactgtttatacacattgttttattactccagatactctatgggacagaggatattattctcctttttatcaagagaaaactgagcttaaaaaagttaagtaactttctcaaagtgttttaaaatgtaaatgatagagctgggatgtgaacccaggttgtagtcatttcaaagtccgtgacctctatgctgcatagcattagtagtgtctaaatttaggtgactatttgggggaggaggtcatgaattttttttaatgttaataatcttcattcatttaataattttggatgatcgccctctataacagagacttctacatttcatgtaaatataccagggtaaaactttgcaatttttaaaatcacagcattaactatacaatggggtcactcaatgaaaatcgtttatgaatatgaccgaagatttcattataaaaacacccaccaccagtagcccaaaaacattacaacaaggctcttgtgtggaaaaaaaagtatttctctttaagaaagacttttcttctttttttttaatcactggcacaaaaattttctcagaaaacactaaggaatatcaaccaatcaaagacacaaaggtttatcaaggaaggtttatggaaagcaaatgttctccaaatatgcaaatccaaaaaggaaggacaaggctgggtgaaccctgtctgcagatagcacagagtaactgagtaatcacagagtaattgtgactgtttcaagaactgtgtttcagatcatgttaacttgaggaacaataaataaatcttgctaattcagtgaaactgctggttttatgaagaacctattgtgggccaatattttataattcaatattagtgatacactgggcaaattttctcattaatgacactgcatcatcaaactgcataaatgctccactgaccctaactatttgctactgacctccacagtttgctggaagtagcagttgtgtatgtattccaaatttaaaaagcaaatttctatttcaaaggacagatctgtgactgcctttaaacaatacagactcatttaatatctaatttattcagaactgaaataatgtcacacaaaaagctctacttttgtttttcagtaacagtatggaagctgtgatttctgagcaataatagaagaatacttcagcctctcagccattacagtaagcagagaatgcaagagaatgcatgagttcttttgtggaaattggcagataatggcagcttttctgaaatctcccacttttttaaattggcaatccgataaaacctttaaatttggggagtgggaggaggaaatgtttcaataaccacatattaaaaataacttgctaaagaaaggccttgaggctctcggatatactaagaacaaacaatcaaatgtatcctgtacctgggaagacaaaagcctcacaatcacgatgttaaaaggcaagaaccttgggctccagaggttaaagggtagcatcctgatgccataattaggcaactggatgcatagcaagaagagttctggaggggcaattagaattgtcaccagatccatcctggatacatcactaagtgtctctaagccttagttttctgtctttggaacacttggtttggctcagtgctctattaggcctagcctggaattcaagattctaaactctcagcaggaattttacctacaaagaaatataaaactagactccacatttttgagtcctaattcagagacaatgttgataatttttatatcattgtatgtcacaaatctgtagatgtcaaaaattcttacaaatccttatgattatggattttctgacagtacagtagaaatcgaccaagggcactgggttcattgaggatattttattaatgagacttactttttgattaaaaagtatgtattaatattgatttcaacatacctccattatgcaatgtgactgaaaacagaaaatactagtcacaaagtgaaatgtaattctatttcttttaaatacttctgcacctatccatttaaaaatatttggatgaaccacaaaaaatgtctattatgcatcaattttttacctaagcaaacctgcaattttatacgttttaaactgaatgaacttgtttgtatgtgtgtataacatgaattaaaatgctaggtaattccaataatcaacaggatatcctgcattatcagaccttactaaataaaacaagcttttatcggctacttactctattgcattggtcttaactctattccataatggcacagtttaaatcaatgttttatttttatattatcattttcctaaatgcacatagcaggaggggaattttaacattgtcttcattattttataggaagtatcacagattatgtaagtatcttgtccaatggggataatatgaagataggctaaagtcttttggggcttaaaaacttagtacatcaaaaggaaatatgtggagttattcaggcatatgtcttttattgtcattgaaacataatagaatttggttacctttatggttattcaaatgctgaaaaaattatctgtgatttaaaaaaatcaactggcagcataagcactgtcatcagttgatgctgatttctctaagctccttagcctttatatcacttctactcgtacaagggatgctttgtatatttctcaggcaagtttctcattttattttgttttgtttttaaattctaagtagctttaaaaattgtgctattgttccatctattcttctttccaattttgttaggcatttagtgacagtgggctttggtggaaacttatccattgctcagaccagggacatgagtcttgattagccaagacattcctggtagaacccttctaatgcctgtgactggctcagaaaagggccaatgacactggaggaaaactgctggggaacttatgggaaaggttctcatttgaaacatacacccacccagcatcctagtttatctaaggatgcagttatatgaggatgcaatgaatgaaactactgcacccattttgtgatcacagtgcgacataactaagggcaaaagccaatatgctgaagatggcagagtgaagatgtccaggttctaaagaacctggagttgtcaaactacctgagctttggattttttgttgtgtgacctaataaactggtgtattttctccttaaagagaaagatcacatttctgtatgtgtgtttgactgtgtgaatatgtgtgcctgtgtacgtatataaaatggtcaataaaatgttaatgctgattttttaaatgagtttttttccagtatttctttactggcagaattaaagttggttataatctcccccactttttatgcatgttcctatatttagtgtaggagagttaaaaggacaaggaggaaggatgaggcaaaaagatggaataaaattttattttggaatcagaaattgattactaagaacagtgacttgaagcaattcacttttggagtatctgtcataatcaataactacccacagcttggttaatgaacgttatttttagttgaattactaacaaaggaaacaattagatatgatcaccaacattttcatgcattaatgccagtgcaaattaactcctaccactaaaattactccttctgtctgtcaaaatctgtgacggctatgacttactgcacgcagagcataattgtgtctccctgcctgcataaagctgacacataaaatcaatattaattaaaaaaagatcaaaattgtcctcattatcttatttggctgtctctccaaaatagggttaccatttatgacagaataaaacagagtctggacttaaatgattcctcctgccaaataataaatgatccttttattggttggatctattaataaatatctatttctctatggatgaagttatgcatagtgtaactttgaaaaaggacccaatgtctaactataaattcatctagactatctatgacactttgccatggatatatttttgttctacacatctgtattctctattctctcctctgcccaaatgctcctaatacaagaaaagaataatcatttatatcagaagttgaggatcactgtgccctgcagaatgtatataatttatttgacattttatcttttctattataatgaatacaattttaagttttattattattacacatttattttaatgaaaaatttgtgggttcctaaaatactgagagaaatatgtgagctcaggagatttctcatgttcatcaggaggttttgcaaatttgtgcctcagtttatgaggtttcatgatacttcttttcctttccactccattttcttcatgctggctttccacacagcaccttaatgaataaaatgacaattccagagaatgttaccatcactaggatgacttagtatggaaccctaaccctaatcatctcaaatcgattgacccccagaaacaaaaatcacagggttagtttcttctgttctttcctgctcccagtgatgccttacagacatctctgagaactgggagtctacatgatgtgagatattttcttattaccatcaaaactcattcaaacaatattcgctttaataagttggtgtttacttgccaacaaatatcaataactcacaaccacaaaaaataattaaaaaggaaaagaaaataaaagaaatataggtggtttatgaatattcaatcaatcactttaaaccacaggtaattttatcacttattttgtcccattttaacaatttatgctcaagatatagtaaaatgaagtaaagcttaaacctttgactaaatgtttcaaagagaaagaaatttaactttgagaattgcaatatttacatatatataaatgcaatatttacatatatatatatatactcttttttcttttctgcccttaaattgccacttatacatagagtacatcacttctgctatccaaatgatttggtttgctttacagaaacccaagtttggcactttgggaggccgaggcaggtggatcacaaagtcaggggctcaagaccatcaccctgtctctactaaaaataacaaaaattagcggggcatggtggcgggtgcctgtaattccagctacttgggaggctgaggcaggagaatcgtttgagcccgggaggcggaggttgcagtgagccaagatcacgccactacacttcagcctgggtgacagacggagactccgtctcaaaaaaaaaaaaaaaagaaaaaagaaacccaagtctatatgattataggcaaattatttaatttccatatctcaacgttctaattcatgaaataagcatcataatactactcacctaataggtcccttgagaggattgagtcctcaataaatggtaactgctactattaataaataataacatcggcagattctaacactcagtcatatagacaataacttcaggaaatattctccacaacattacttacttccacattttcacattaaaggtgaggaaaattgatttctgaagttcagtagatagacccaaaatcatcctccaattagctggtggcatagactgaacaagtgaagagacaatgttcaaggtcactagaacttgctgtagcacatgtgaaaattgtagcagaaataaaagtataagaaaagacagtggtttccaaaataacactgacattttcactatagagagatgacaacaaaattagaacatttaaatatttttaaaggatttgttttctcttctatgacaaaaatttgattttacttttgcattagtgaagcgatatgctttttgaacttgaggttaggtgggtccctacctcgtgtctttgttgctatcagtttgtacaactaaaatctaaatgcctcggtttccttctaggaattatgagctatgcacttaaaattcactgaaattttaaagtgggtatgctctactaacaaaattaataagaagatgttaattgagggtggcaaactaaatacaggaaactgctcagcatttttttgtcagaaaatatttcaaatgagacaattttgtgcctcaagagtttatgttagctgggaaatggagaagggaagttgggagaatatctgaagaaagggaacatttaatgaacattaaataataagacttaatgttaagcacttcccacatcaattttgttttccagaaatccaatgagaaaggtaatttgcagatgaaaagaaaatggaatgtcagttaatttgacaaatgtcaaagacatgtttaaaactttgaaacttatctaacagatttaaccatcacgtgatcttttaaaccctcactacagtcccatcttctccttttccttacttataaaacaaccctagatttccttttcagtgttaaatagtattctaccttgaaaagaagtaagacatgactactttatactgaatttattcaataaagaaagaatttgatcacacatttctgaataattactgctttgtgacaaaatgaaaattaatggaaacagaaagtttcctccttcatagaatcaccatttactcactagctttgaaactaattctagcccaagattgccctcaaaccaggtccaaacacaaactgtaatccttataaacaccataactatgcagggtggaattatcacccacactgagccttttctttcaagtgttatttctgatttcacatgtgttgagaacatttatatacaagacctgagctacacaattttaaatgttattacttgtaaaatataagctgtgtctttatagtcacatatctttataatgttacaagaaggaataataatataaacaccatcacagttaatttataataatttggtaaaaacaataatattttaataatgaagctaaggtaatatttgtaagcaaaggaaatccccaatgtggaacaaaaaagaatgaacagcaaagaggccatcaagacctcacaagtgctcatctccccagatataagtacttggtcaatatatgtaagaaaatattttctctctaatgataagaataaaaacattaattataacaagatataattaataatcagttactacttatcgagaatctattaaatctgaattattccattcatatttttaaagggcttgtatatatacatagtttttcatatgcgggtatatggacccatatacatataaatggtccttcatttattctattgaccttcggaaacttgttttccccattttatagatgatcaaattgaggtccaggctacttaagtgacttcactgaagcaaaatccaagtagagagatattacctgtttaattagttgacatgcactgagctttagattgtgaatatgtatattcataataataagattatggttacatgaaactgtaaaaaatgctgttcttttctagggaaataaacacatgtttagcacagaatgttaaaagtagcatggagtagtatgagataaaattaaacatttgctttcaaggttatggcaacaaatgaccacaaagagaaaaaatgataactgaatcataattttctgacaatctcttggtgtttctgtattcctcctttgtgcttcacatgctgccctctcagtgaaaagcaactataagcacatagtctccaactgagcatgcggctggaaggcatgcaccatcatggttaattaggcaggcttcagaattcagcaagtagggtgaatcttagctatatcacttcctagctaggcaaccttgggcaagcatttaatctctccaaatctctgttactcatctatacaataaagttgataatagtatctacatgaaatgactatagctagaattaaataaggccagggctatcacaatacttggtccatagtaagtgctcagtaaatcatgcttatttttatatttatatctgcccccccccaggactgaaaaaaaaccactttaactttttcctctagaggtattactgctaataagtgcctcccctcccctcccttcccttcctctcccttcccctcccctccccttccctccctttttctctttccattgagaaaaccaaatctaacatgaacatggcattttcctttctgtcttggtatagcctatcatttctggattcaccatatggttaatagatggtggtgagacatagtgtggtatattagttcattcccatgctgctgataaagacataagcaagactgggtaatttataaaggaaagaggtttaattgattcacagatcagcatgcctggggaggcctcagaaaacttacaatcatggtcgaaggggaagcaaacatgtccttcctcacatggcagcaggagacagaagaacgagaaccgattaaagggggaagccccttgtaaaatcatcagatctcatgagaacttactcaccatcatgagaatagcatgggggaactacccccatgattcaattacatcccactgggtccctttcatcacacgtggggattatgggaactacaattcaagatgaaatttgggtggggacatagctaaaccatatcaggtggaaattttaaaacagtaatcaagaagacagaacccttcctctcactgccaatgggacaactagcccagcctcttctgtgttcagatcatagcagcatctagcagtgacttgaagctagggaagctccatttcaatttctgagctaaaactttttctcctggcacccaaatttatatttctgaatcagttttgccgtagaaaaattgttatgcatggtggggaagttctaaagttgttgtacattattacctacctcaagaacattaaggattaaggaggcttccaagagctcactggtgtgaggggctggtgagcaagcgtactactgtatcaatgaaaagatgagggatgggcacaggggctcatgcctgtaatcctaaaactttgggagactcaggcaggaggactgcttgaggtcaggagtttgagaccagcctgggcaacataatgaaacctcatatctacaaaaaattttaaaaattggccaggcatagtggtgtctgcctgtggtcccagctacatggaagctgaggcagaaggatggcttaagcccaggagcttgaggctgcagtgagccatgattatgatactacactgcagcctgggcaacagagcaagaccctgtctcaaaacaacaacaacaacaacaacaacaacaacaacaacaaaaatgtggtctgattttcaagtacaattcacaaaggcacatttgaaacacaatccactcagagactgggggctgcttttccctttcttttcattggccactggccactagagggctgctgtgagtcatcccccttgtcagaggctcttaaggctcatagttctgaaattaggatgcatttcaagggcgggaccaaattctcctccacttctacagtatctgcagagtgtctagaaatgagaaggaccgtttcaagagctcataaatatcctgttgtggaagacagatgaatgctctgggttggaagcaaatttttttttaacacatacctagggaacttatgaacactctagttagcttcttcaatgtgtctgaagactgctcacactcctgttgacaagtaaagagggtgaactctaagaagtatatttaaatgcaaaaatgaacccagttcatgtgcttttcttgtactctctgtgttttagggtagattatcatgagtggtaaagaagatagagaccggcattagagggtggggcttagatacacactcatatacaacgggtcatttaggttgcacaaaaatcagaaagatggccacagatcagaagtggttttccactcaaaccactgacctctgggttgtctttctgaagaacttctttcctgttggttagagtttacttggtatgttcttgacccgtgagacaggaatgaggagatcagacaaatgggaggtcagaaaggaggaagagattattcccatgtggaatgaggtttcctaatttatagattcctctgtggatgtttggtggaaacaaacctctccccatttgcttaattttctcttgctcttcacacaacacagtcaaccatatgttagactcttgaaggttccatctctttccctggttttcttttaattctatttcctctcaccccaagccaatccagagggtggaattccaacttcgattcagacatcaaagccagtgtggccacacttgatctatctcatcttctttaatagacttaattcttctcaaggcaggtcaagattctattatctttggtaattttatctaattcattaatcaagaacaggattttctacatgagtaatatgagtaataataatatccatctatgtgctaatcttctaattattttacacatattacttcgtttcttctatgaacagcctatcaggaaaattgctggcaacattttagagatgaagatactgaagcacactgtggttgagcaacttgcccaaggctcgcaaccaggagaaggtgtatatgggatgtgatcaccaaaagtctgttttccatatcatcaacactgtcctagctgtggctaaacacctctacctctgctatgaccagcagtctctatttttgagctgcacctagcatgcaccagacatgataatgataatctcacaagcatcacttcccttagtattcaaaacaacatcatcagctgggtactgtccccacgtatagacgaagaaacagaggcttggcagagtttagtgcgatatcagaggtcacacctctagtaataacccaaccaagactgctgaatgtttctctgactgcaaaggctgtacttttacccagcaaatcatgttgctcctatagaaagactgcacccaaccgtccctggaaataccataggcctgttttagcacactgcgcagcactgataaggttaaatagaaactgtgattatgcatcactgcattgctaatatctctatgaataaaatgtcgatttgattttcatttaacctcaaaagaatctgattaccaaataaccattgaagaattattggcaattatgttctgtaattatggtgcctgttaatgtcattagcgtacagcctttcatatttagtactattaattaatccccataagcatagaaatttataatcaatataacaaaggctccatggtaaattataaatactcccgaaatccctccaacagtttacagggctccgtgggcttccttggttgggacacatttagtttgggggctgcaagaatctgtggtaattgatagcttttcacccggaatcggctatctcactaatgtgcctaattaggcaaatgcttaaaactggagtcccaactgccactgacaactataaattcctgtagggcaatcaaaataattaactgcttgagtcaagagacccacaaatcagatatacaacttttcaattctctgagcaatatactgcttcagataacaactactgtcagtgagtgtctggtttcggttttggaggagttgaatacagtaagtatgtctaatgttaaaagtccaaaaaagattcatgatagctctatctcacagatatgcaagataaacatgcatgctcacagtgatgctaggaatggatgctttgtaaagcactggtctaagaatatcatgtttttcaaaatctcccaatccatcctcagattttcttttacacattttctcaaactgaaacgtataagtctgttttatagaaaacctattttgtttttgtaattttaaacatctacattaatatacatcagattttttaaatggttacattcacatattttatctgaaacaactactgctataattgtctaaagatgcagcaagctgcctcagaagtggtacattctaataagatgtggcatgataatctattctgcattgttcagaattggactagttggtttctgaggccctgctctatgttagaatctaaaagtccgtgaatcccattcttttttcccacagagaaaagggattagaacttgctccctgttggcatcccacgccctttcctgattccattcttgttctggacaatttcccaggaattagtgcataaccctctacagctgctgggcctcagaaacaatttgggaggagaaaatagaggctcagaataaagaaaatatctattaaagcattattgcatcaaatataatggagaacatgttcatcttttaaaaattcaaaaggaagaatatgacacatttaggaggcatccaaaaatcacctttttcagataaataactgttagtggagaaataaaattaacttgcaatttggaagaattagtaggcagaattataatatttaagatctgaaaataacctcaaaggtcatttgaatccaatattccattttacaaatgagtaaggtgaaattcagaaagggtaaataacttatccaaggtcccaagtacattgatggctgaaatggaactggaaatggagatatcttaactaccccatcttccaccacccctaaactaaatggttaattaaatttaaaagcttattacagggtatgcttaaaggcacaacttcagattcgtggttttaaaataaaagattgtatcctaacatcgctgacaaccacagttagcatggattctcagtcttgtcaagatgcagaagtaagatatgcatagacattgggatgggagatcttatcaggtcctgtagttctattctacgagctttcagtaagttttatacaaactaaaacaataataataataatggatgataacgacaggagcctatactattttgaggctgaaacaactacatctcacataatttgtcacatagcattcagagccctcatctgacctgtagtcatttttttcatttctgttttggtggcttctatagctttttatttatttgtgtttgtatttttttgaattagttgtcagtagtcaaaaattaaaaaatgtcacagaaaacctgactacaattttcttacatgtagctcactagttgttaaaaagcagagaaataaaaaaggaagagaagagaaaagaagagaagaggaaagaaagaaaaccaaagaaagaacctaatgcaaatgatgagataatggatgcagcaaaccaacatgacacatgtatacatatgtaacaaacctgcatgttgtgcgcatgtaccctagagctgaaagtataataataataaaaaaagaaaaccaaagaattccttctgtgcttggctcagcagcgttggagttcctgactccactttaatgtttccttagtctagcaccaccaccaaagttcttatacaaatcattttaaccaccaccgaagtactgacacaagcattactagccgaagtggttgtagatttccttgaaattaaaaatatgtttcacctttgtagtttcaatgagaataagaaatgaatgtgcagaacgtcattcttaataactatgcttattataagaaaacataaagaatgcataatggagaatgcatatttcttcatgcatgatggttatgggaccagcccttctctgttttatttcctcttccttaataggtagctatgcaataagaacaaattttgaaaaaataagacaaaagaagatattctgatttaaaaggaggtggaggaagaggaggtagtgtcagtggcacaggtagtacctaaagtctacctgaagattctctccaggacatgggttacatgcataaattgggcctctgaaagccttaaactttatctagagatggcatataggctttggatttaacactttctgtgctctatttcatcacatttatagaactgttttcatagctttgaataagtatgagcttattacatgaatatttagtttattacatactactatatacagctgtgattgtgaacagatacacttctgctttttgttgaagataggactgagttagcaatgtctactgtattaaacagaaaaataattctctctggccacttccatattctcccagatcaggacctatacaaacactggggaaaacaaacttccaagtgatggcagcacaatcaagctgttttgtggaaggtataactgctttgcatggttataagcctgccagaaaacatgcaggaattcccaattcccagagcagaaacattgccagcatgtaactctggattccaccccatatgccatatttccagcccatcttcggtcagcacatagtctgtgctcctggggcgtgcaagactgtgaaaaggcctgcataactagctttcatgatgattcctgcattaaagagtaaaagcatctctgttcagctttcaaacagcctacttacccatggccaggaagaaggggaaattaatcatttaattaaattagtcattttccagactaaagataaacttggaatatgactcacttaagcaaaactttccacaggtgtcacttctccaggaagattaagagaagggcccaggtctcctattccagaaaactatttgagggttgaaacctcctccactgtgtatcacctagcacagtgcctagtgaacagtaagaatcaggaaagagttattggattgagtagctattgaattgaaatggaacccagtctgcccactctaaaacagtcactttgaacacagaatgtattaaggtgttatttcacgtgcaggctgttacaaatgttgactcaggctcaaacaaaccttttagcatttttacttttaatccaattgaatgattttacaaaatagggcaaggatataaattcaaataaattaacagtgggtaaaagagcatctagtcctcaaaaaaaaattctttggcctgcctatcatttatatttgtacaattattcctcttctctaaggttcacaacacttaggcttctgaagatggaaatacactgcacagggtattaacttctgccaatggaaataaaactgtaaatgatttggttttgtgattatttaacatataaacatgtgctcattgagaaaaatgatgtctggacaactgacattgtatttctgccaagtaccaagctaatgttcataaaattttactggagggaacccaatgctaactataggatttcaaactgctgatctggagagatgaatcgtgaagcaatctacgttgtatggctaatcagaattcccatccttacccatgctctgaaaagaacctaaaatttctatttggaggcaacttcagaaagctttcattaatttaaattttaaagcagatttcttcccattatgtgtattcaactgaaagcctatttaacacaacaccatgataaaagtgaaaaaaaaaaaaatgtcaggtttttccaaggcatccattttactttattccagaatccagaggcattgaaaatccagggctttctgcatttcttaggatgttttgaaaactaaaaagaactggtgataatttggtgatttcccgttctctgcaatttattttaaacatgtgaaatgaatgactctatgttccttaaagctgcccccaaattaagcaatgtaatagttgataattagatgcatttaattctaatttaatagccatctttatttggcatgctctttatataaatactactcaactgaatcctattaacacttacatggtttattacatttcatctgaggaaaaatgtacatattctaaaagctgcattatttaatcttggtgttaatttactggtatgcttaatgagtttacaggtttagtattatttaaactttgtgaaatatatgtaacttttctttattttacctttaatatttggagaaaaaaaggttctattagggttttcaatatggttataattgtagaatgaaaataagataaaattaaaattaaaaagcagaagtggtacagttctcataattttctacatgcactggagaggaacaggttttcaggaaatctcaaatgggaagtagatgtgttgagcatgttgaactaggaaggctcctagcaaaaacaaatgagatgctgtactgcctctccattacggccaacacagaaggagaaaagaaaatggcatcgtcatggcagtctacaaataactaatcactcccatgcacggttgattttcagtatggagtctggcaggaaaacctcagggactctgtcacccacttgcaggccagcttcacatgacacagtattattattagcagcaatattttgaccatttctagttatcttttctcttcttatctctcccctgaagttgatacaagaaaagattatctgaaaataaagaaaataaataccagaaaaggtttaagtaggaaaaactgcatgtttttaggaaatattctgagtgattagataggggaataaaaagtatgaaacgattatatcatgttctatgtagcctgacaaggtaatccctaagtgagagaattttttactgctgcaaatttgtgtgtgtaaagtgtgactgacaagccacaaacataaattggtaaaaccaaaaggaagtcatttagcagctcattattttacaattttctacatttcaataaattcatcatgacgatttttttttgggggggggcggaattcccaatggcattaatgtactagtttaatagaacaataaaataatattgcaggaaaacatatggctctgccaaaaatattaaactaatataccataaaaggaaaatgaataggtgattcattcactatccatttacaattatttaaattataaaaatgaaagcagcctcttcattttaaaagacaaaagaaaagtcatttagtagtttagtaatcaaacctatgtgagagatcagttatctggttagatattgatctcacttataaatgattttatattacactatgctcctagttcatgatacatatacacacatcctcttattatttattgaacataaatttatatcaaactggctttaagactcttgtaaatttgtgggagctccagttttactaaggcaaagtgagatgcagaatcaactccattttttccaaacaattgattccttatcttctaaaatgccacaattttcattatgccatacaaaatattacggaatgtaaattatcagtaaaatttccttagttatctatttcactgtgaaatatgaacacagcctgtattaataaccatgaattcaaagagaaaatgctttaaatatatatcaggctagcttaatctaagcatattgtttgctgtggttctttttcagaactgaatatcaagctacagtccactctgccgaaagcttccagctttccaaaaactgaaaaccttcgccagtaaatcacaactgttttaccatatgcctctctgttctgccaagcattaccagcttgttctacttttaagcaaatttcattatattatagctcagagcaatgctcattaaaaagtattactgaaaaatgtcaagttgtttttatatagaaactagaatttattttctactgaaaagtcagatatttattgaacacaagacatttttaaaacatagctttcatttcacaagttggttcaacttaatgattatctgaagtactttgggtcttgcaccagttaatgttcactagtatctcccattgatgtagattaaccattgcctttctagaatcaacttagactcagattagtggaaaattctcggtttcttcacctatattcatattctcattgatctgcctattctcctggctccccgccagagccttcttgagaactgctccactggacatactttaggggactgtaaacttcattatagcctattcattatagtataaatacagttcaaagaacactagcttagaaatctcaaccccaccgcttctaattgtgtgattctcaattaagtcagtaacctctcagagtcttcatttccttatttgtaaaatggaatgaaaacagcctgctctgctttttgaacctaattattgtgagcaaaaaagtcagcaatgcatgttccaacattatgtatcccatttaccatatgccaaacacaaaaccagaaagcttcattttaaagcaccaagctccttcccaaggaacagtttttccttctcttcagatagtaaaactcactggccataagagcctgtgatccacaaaagacaggatagatttttattacctgctgtaattaagtttagccttggattccaggcccaaagatttataaaatgttaggctttaaaccacaaaaccaaaaaatcaagccattcttgattcctctcaggagaaagaatgttttctaatcccatgaggaaatcccaatcagacatactcaaattggatcacactttacatttaaactaacaataagaacaacaatagaaataacaatcatcactaatccagatccagttgttctttaattgtaggccaaatcattctctgcagatcctgaagcttttcaaaaatgaagaccaatcctgaaggtgagctgaaaagtgttgtgagggttccttcactttaatctactgcatttttatgcagtgaaatcgggataatgtggaaatcaaggtcgcttttgatggaagagaggtgacaaaaagatatctagagggacagaaggaaagggaacaggagtaggatggccaagaacaggcctacttaatttgacttgctaatttcataaagagactctgagcagaattgcaggtggattatccacatacaatcctcaggcctttctctgcactttcctatgctacatggtctttccttcccacagggatctttctctggtattgtctatctccttagcaatgagagaatggaggctgttcaaatcacctgtcatgagactgtcaccctactctctaggtatggcttcacctaaaatacaattataaacatagaaacttccacctcacaagtatagtggtgatagcaaaactcagagcatagcaaagtgcattctagatgccaacatagaaattatgttcattcagtacattaaacagcatttgtttccaaagaactcaaacagaatgacaaagaaaccactaacacttcactagataagcaaatatagcactttcaatattatattaagagatgcttatcaagaacttgcaaatttccttaccctttgttctagcaatttgcatcagggaatctattctgcaaaaagcagcgactgcatttttttgcataaacgtgtgcattgcagaattatttagatggacagagctttagaaacaacctaaatatccaacaatagtaaaagagtaagtatattaagatatttacatacggaataggtggttgatttacaaagggctagtggaatagaaaaaatttctcatgttaagatccacatcaaaattttttttgtttacaatatgcacataaaagattaagttataaaatcaagatttaccaaagttgaaagcatacattttttcactctcttataagagcatatttgcatgttcctaaaagaatcaataaatatactcttataatccatacatgttgggtatttacgtgttaaaactgaaagtctaatcttgtgctgtctttgaaaaacggctgtgttgctgtggctaaagaatgctttacagaaaagaagcatggtatactaatgtgagaaaacgtgctttgtttttaaatgtgatggttttcttggtgacattttgaagtcaatcttttctctcttgaatgacagaatttctatattaagagagtatgtggagacaaatagtgcctctcagttgcgcaaagaagcatatttagtatccaactacagaattccacggaaattatagaatcttcagtccagatttaggtaccagagttaagtagaaatggttatagaaccagtcagtaagagtatagcatatacgcagaccgccacacagagagtgaggcatgtgcaagagaaaaaaagtaagagtgtaggaaacaaagagtgcaggaggaagaagagagcaaattggtaatgattctgtaaccagagaagcactggcatgagtgaataactcaactgtaaagaagtacagaatggatgatagatatcccaattaccctgacttaataattacacattctaatactcatatgaaaatatcccatggatccccaaaatatgtacaactatgatatatgaatacaaattaaaagtaagtacagaataagtcatatctatcatcacacatgcagtatctccctttttaaaaagttctcaataaaataccttaatcaaatgtggctcagtaatagtaacactgaatttagacaactttatcaattatcttatcactagaatggtgtacaagcgtgatagtctttgattgggcatgaccaggaaaaagttgagggttacaagactggtgaccctcaagagaggaggtaacatttgtcggccttacaattctcaatattgatgcatgctgtgaaagtgcaagacataagttattctcaatattgtgagaccatcaaatgttacctcctctcttgagggccaccagtcttgaggctctcttgagaacttccttccaatattagtccataggacctcctgacacattcacaagagaaacagagagcaagctgagtgacattatttttattctcttacttgagggaatatatgtaatttagaatggattagatagctctcctgcattgctttattgaagatatgtctggagtctgcagtcagaaattagtgaagtccttccttatccatctgaaaatttcaagtttctctaaaattaaaacaagaaatagaaatagtttaaccaacgcagagaccagacccaacacactaatgcaaatacccctttcctagactctactatggtcgattcacttttccttatggttcacttcatggcaaagctgtaattataatgcttagaaatgttgacctttacttaatgactgactctctcatgaccaagattaatgatttgaaagcccaaatgcagatgctaacaaaagataaaggtgtatctatcacttaatgcaatgaaattttattcattaaagaacaagaaacaaaggctgattatatcttccttcttataagctatttaaaaacaaacaaacaaacaaacaaacaaaatgatgtttcgctgtgttacgcaggctggacttaaactcctgggctcaagcaatccttctgcttcagcctcccaagtagctgggactaaaagtgcccaccaccattcccagcttataaactacttttaaatagcagtcattctggcttgttttcttgcatccagaaatgaattcgactggtggctcattgtttctttttccagagtaacatggtctcttttcctttggtccacacagatcctgtggatcaacttcatgtcagaaagcaaaaagtaaaaataacaccttggagagctctcactcatctattcgcaccaacctaatcacaatgctactgcttccaggatgaccaggtaatgagtgtggtctatccaacacgaggattctttccaaggcaatttggagcaaatcaactaggctaattggtaattcaagtttttatcccataaaatgactgtggcccaagggaatgtatcagaaacctgtgcacaagagtttgtattagagttgtttattaacatggggattatcttcaaaccaataataaaaagctataattgactctttgcaaatgcataaatatgggagcaacagtgtgcacaggttattactaaactggaaaagaattttaaacatttcttgtaataaataaatcacctttaatagtgacaaattgtagataaattgcataatgccaatgtatatttcaaggtaagaactaataatacatcaattcttttttgttcctttaagattagaactcataaaccccacagtgcactgggtacaaaatcccattgaaaactcagaaatgggactgatgggagaactgaactcagagacttccacaactcggaaatatgttcttaaaaagccatgtatctttttatcttgggcttctaggcaactagcacaggtcaagataactagcataaaaggaatcgggcactaattctgctaccatcttggtgtacgatctgacgcaagtcaatgaatcactatgcatctcaactcttagatctaaaagacagaataatcaagaattttataagactccaatgagacaatttataagaaaaagcattgaaaataatgcatgctgtgagagcgcaagacataagttattaaagggctgatatgtcaggaatatcagtaagtttcagaataaactgttacggtctattcttgatttggttaaggacatgagggtaaatatgcttatgctattccattttatggatagcagtggtgagaaccactgtggccaagaattttgtcaattaatctgcaaacttttctgaccaatgcttagcactatcaatctaactaagctgtgtgtgtgtgtgtgtgtgtgtgtgtgtgtgtgtgtgtgtgtgacttaatcaatacctaacaaagatccctggggtgaagatcactcctatattatacctagtaccaccagttatttggagggacaggtgttatccactgatcaaatcttaggaagctgcccctcggagaattacagctctggcacaagcagatcatagactcagtttacacttcaagaaactctatttagtggtgactgcacatagttcattttttaaaatctcgctgcacacagcctgatcctgtactactcaaacatgtcaattgttatgattcattattcttcaaaggcctcaagttggtactcaatattccactgggagcttggaaaacggatctgtcccttcactgagttattaggcaagtttcaacacatcttttcatcagtataagagtctacagaacctagcctctgtaaattcagagaaggggccttgtattttatggcacatggaaaggcgttagtcacacacaacttgttcccagtcataggcctctgttcaggctcctctcttctctaggttcccttagccttaccagcaaaatccctagacaaatcttatttcttctcagacccagacagagcctcagatcctgtatgaagactcctgcaatgaggggaaccatcttctccactggaatttgtacagctgttgtgaggctcctcttctctctcaatatcgccttttctactgccactcctttcttgttaaggtactagccactctaaccacaccttctctcattcctataaccaatcatttttaaaagtctggcagaatctctgatcccaacaccttcacagaaaaaaaaaagtaaaaacaaacaaagaaacaaacctgttatgcattataggagtgattttcaattgtgtgtatgtggggtgggtgtgtcttgatgggaacatgaaaactccgaggcagatgtggtaagcagatgggcggggcatgtgtaatgtgatgagtccttccagggtggccttatctaccttgcttatagccagcaccacaatctattcacattgtttgtgcctcagctcaggagcttcttattgctcactcaatacctcccaaatgattttctcacctacagtcttgttctctttaaccatgacccaaaccaaccaattaattctctaccttgcttgctgaatgacctgtgtaaatgcaggcctaattctgtcaagcccttcttaaatccttcagtgtctctctatcgccttgaaggctaagtcaaacttcccaacaaggttgagtaggctaccattcccgtttgggctttctagcccctttttgggtttattttattttttatatgcatttttttagagactgggtcttgctatattgtccagtgcagtggctattcacaggtgttatgatttggctgtgttcccacccaaatatcatcttgaattatacctcccataatcctcatgagtggtgggagggaccaggtgggaggtaattgaatcatgggggcgagtttttcctggccgttctcatgatagggaataagtctcatgagatgtgatggttttataaagggcagttcccctgcacacactctcttgcctgctgccatgtaagatgcgcctttgctcctcctttgtcttctgccatgattgtgaggcctcccagccatgtggaattgtgagttcattaagcctctttctctttataaattacccagacttgggtatttcttcatagcagtatgaaaacagactaatcaattttttgtgatggttaatattgagtgtcaacttgactggattgaaggatgtaaagtattgttcctgggtgtgtctgtgaggatgttgccaaaagagattaacatttgagtcagtggactgggaaaggcagactcaccctcaatctggaagggtaccatccagctaatcagctgccagcacagccaggataaaagcaggaagaggaacatgaaagaattagactggctgagtcttctggcctccatctttctcccatgctggatgcttcctgccctcaaacatcaaactccaaattcttcagcttttggactcttggacctacatcattggtttgccaagggctctcaggtcttcagccacagaatgaacgttgcactgttggcttccctgcttttgaggttttgggactcggactggcttccttgctcctcatcttgcagaaggcctattgagggagttcatcttgtgatcatgtgaatcaatactccttaataaactcatatatatatatatgtgtatacacacacacacacacacacacacacacacatctatcctattagtcctgtccatttagagaaccctaatacaacaggcatgatcatagcatgctacacagccttgaacttctggactcaagtgatcctcccatgtcagtctcttgagtagctgagactacaggctcatgccaccatgtccagctctaagaggtcatgtacttttttaaatttttttttcaacttttaatttttaattcaggggtcacatgtaaaggtttgttacttgggtatactttgtgatgctgaggtttagggtatgattgatcctgtcactcaggtagtaagcatagtgcccagtagataattttttcaactcttgccccattccctccctctccctctaatagtgccctgtgtctaccgttgtcatctttatgtccataggtacccaatgtttagcttccacttatgagtgggaacatacggtatttggttcactgttgctgcatttattcacttaggataatggcatccagctgtatcaatgttgctgcaaaaaacatgatttcattcattttcatggctgtgtagtaatccatgatatatatgcaccagattttctttaccaaagatactcttgatgggcacctaggttgcttccctgtctttgcaattgtgaatactgctgtgataaacatgccagttcatatgtctttttggtagaataatttattttcttttggatatatatcctttcctagcccagttttctaagtgtcagccagccctgcacgattacttgaagttctcaaagtggtgcaagcttcttgctttagagcatctatacagttgttgctcctggctgattcctgttgtcccttttataactaaataggctacttaccttttgttctttaagaccctcttcacgtatcacctcctcctccagggctctcttcatctctgaaggctttttaggagcctcccttcattttctttgaacattaatgataccacagtcctatctcaatctctcacacctgtctactctcccaagtttctgtaagaatcgactagttcctgtaattgacagctatatggtgttactattaattagtcccatttgattatatcatttcctgacagtcccaaacactctttggactgtggattttcaacatttgtatcagacagctggtcaggtctacctgctattttaccattgcttgcctgtaatttaatttatcttggcctcaattcctccatctgtaaaacaacaatgactattctactggtttatatggtgactaagtaagataatgcatatacaaaatacagcttaattaatgcctaatactagtaagagcttaattaatagtttctcttcttccccctccttcaaattattattattattattattatgctaggcacttaataaatacttgacacattgaattaattagctgagagctttttatatctaggaaccaaatttccacttctgctctccagccaacttgtggaaggtgaaaggaagatggtcagcatcaaaagattcctctttctagcacgtggcagagtattccacttttgccttgtaactgccattgaaggtgatatttcacctgataaagtcagttatgagatctcccatacagagtaatgaaaaagcctgtaacagctagtgatctgcctcccctgctgttgcctccaccgaataattttgccataaaaaataaaggggacatctccttttagtgaattatgacaaattttaactgacttatccctcttggaacttaggagtgtcctactttctcctccaatgacactcccactgagctgacatgtgacacatcctgggaatgcattagaactaaagagaaagttaagactgtgacacatccgttggccctttttttttttttgctaaaggaggaacatccctcctcccttgtctcctcagtccatagctctctgttctcaggatctttttaattctactggccgggaagacatttataggcaaaagcccctgtagagcaacatatccccctctctatcatatatacttctcaaatacctactacatgccagacactgtggctctggggacacactgatcagcaaacaaagcccctgcccttatatgattatagtggggcatgacataaagcaaatgtgttcctaaaaaattccaagttgaacaaatgacattcataccatactttgcgtatggtgcaaaccatatgtaccaataatacatgacatctaaggctgaattttaaaaataagtattcttgttagaggccagtcatcccttagcaactgactatttcagctctggctacagggaaggtgataatgagtaacacatattgaatacttaatatgtaccagatattctgctatctttttcaggtatttttacttgattatcacacatctaaattccccatgtggttatatgcttatcgttatacccattttgtagatgaggaaacagagcagttaaacaatttgctcagccatattgttagtaagtggccttgaaccctggcaatagagcacacgtgcacagacagagagattatgacacattgtctccaaaggtgcttcagaaaatcctaaggagggagtgaatgagtgaggatcatgaatgtgaaaatcaaatctacccacgcaacaaaggaccactaaattgccaaaatgctcaagagcatgatttactgtattcttcatttctgtgtaaataatgaaaataaatctctcggctcccaagaggagcacatctgtaatagttcctgctgaagatgttaaagatgtgtttatggaatttgcagaatcacttccttcaaagttcaatggtctataagttgctagtgttattgttgttaaaagaaactgaacgcttagtactttctgcttcaatctcaggttgagatttgtaaggaaaaccagatatcagaccagctcctatggaaactactctgtccaatcaaaagatatcctctttccatgaaactaacttaactacctcacaggatattcgaagcacaatacataatgtgaagggggaaaaccttactttccttctcctgttctagtacgctttaccagatgctcctgtggccaaaccctaattgttcacttcaaaacaaaaactacttaagcttctggaatgtaacacatctctaccaggttaaccattaagagacggagaggcagaggcagaggggaaacaggagctcctctcagacatcaggaagacaaatgcgaattgtccctacaaaagaaaaaagatcaccacctacgtgtttctctatcttctctcacttttctctgtttccttgtcatccctctttctgcccaggtaaagtggtggtggagaaggagaggaattccagctaaacagtgcgttggtatgaaccgtaggctagtgagccatgtgcatgctccagggacagggaaactgaagagagtgcactataggacaccaaatgcagatataatcaaggcttctttctacatgccgcaacatagtcaatttgaaaataagcatatccagaatggtaaagcacttgcgcagtaattcagccatgctccttctaagtatgaaaatctgaatatcaaagcacggtaaggagggaagcaggtgaaaaacaataataaaaacagtgagtcagcattttttgaagctatcagaagctcaacagagctgaatctattatgggataagaatggaaagatacaggtggaagaattgacatacagcagcaatatcttaaattaactccttgctattgaacacatgagaaactatagtgaaaagtctcagtgactgattggtttttatgcctagaagagaaagcaaattttgaaagtcctggccctttgcatttaggtccataattagacaattagagctcatgtactacaacaaagctctcaaacaatcatgaaacacagccacactcattttaaaagaagattcttaagagttaaagaagaccttttaaaaaatacattgctttcacatttcttccaagtagcatagaaatcagggaggaagaggaaaaggaggttttctatccatcagaggaacaggaatggattttggcatgcttggctaagcattctccccatgatttatggtctgaggtgtcacttacatggatgggatggggtgggagtggaaaaactgataacatgatctgataaacacctgtatcaaaagcacctgaattgcttgcaaaaatgtgtatttctcactgaattctgaaatactgaatctcagcagaaaactcaaagaatcttctaacaagctcctcagtgattggcaggagctttgagagaggcaagggctgagtaggtaggtggggaggtttgaggctgttgggcaaaacagggttgcatccctttccttagacaacaaacagggctgcaggatttaataaaattccacaatacttccagtgttaacaatggtgtatgctgggattaatcccacatgaaataatcacaaaatgataccagttagtatgatgcactgctatcctaccacagccgtgcaaattttaaggacagtcttttttggataaggtcccaccagtagataaactccacaaagtctggccaccagggagggtcaattaccaggactacattgtttctctagttcagatgtgcagaatataagggcagtgtgaagttcagcattacaaaaacagaaagcaatttagtaattagtgaaagtattacatggacaaaacaatagctgggagatttgtttaaaggaataaactaataactttgttcataccaacccatttcaaatatgggaaaataatttttaaacatttaaataaaactagaattaacgaaataccttggatacactggctagacaaaagattcctggtcctgactaacttgagaatttcggcaaataagtcagttaattacaaggagccccgtatgctgaatgcagttgcccaggaaatttgcttaggtcttgcttagtcaaatttgagagacagctcaactaccatacccatggggaaaattgtggacattcttggagtatatgccttaaataccatagttgaaaatgccttaggttgtgcagtggtagatgttttttaatgtactaatttaattgatttatacaataatatatctttattattgcacttagcaccttatattgcaattaataagttgtatattttctcccccttattgtctataaggtataaatttgactacaattgaattcattaattttaaaatctaaaaatgcccagtattttgtgtgatattatatatatcttttgtaaatgcttaccaaatcaatccgtccttctagatttttatttggtgaaaggaacttgtatcagacagtgaacactaatgtagtgaatcctagatttccgacagtgtgctaagggactgaggatgcaaatatgaatagaaaacagttcctgtccttgagaaggtcatagtcaagttgacctggaaatctctgtaagtattataatgcaatggtaaatacatttgctaaacaatagttctttaaagtacctaatttgctgaatacattcatatttccacatgttgagtttgttcaaattcacctaggcaatttatgttaccaatgcattttaatcctgggttatatagctaataaaaataaggacattattaattattttttaaattacattttaatatttaagtaatcctaattaagggcattaaacatgtaattaatgtttgtttcattataaacttgtctaagcatatagctgtacgctaaaaacaaatacaaattcagatttaccactgtgaatgctaaactttatcaaatagtacaactctggccgataatttatcatattctgcatttgttgatataaagacaaactgcaaaaacactaagtgtatttctaattataaataggatttctactcaggcctagggacagtgagtttttataaatgtgcaaccaaccccttttcccatgagtctgactgcagttctttctccatggctgataccaaggaagaaatgttgagactactctttgggattctctgcagtgtatttgctaaccatgtggaagaagtatgtgggatattttaatgaaaagggcagtaaagttagggataaagagacacaccttggtcaaaccaggtaataactaatatgactttagaaaagaaagcaacttgctctattgtgcaggctggagcgcagtggcatgatcacgactcactggagcctccatcacctgagctctagccatctttaaacctcaacctcctgagtagctaggactacaggtgtgcaccctgatgatttttttttttttaattttagtagagatgaggtctcactatgttgcagaggctggtcctgaactcctgagctcaagtgatctgcccatgtcggcctcccaaagcgctgggattataggctaattagggtttctatttcttttcttacaaaaggaaaacatttgactaggaagtctctcaagtcatttcttgctttaagtctatgattcagtggtcagcagtaatctcagagaagatgctatgtggaagggatagctggttgcagctgggtcaccgaaaatcaccacgaagttcatacccttagtaaaattattttacatattgatagctcacaactccctcaacctcacactctacatccactccccccatcaatttccatacatgcttttgggttatggagtatcagcaggcagtgacaaccaccacgaacaacaacaacaacaacaacacacacacacacacacacatacacacacacactctgaacttgaaaacgaaaacttcttgggattttcagggcatggtctcagctacccagcttcctgggaaataaagaaagtagcaagtgttaacacctcatttttacctatcaacagttacagaaaaacatgtaaattgttccttatacatcaatgtatgagtttttgacaatgctgggggataaagctattatttctgggttctgcttaagacacgctcctttgtcctccctaccactcagatatctatagttcatacagtaccaaaaacacctctttccacctagagggctcttaaaacctgcagttaagcaagagcaagccaaaacaagtctatagcatcacagatgggttatccaactcaatcacagacattcccctaatctccagcaaagaaacctgctgtctctctaatgcactaacatcatttccctagggcaaggtctgatttctctgagtatattattcatagaaatattatacattttgataaatgtaaatagaggataaactcagtcaaaaacaattcacaggttagaggaggtttaaaagagatgggagcgagaaatcactttttcctgtatttgttttcccaaggtttctcacccctctgcagaatgagattctaggtttagagacattaggaaaccagtaaccacgggacccgttgcctggaaacggcctgattacaacgaactcactaggctacaaggaaattctacctgatcctttaggaccatttgccaagcctcattatgatgataaagaaaatttatactttcataaagccttcaaaaattattgccatgaggttctgaaaaatctgagcatctgctttggggaagaaatgggaaattaacatgaccatctagtgtcaaaaactgacagcctagacaaaataaagaaaaattcgttcagcatcaggcgtagaattcagaaatcaaaaatccaaattcaatgctgaacaaataatgtttgggaattgtactgtctgccatgggggtgagaagccaaggcagccggaaaatcactaataaggggcatttgtattctgcagcagtagaacttcacttgtgcttccctgtacatctaagaagaactttcaatccaatgctgccattaacagctgctttgaaacatacgccatttggttttgttgcccttgacaggtgaacaagatttgtcagggaaataacattataataatattgcagaagtttaacaaattctaagaatgtctataaatgtttaagacaattagtaatcactctgagaaaacagagtctattttacactttagtgaaagaaatttttatagctaaatgactgtaggtatatatatttgtgtgtatatttgtacacgtacataattttatattttatatatatatatatgatagatgatagatagattttttcccctttcaagaacaacaggagttaccaaatgcatcagtgaattctggctccattaaaagttttcgttgttgttgttaatgatctacttacagttacattggactaaggtgcgtctcacagggagctcaaatgtgactttggacccatcttaatatggactttgccattaattaggtctatgattaatttttagatcatttatcataatttgctggagcataaaatgcaaatttcagtgaaatctaaccataattgcttacaattaaattttttatatctattgtaggaaataaattcagcatattcttttaaattttttattactatttttcaaacacttttttgaggcatgattcatgagtccattcttcatagataaatgctcaacattccagggccacagggattaatagagactggtagagagagagtaaagtaattagcttaaattttgccatagatgctatgggaagcaagccattttcactttaaagggactatttttccatacttcagatattcaatacatatccacagtactctcaaatatgattccagggtaaaatgtaaggcctctaagccctaggtttcaaggaatgtatcttaattacgtttgaaccctcagtacttatttcaggcctagcacacagtggatactcccaaatctctgctgaactgaaccaggccatagtatcatcagaggaagtgatattctactttagagctaactgagacagacagggaaataaaaaacggactgcagattgtactgaagagagtgcctggaaggatgatggtcatagattacatggagaaacaactaatgtcagaacaagaaatcttatgatcatcatttgacctctaccacccattccccatgccagtcactctatatattaccgtcaggattattctcccaaaacgcaaaatcataacactattcaactgcttgagaacttacaataaaaaaaaataaattattcattgcaattatctttgtcttcaagcaacttaacaatttggttgcctagatagaaataacacatgatactttttataaaataggaattgagagaaaagtcaggacagtgtgagctaaactgtcagtagaagctgcctaatgaaggagggactggaaccaggtctatttatttgaaagaataaatagtagaggaggaccattccaggacaggtaagaaacaagcaaaaacacagaggtgagaatttgaatagtacattagaatagatacaaagatacatttggagatgggttgcgggtaagaataccagttttggctggaatcttggaagtctgaggcattttccgtgaaggaagtatttaaaaggatgctacgagtttccaggaatattcatgaagtgctactggtgaaatagatagcatttgtgatgaacctagggacacactgattcattcatttggtaagtgtttttggaacacctgctatgtcctaaccactagagataaagcagtagacagaattcctgccctaataaaacttatcaggggtgagagtacacaaatgataacaaaacagataagttagtatataataaaaggtcaagtgccatagcaggtaagggtctaaagaatgggagaatgtattctaaaatattaaaactttaccgtctcccaaaatatctagtacagacatgggcatgcaatagaaataccaggtgactggagtactgcctgctgaatacaagtcctggggttatgggatacagattttctcctaataaaacctgaaacaatcaatcagaactctatgaggtctccgatgtgcttgcctaacacataaaaatgcctgggcgcaacccaacctcacctaaaatgggaggatatctgggataggctcctgcagcatacaaagttggatatattgcagggttttcgaaattctttccacattatctaggatgagctgctgataataaacaaaaagttttcattaaatatttgttagataatatgcctatgactgctaggtgctataaagattaaaataataaaagatggtcatggcattgcctttcttaaaaaaaaatcaaacataaaagtaaacttaaaagtcaggaaaagataagtacagtaatgacatcaaaatgagcttggttttacaaaaaaaaaattgtacaaaggagttcaggagctcctgtgatatatgaaacttgaaaaaaggaaggccacttatataaatgcttgtgttttcttgagtctttgagatatttaaattctatgggagcaagcattatgaatgtgattttcaaattacaacacctaatttgttctgacccatccttggtcactggttgaattttttatatctcaaatgccatcctcaaatatgggccaatgtccacacagaggtaactttccatgtaaaaaattggcaggaacaagtgagaaagggaggtgcttacactgccctttctgtaggacgtatttgcactgactgagttaatgtttatgggctgtagatattcattgagacatagtatggggtggctaaactcaatgccctacaaagagaaacaaaaggaggagcctcgtccatcatattgccaataaagagcagtaaaattacttgacaatataaagataatactttgctttcccactgtgcttggttcttgctaaaatgttattaatgaaaggaactattagatcccagtaacaagctgtcatacaactactttacctacctaatttcctttcccactcacccataatatttcctgtttctatacagcagtcatttggactctacaatatttcaatctgtctcatctccattattggtagcactactccccaatccacactcctgctctgtgcaaaactcctgtctcctcattaattctatttattcaactccttcaacctttgtccagagggtctcttttcagatcagacattctgttttgtttgttaatttatagcttttgacatttattattatcttccaatgagacacagaaagaatataagaagttaaatgttttcacaagcaaccctagattcctgtgtccctttgcgggggaggaaaatagaaagaaataaaagctgccagatagaaggcctgaaataaatgacctgcaccacccataggcaaattctacctctttgtaaagaatgtttcataggagggaatcaataagagctgaatatgaaacattggtgcagtgcactagctaagttcagtgaactcccaagctaatcctgtgttctcagaagctataagcgccaatctcttcacctttgctcagggggatgagctcaccacagaaactggcctgttttttgacctcaaaatccagttgggacagggttgggggatggcagaagcaatgaaagggaaggtttccaggccatttgttctaaactgaggtgtgctggcagaagcgaaggacaaggttgagtctccatggccctgagctgggtcacacagctggaatcacactttgctcaacacaaacgtctttcactttttcattcacccacaagcaacacaaggactgcaacagaacactgatgagaagaaacaggcccagcgccactggtcactgtcagtatctaggctacctagtaaagcaacccccacacgacccggatgctaaataaacgtttacatcagctcatgtttccctatgactagctgatcagtatatcgaattgaaatataataaacaccaaaaggaatgctggcaggaggctcagtattttcagtttttgtacaggttttttgaaaatcacatcacatttgttccctttaatgatactgttgtcttacagaaaaatactcattcacgtattaaaatttcatcaccatatctaaagcgacattcctttttaaaacaacaacaacaaaaactaaaccaaacttactaaaaagccccaaatgtctacactgaagcaactcaaatgaaatggtctaatcataaaattaaacacattacagatgagttgatttgagggcatttagtacatttgagtatactcgatatttcagtttctttaacctacattccctaaaagtaacactaaacagtggttctgtgtatatgacacagtaaaaatgcatatatttatttctgaggctgtatattagctgattgtgaatcacccttgaaagtatgttttataaaataatgttcatgcaaattctactaaatgtatggtatactttatacaaatattaaatatgaagggaactggtatataaataatcaattgactagactatgcatttaatatgtatttcatgacataatattagcttttataggaatcactacttgaaaaagcagaccattaaactgaatttgagtttcaatgactcaagttctagttccttttaaatgtgtctggacaatctggttgtatcacttgcttctcatccataaattttttcttaccatttatgaaatgcttgttatgataaaaattattataccacatatacatttctattcccatcccaatcaccaatcgaatttctaaactatatccctatgatctaaaataaaccaattaaacaataacaaacaaaactttatgcatctacttattcatactgattacatatattatttttcttgccttgtctttaccactagtatattaattcttaagcccaagaactttgcattcctactgctctactccatcctttgctttaagcacaaattagaaagaatgtaaaccaacactataatttgtctcatgatagctccaagatggtctgatttactgtgtggtaagaatatctcctatcctgcatttcaatctccatccaggccttcaaataatactgtctatcagttaatatacagcattcccagttgaatatgattctctaacagtagcagacagaattgttctctcggtatcctgtggggcctaagaggacagtcaaaatctcagcaacactgtattttccttgcttctgtgccattctaacaatttcttcccctgggaaagcctcatcttttccttagatttgtgtttctggactcactgatgaatttagattctattcaaatgtgctcgcactgctatgttctattatgatctggaaaataactattattgttagcaagcaaatgttagagtttttattccactaacacatgctttgagaatccctaagttcctgtttatgactttgcagataacaaacaaaactataaagagtgtaactacttattgggcctttaaagacacgagagataatttattagaggacacgctcagtgttctgtccaggtggttgctatcaattacaaacagaagtcttcccaaatattcacttaatgaataaattgaaaggaagatcaaaatgtttttcatccacagaaagacctttgccacagcattgatatgctggtacttttgtcttaacattttggtctcttataatctcttgtttaaaagtcaacttttttatgtaaatgtctctcagtttatccagggtgattcttttctgttggaatgagaagcattatctctaagcatgcatttatgtgttgtttaattgggtgtggtgtggttgttggctctgtgataagaaagcgtcacagtctccgacctctagatgcttaaaatctaagatgaagtaaatatcccaatatattactgtggacccaaagcataatgggccatttaaaatcattctatgaacaaatcgactgtcattttgacagtactgagaacaacatatatcccttcacatttcagcttgtgttggatcattaggcacaagtttgaacaattccagggaaaacttacaaacacattttgaaataaaatttggatgtaaaatatcaagacttaacagaaacattttacagaatgatttacttcacaaaattatgtggtccgtacttctttcaaataacatattttctgctggatttaagtaagcttaattgacatgttatcatttatatagaaaattaacatgtccctgatttgtcaggtacaacaagaatgtacaaaggaagggccacatatactgcaggaattttaagctattctcttatcttttatttcagagcattcataatttttaaatgttgcaataaccttttgaggcaatactggtgacttcttcatttgactaaaacatccttgcatatcaacaattgaacaattgaaacactttaacaaaatctaatgtgtatatatataatattatatgtattatatatgaaaagtatgcatgtcataccatacatatagtgagatatatatatatatatacacatacacacacacacacacacacacatacatacttatgccatcagagaacatttcatttagattagtatgaaaattcaaaaaggagttaagtctcatttttatggagctacacccacaaatcccccaggctacacttagttaaaactctgaaagaaattttattctgagattgagctcctgccacatcacactgtcaatatccaatattctgaagctacaagggccagtgcccaccgatcctagtcccatttaaggaaatgcaatgcaatctaatgccagttctcaaagcacgtaagtacatgctgaaatcaaagatttaagtgaccatttattttgtcttgtatctgcctgagaaaaccctttgccagccaattttctcctattagaattagctttcaaagttagaatgtcatttgcatgcttgcagacaaagctaacaatttcaaatcatgaaaatgtgtattctcagatggtgaatatttgcttttttaagtacagagagtagaaaccgagctagtcttactagattttatatattgcttaaattaacggccaaaaaaagcctccaaggggtaaattgcctttttgtaatattacctttaatttcttttagcaaatgggatatgaggtttaagtgggttgaagaaaatcaagtaaaatatttatggtatacaattttctatggtcatatgcctaaaagcaaacattttgtggttagtttactatgaatgtaccagggctagcaagggagtcttttgcaagacagttgatttttagaaacgcttacaggttgaaactacaagctcctaataacatttaacaatcagaattgctttggagaccagcctatgttggctaacgctggctacttaggctctgcaaagtttttgtaactattttggcaaccaagtaccataaaaccaagcattccattttacatccaatgtgtctgtgctggcattaagtaataccaggagagtattttaaaggttcaaggtcaaatacttgatattccattgagtaaaatataaaagaaaatactgcacatcatctaaatatcctaaaaggctaagttctaaccagtataagtccacaagggacagaaaagtagcatgatgaaataaaaaagaacactggactgagaattaggccttgggcaaatcaaatccattctgagtctagcttctccacttcttcaaagagggtaataatactggcttcactgacctctttggataaaagcctgcatgtagaaatgcttaaaaatgtagacaatttaatacaaatattagataatactatcatttccatttctcctgataatcatgcagcaggtctctgaacaagacctgtgtactgtgttattcataacataacttgagaagaggtggtagtttttacacacctcctcccccccttttttctttacacttgatcagcttcagagatacagtcagttactaaactcctcagacacttttagcagcatcagaagcagctgccacttgcaaacctgtcagattccacagggactaaggatgtaaaaacaatgagtcattacaggtgtgtctgcctttttcattaaaagacaaaatgaaaagaagatgaaattcacccaactcagtgtttttaaggcagaaagtaaagagatcaaccaggaaatactttattcctttaattcatatgacagacattcaaatataacatagtaattgtttttaaatagactgttactgtgctgggtgctcccccagactacgaaaaagagtgctatctaacttcaaggaacacactgttcgagaataacaatatggggcataatggtagcatacaattaattctaattccaggtagaaccttggtgagacaagaggtagtaagaaggccactggaatgaacaaaaggaaggtggcaggatccttaaaaggtttaatgaaagagacagagatgacatttgagataattttgaatgattcctgggatcctggtaggagaaatatcaatgaagacagaaactagaaagagggatatgttcaaaattgagaagtctaagttgtttcaagaatatcctgctacagtttccctgtctacccaaatgtgcatatgtttgtgcaagctgctgatgttcgtttgttacaaaggtgacatgaataacctaaatttataaaacatctttaaaactggcaaataatacagaatctctatggattacaaataaaacatttactatacatgtaatcatgttttagaaattaaaaataaattaaaatatgcaaaacaaagattacatataatcccaccacccagggctattttgatttatgccttgccaagactatgtctctgtacctatatacatctacattttttttcttcttcttttaattatactttaagttctgggatacatgtgcagaacatgcaggtgtgttacctaggcatacttgtgccacagtggtttgctgcacccattaccctgtcatctatattaggtatttctcctaatggtatccctcccctagcacccctcaccctgacaggttctagtgtgtgatgttcccctccctgtgtccatgtgttctcactgtgcaactcccacttatgagaacatgaagtgtctggttttctgttcatgtgttagtttgctgagaatgatggtttttcagtttaatccatgtccctgcaaaatacatgaactcatcttttttatggctgcatagtattccatggtatatatgtgccacattttctttatccagtctaccactgatgggcatttgggttggttacaagtctttgccattgtgaacagtgcagcaataaaaatatgtgtggcagggcgtggtggctcacgcctgtaatcctagcactttgggaggccaaggcgggtggatcaccaggtcaggagaccgagaccatcctggttaacatggtgaaaccccatctctactaaaaatacaaaaaattagctgggcgtggtggcgggtgcctgtagtcccagctacttgggaggctgaggcaggagaatggcgtgaacctgggaggtggagcttgcagtgagctgagatcgcgccactgcactccagcctgggtgacagagccggactccgtcgcaaaaataaaataaaataaaataaaacaaaacaaaataaaataaaataaaataaaataaacatgtgtgcatatgtctttacagtagaatgatttataaacccttgggtatatacccagtaatgggattgctggatcaaatggtatttctgattctagatccctgaggaaccaccacactgtcttccacaatgtttaaaataatttacactcccaccaacagtgtaaaagtgttcctatttctccacatcctctccagcatctgttgtttcctgactttttaatgatctccattctaactggcgtgagatggtatctcattgtggttttgatttgtatttctctaatgaccagcgatgattagctttttttcatatgtttgttggccatataaatgtcttcttttgataagtgtccgtttatatcctacacccacttttcttgtaaatttgtttaagttccttgtagattctaggtattagccctttgtcagatggatagacggcaaaaattttctcctttctatacagattgctttgtaatgtggttttttcacttactagtatgtttgaataacttttcatgacattaaatatacaaaatacaacataaaatttacaatataattttaatggttccctgatgtactattgtatatgttgcccatcagtttattttatgagtctatattatttcttatccagtttacctttattttcttgtataaacaataatggcatggtcatccttttaaattaatcattatttcagctctgaatatttatttaattctaggattccagttactgggctcttctaaactgtcttccaaagagttatactgattttcattcttcactaatgggttagccttggtctactcatgttctttttaatgttgaatatttaagttctaatttttcttactactaatatttgaaaatatttttctttgaatattaattatgttgaacatttaaaaatttgtttattaaccacttttttatatgatatgaaatgactaatctccattaaaatgttacaagtctgttttgtgtgttttgttcatctttgcttttccggtaaccatcctctgggtatctttctcttaattaattgtaacctcctatgcatactacactaggacacattcttaggtttaggtgtttatccacacttagtgccatagactataaagggtctgagattttatactacttaaaaggtaacaagttaacctgctgcagttttatgaatgctagcacaaaattccagaatcctaggccagagatgaagttcattacttgtagcaaaagcagcagccagagtatcagcaattttttgtgctggttccataaacctcattttcctcaaggaaatgcaaagacagccatttggtaactgcacttacactgggttgtgttataagagaactctgagctcagagaacccaaatattttataatgggcagtaaatctgactgccctttgcttcagagagaaacattatatttattatactgaagaatatatgcatggagggaaaccctatatctgtgttccaaggccattcaggatacaaacattccttgaaatgaaagtctggggaaaaaaaaaaaaggacgtcaatgtcttgccaggcaaacatgcagaaatgcaaatgacacataggaaattatctccaagcgcttagccctgaacatgtagaagagaataaaagattttgtgaaggaaggaaggagagtgattcaaaggcattcagcactcaaacttggttccaaacttagccttacctgtgaaacctcacgacaacagtaacacaccagccaaataaaaacgtagcttctggtcaagctgatttctaaaaaccagactttctaaagaggttatataaatagtgacttttcactttataaagcaattctctacagaatctttaaatatcaagttattctggtatgattggaaagtaaattcatctaaaaatatttatgcctttttattcagcatattagttaatagagtatgctcaggatgaaactgcctcaattcggatctggctctgtgtgctggttgagttattcagcatgcttcagttccctctgctgtaaactggggatactgatggctattaactccatcctcacagaactagtaaaaggtgcttttgtcactgcatgatacataggaaacattcaacaaatgttagttgttattaattgtattactatcaccgaaaaataagtcattcagttgatatattttcttctgctcttttcctctatgtttacaattaactacaaaatgttttcttttcttgaatgacagggtagatgctaaacaaaagatttaccaaaatctaactctaataataaatgggttaaggtttcactcaaattataggttatttccaaaattaggagaagggaaaatatttttttaaaaaaaggatgatacactttgggaggccgaggaaggcggatcacttgaggtcaggagtttgagaccatcctggccaacctggtgaaatcccatctctactaaaaatacaaaaaattagccaggtgtggtggctcatgcttgtagtcccagctactcgggaggctgaggcaggagaatcacttgaacctgggaaaaggggttgcagtgagccgagatcatgccactgcactccagcctgggtgacacaacgagactctgtctcaaacaaacaaacaaacaaacagcaaaagaaaaggatgatgaattcctaaagctggattgtagcacctgcgataacttctttatttctatacttttgtatagtgtgctaacaaagaacccaaaaataagaaaaaagaaaaaagttgtataacatttaaaggtctgtaacatactattcacttaacacaaacaacctatgaagctcagggatagagtattcaaatatttgtggggggcagcagagggctgcatggcattcctctccagaatgtaatcattatttctgggttatggctggttctaaacctaacagtagtgactcatccttttccagagattctgaagtagatggaaaatgcatacttgaagaaaaggtggtgaacaaagagagagaaagactaataaatggtggctctattgcaaaggcaaagctgttgaacaaagtgggggaaatgagagaactctgtgcaaactaactcatagcattttttaaagcttcattatgtttctgagacttgcgctctgataatgtgtaaagaaccattttttcccctttcaccaccgccccattctgttatctgttacgtctatttcatatttgagacagatgaattttggaaaagttatgtaatttggtcaagatcatgcatgtagtaaacaatacatttaggattgaattctagtttaaaaaatcagtttttgtgttattttcactgtagtaatatagcatcagctgaacttgaattccagccaagtgcttgttctcctaaagcctacatcgcaatctactgaaataattcttggccaacccaagcatcaaataaagaataacctcaccttctggtgctcagccagcatggggattctgttaaattgtgggtgtagctgatattcttggttacctggggatccttctgctaattttggaacatatttggcttttcttaagctctcggtctgtgactttttaaactattcagctgtatcctggctatgtccatgtcctcagagaataaaacaaaatcatagatcagggtattctttttattttgtcctggacactctcattccccagataaatcacaggcacagtcataaatctatggaaaagaacagtacaatttccactggaaaggcattctctatcttttccacattgtatccactattcacagtgaattgctactaagaacatttttctctctagtactctagctacataaaacacttggtaatatacatactagtttattgttcttcacaggcaaacatagtgctacttttccaagtgtgggaataactcattctgaaccactggtcccccaaaggcatatccatatcccttaccttggctttgacaggaattataggagtaatgtaactattatttggtaagaaagctgatagtaaaccgtgtcttctccttattcctgaccctgcgcttatactttgcctagcctcatatttaaagaataccttccacttttctcaaagctacaagtaacaaatattcaacacttcacagagtcaggtccagcaatcttctgctgaggtctaaaaccttgcaaaattctggaaaatggtatccaggtaatattgtggttttgttagttaaaagtatatctgagtatatgtgtgaatgtgtatgggtgggtatgtatgtgtgagacagattggaagtttcttcaataaatatattactttgagtaatatcaggaattgtgctaggcactagggttataaaatatatcataaatgaatcgagtccttaaggaactttgcttgttacacttttatcaaagggtcagatggagaaaaaatgcttttactatgccatcctgagtactcggatataaatgtgcacagggtcctgtgggagcagagagaagggtgatttggtttccagggacaagttgtcttgaaggagatggcagtagaagcaatgaatgcataggagtgaccctggagaagaagaatgtggaggatgttgcaggtagaggaaaagaaaagcatgaaaaaacatggtgagtatgaaaaaacatgaaaattcattattattaattaaagtttgggaagggagtggtagagttaaggctcgacagatattatgatgaagacattatgtaagaccatatggacataatcggaagcttaaaatttaacctgtaggtaatgaggaatcatcaaaaggctttatggctaagtgtggcaaaacagtttgccattgaggcaagctggtcaaggatgaaatggggttaagatcctaggcagggaacaaattagggagctaatgaaagagacagtttccagaagatatgatgaggacctggacaagggtgatggtaatagtgaggacaggaagatccatagtgggggcactgtatacacaatgagatcctctctccaggggcgtctgaaagggatatccatgtgagggttatagatacgaattggaataaactgtatcctccccaaaactcacttattgaagccctaactcccaatgtgactgtttttggagactgggactttaaagttgtaattagagttaaatgaggttataattatgacaccctaatcccacagaatgtgcctttccaagaagaggaagagacactggagctttctctctctgaggacatacagagaaaagaccatgtgaggacacagtgagaaggtggacatcagtaagccaggaaaagcggcctagccagaaactgaccatgctggtacctcgatcgtggattccaccctctagaactctgagaaaatacactttttttttttttttttttttttgagacggagtctcattctgtcgcccccgctggagtgcagtggcacaatctcagctcactgcaagctccgtctcccaagttcacgccattctcctgcctcagcctcccgagtagctgggactacaggcacctgccaccacgcctgggtaattttttgtattttcagtagagacggggtttcaccctgttagccagaatggtcttgattccctgacctcatggtccgcccgccttggcctcccaaagtgctgggattacaggcatgagccaccgtgcccagccccacacttctgtattttaagccactcagttggtgatactttgttatggcagacccggctgactaatacagagggttttgttgatagaagtaaaccctaaaaaacacataaagagaagcaaaagcactgagagaaagtctgaagaagcagaaagccaggagcagacaggtgagtagagcaggagcttctgcttggtagttttgcaggatgaagcagaagtcacgtgggttccctgtagaagggagttctaaagcatgtaatgatggatttctgtttctgaggaggctattctagagttgtgattggatcagccaaactgttgtccaactactattatatcctgaatctattttcattcctgaagtctgtgtggtagccaagtttgtttcttgtttgccttgcttgccaatgtggtataacagccacgcccccaccctcctctggcatcaactggaataggccttttcacttgcactctaaaactgccaaacatcaagagtgggaggaagagatgtcaggatgagcagaatgcaaataatgactgcagactccagaaatcttgggatgagatgttaactatccaagattttatttaaaaaatatgaactgtaatacatatataaaatatgaatattttagccatccacattataataccagaaaacctcttgtgcacataatgagggccatctatgtacgacaggaagtgtggcatgatgccgtctctaaatgaagaggggctctttttaaaaaggcaccaaaaaatctgtttttattcctctttatagcaaattggcttagtttaaatgccagtctataaaaggcttcatccacactctcagtacctaccagttgtgaagaaaagaatgaaggaaaccactgcgtgcactttttttctcagcacctgccaacacagggcttgggttttcggacggaatttcataaatggaacaaatgaagactaatgatcctttctttatctctaagccattatagcgccatcaagtggaagacaagattataggatttagacagtccttgcagaggaactggtaagtagattattcttctacctgcttaaggatagtttcaattttgatccgagacacatctgtgtgtgtctgtgtgtgacacagagagaaaccgtgtggcagttcctcccttttgtcttctacattaatgcattccacctgtgcttttaacatccagatgctatcatattttaattatactgattaatgcccgcataagaattacaaatggtaaaccaaccttccctcaaattagcttagtcaatctgtttaaaggcagcacagtgaaatagaacaccaagctaataacatataaaaaaatggaaaattcttcatttgtttctgtttgagttcttttaattaaaggtgacaaaacagccctttactatcagtgcagcaaatgcaatatgcaaagatgaatgcatttacagctgtagcttgcattgctgttttagcattactaacactgttgggaaaacatctgtgaaaaataagatgacagggaattctcatgataaaactggaaagagatgtcaaaagaaatattgccatctccatctttggagagcttcgtgaagaggatcattgtgtgctctagttgctctgaccggagattccaactctaccctgaaatatcttacagcatctttaaatatctctctgatgggtctctggcaaaacaaaacaaaacaagaaaacaggcagggcgctgtggctcatgcctgtaatcccaacactttgggaggccgaggtgagtggatcacctgatgtcaggagttcgagaccagccttgactatgtggtgaaacccccatctctactaaaaatacaataaattagccaagcatgttggcgggcgcctgtaatcccagctattcgggatggtgggacaggagaatcgcttgaacccaggaggtagaggttgcagtgagccgagatcacaccattgaagcctgggcaacaagaccgaaactccatctaaaaaaagacaaaaaacaaaacaaaacaacaacaacaacaacaacaacaaaaacaagaaaacagaaaatcctttaacctaagttaccaagtaatttaaggtgaaataattttctccttggccacttcttgaagaaaagaaatatgaaacatgtattaaaaaaaaaaaaaaatcagggctttataacaaccctgaaaagaccaggaaccatgagttagttgtttttcctgagtaaggacattgtgcagccgagaggtaaggactgcttttggcactggtgacctgccctgaggctttttcagtccatgattgccaattcttccatctaaaaatggagatctcaccacttctcagcatgtcataaggattaaatggcataatataaatgaaagcatcttgaaaatttttgtatattgacctattgtgagtctgcagagataaatatcccaaaatatttttgtgctccaaaatatgagaaggtaaatacggctttacaattccagttttctatcttgcctgctttattatcttcccctcgccaccttttttttttttgagacttgctctgtcgcccaggctggagtgtagtggcgcgatcttggctcactgtgagctccgcctcctgggttcacgccattctcctgcttctgcctcctgagcagctgggactacaggcacccgccaccatgcctggttaattttttttgtatttttagtagagatggggtttcaccatgttagccaagatggtctcaatctcctgacctcgtgatccgccgcctcggcctcctaaagtgctgggattacaggcatgagccaccgcgcccggcctccccactggttttaagcactttaccaagagctttctgttgagactgcatcaatgtcatgtaacaattccacacaaaacttgtttccatgagtctgacgcttctggacaaggacaaggtcatcagttttgggtgataacttctgtaatatcataagactattgtttctaaggtacctactagtggcaaatgtgtgcatgtgcgtgtgagagagagagacagagagagagagagagaaagagagagacagaaaccctttcgagaaggcctccttaaatcagggataaggttatttctgagaataagataaaaacctaaagataccagtgatggcaagcttaactgtgtgcctaatatgcaccagaactaaaccttagaaaacaaaactgaataaagcatatccctacctataaggagattacaatgtcaaagggtaaaatggataattaaacacagtaattatcacataagcactatgataagggtaaccgaggcattgagtgatcatggaaggtttctcaataaaggtgctacctcgtgtaactccttgatggatgacagggagatggaaaaacatgaggagtaggacagtaagaatgcaaggagcaggaaatggattgggggagaaaagggagaccaggaaaagggatggctaatgtaaggcccgtaggtccaaacaaaccaaaacaaaggcatattaaggaatttcatatattccagaatggccaaggattttaagtgtaattttacattgtgtatacattttcatatttctactatatgcatatagacagctacatctttatatacctactgcttggacccaaaacctgattcatggctgtcagttcttccacatataggcaacaagaaaagggcaaatacaacatgcctgcaatgctcaaacggcttccttctgttaaatgcaatcatgaaatgatacggcttaacataaactcattgaagcttcatctttcaagcacaatgtaaagattctagctctattcaatctcagctacagggcaatcacaactgtaactaactcctacgtctttcatcttttgacaatgaaattaaaatattgcttcatgctatagtaggaaagaacactctaaaataaataatcccaaagttgaaataaaactgaaaataacagcagtgtctttctgagacagtggggcagcaatgttaatgaacggaagctttgctacaaactgaacaaacacgcattgattttgaaggtatacggaaagacgactcagataagctatagacatcagaaatttaagaatcaaagccaaaatgagacaatttagacaaggggcataactatttttttttaaaggtgggggatatgcagagaaagtaaagatgaaagttagcattcacttgagatactcaattacagaaaagtcatggaaatcaaacatgcaagatgtttaatgcacagagtgagatgaagaaggatcatttttaaaccttaaattctccctgctcttagtttggataaagaggaattcctcaagtcctacgttttcaaaattatgtctcttaaagaattagtagctttgcaaatcaaagcaggattggctcttatcatctcagtttatctctgtcagtgctcctggtggtggtgacatgctggcctctcatatttctgtaagcctggccctttggattttcccacagtatcagcctaaaaggccaaggagttgtaaacctgcttttaactctccttattccctcccaccacacacacacacacacacacacacacaaacagggtctacctgtcccatggcttccgaattatgaaatgtgccccattcagttcttgcaactcttcccacttatccactctgttcatcctctctggggaatccaatcttgacccaaagagaccaagtaatctttaaaatcagaaactgctttaataactcattagagatagatgaccatctcttatatcacttgagtctttcctttcctcaggcatttctagattttgggtcaccaaaacaacccaacagccatccactcactcctctctacataaacataaataaaatcaaaaccaaaaataaaagcagccaggtgtggtggcaggtacctgtaaccccagctactcaggaggctgaggcaggagaattgcttgaacctgggagagagaggttgcagagatattatttctagagattactatattatcctctgagaaaacacacctgcttgtcctttggaagcaaaaccatagtgtaaaatgcaggttgagtattccttatctgaaattcttgggataagaagtgtttcaaatttttggtttttttggatttcagaatatttgcctatacataatgttcacatgggaaatctgggcatgagcagaaaagatatatcacaaatgaggatgactgggagggttttcttccccctaaagaatgctgaataaactgtgtattgtgtgcttgtattttgaccgcaactcatcacattaggtcaagtgtgggattttccacttttggcatcaagtgggtgctcaaatctttggattttggagcacttcagatttcagattttcagattagggatgctcaacctgtactagtagctgatttttaaggtttcctttgttggtaatttttatggaaagaagaaaatctcaacagatgaaataaacagcaactaaaagtggatttatgttgtttttttttttcagcaataagtaaatgcaatcaaaatgttttttttttttaaaaaaaaagactgtcaaaagtaacacatgtaactaagagtgaaatctttggagagttagactttatagctccaagtgaatgtaaatgctttactaacagtggaattggaaattggataagttcccttgagatagaaatagtcaaaatgctacaggagattccaaactgcttgctacaaaaaaaaaaaaaaaaaaatccttagctttgactataagtagatctctagttcttctccatacaggagatatgtggtcttccatcccagggagaataatggttaggtttctcaactctcataacagaatgtcaacatcaccatctgctcatctggctttcaaaggatgcatatgggctcatcttctcgcccagaatctcctcttgctttggggcttttcccttcagtttggtctttagtatgtactcctaagtttgccaaatgcacactggagatcacagaagactttgctgaagaacagcccagtaatgagttgaattcttatctattcagaggtttccgtgaaaaaattcctctgcagcgtattcaaattgtatagccgcaattatactccctggctgtggtaatttaaacgttattttaaaattaaggcctttgttaataaatactgtttgcttaaaggttaaaaggtagaattatacccttcacaccaaattgcagtctccatgggtccttatctgcttgtattaattcaaagagaagattctgggtgtcatctgccacttagagcctgaagtaaacctctaaaagcatacatttctgttgttgtttccattctacatgggcttaaagtatgctttagaaacatacatcacaactgagatgtgcgtgggcattatgaatagttaagcaggagtgcagaaagcaatatggacagaagaaacaaaataatttcctaacatataaataaattcaaaacctacttgaaatgtagtatatcggaagaacattagtcagggtctctataactaattagctttgcgactttgggtaagacataatctctctggatatttatgtaaagctagaattatgtacgagaaaactacagtttagaaggaaagaaagtaattacaaagtaaagacattgaacataaatcttgaattttaccattaattgaataatggaaagaaaatacagactatattattaacttttatttgtctattttctctataaaattttcaatccatgatttagagatcatgtccatcttgatcaccactttatctctggtgtctagtacagtgcagactgaccatttaatatattttgaaggaaagaccaaatgagttttaaacatattatctaatactataatactcttatggtctcattcttcagttatttgctaatataatagatgcatttgtatcctctgtaatataaaaataggaagggatggtattggttgtagttgaatatttaatgggagaaagttaagcctcaaataagaaatttcctgaaatattaccaatgagaaaatgggtataaaaccttccattttaccaaaaacagaactttttttttatcacaagagaagggtaaacggttaattaaaagcaaattagatgaaataagatgatacaaagaaggtatcccatttaatgaacatgttagatactttagagaatttatttaaatttctgaacaactctaaaaaataaatccaatattagttttaaataagaataaattaaaacatagaaaagttaagtgacttatccaaagtaacataagctgtaagcagaagaattgagatttgagcactgatattactggttctaatgtcagttctttttacagtatccatttcacattaattgatagtctaccaactaccagatgtttcactgagcactctttaggaaggaagggaaattaaatattggcattagttaacgagagacatttctttccaccgagtgtaagtaataggatgaagatacattttgagatgatatgatttatccagaagaaaaagcaaagtttgttagaggtctccaatctatgataaaagcattgtgtaaaatacaagaaaagtaaatttcttaagagtaatgttagatgaaagcccatcatagttaatggtataagtaaaactgcattaattgtcaatggtatgaaaatgttcagataaatcatgccaggataaaacagagggcttataaacaagtcttccagttgggtggtcatcaaaaatgtatgaatatccactgagttaaaactacttactctttggctttgccatcttcatgtttagtgaagggaagcagggcgatttttggtgtaacgttccgcttaaccttcactaaagggttaatcaagaaccattactctaaaaactcaaaacaattctgcaagcctttataatgcctagtttatcccttaattttattatcatgggaattaacagaaaatcctcccaatacaaaataaagtgtgttctttcaaagatatacagaaagaggcagctgaagagatgtttcttcctcacattagccttgggcagggtaaacagaagataaaaatccaaagggacatactgagtaagaatagccattgaatgataggaagaaaacctaaattccttggtcttgtggacaaaatagaaacaggaatgcaaaaagagcctggaacccccagaggaccctcagcatgagcagcagaattatccacaatgattctcatgcatttgtactttttttaatcagcaaaatttagcagcttatatttcaatgagagacagcaatgttttcactggggggcaattctgaaccacaggggacatttgacaatgtttgtagacatttttgtttgttacaagtggagtggtggttgctttgggtatctattaaaaataggtagaagcagggaagccgttaaacaccctaaaattcacaggacattccaccacagcaaagaattaactagcccagaatgccaatagttctgaggctgtgaaaccttggagtagaaggagaatcagcatcaaaccctttttcataggcatttttcaggtttctttgttacatccgactgaaacaggcttgactagcaaatttcaagagtgaccttgtttcaaggtgcatcatttgtcggcatcaaattcacatcctctttcttatttaaaatctaccattagttatttctccctcaaaaggcttctacaatttaacagtgaggacatgttatggctgtgaaatagatgtccctatcatactgctttagatgggaaaagaaacattctgcagtgtttataagtcataaagaattctaaatatctcccactcaacacattcaggcaaaatgatggtataatttctgtgctgggtagcactctttcataccattatgtgtcgtgtgaaccaactgtaggtaatgcactatcttcctttaatcaaatctgcattgtaatttctataaaaaaaatcaattaaacacaaggagcaattacttattttttatcacagcataatttactttcccagaacagcagcatgaaaatgtgaagaaagatctcatctacctcagtgtatttaaagtatgcatatttttaaataaatgcgaatggaacactgtcaaataagcaatatattatctctatataattccccatttacatcaactttatggatgggtaatatggcttaatagcaaaagcttaagatatctttttgaaacacaattttttcatagtcaatattatggctgaaaacatttttcagactcttacagtgaaaatataattagacaacaatttgctcatcaacctcatcaaatcactttcataaatgacctacttaggtgtcaaataaacctaaaagaactatattttttccaagccttacaaatccatccttgtttacatttccctacctatctctgtgcattactatcaaggaattttgttaactacatgcttagtagttagtaggagatcatggagctaatctagcatccttacatctgggacctgtagtcttttcagtgaaatctattttacactgagcatcaggagttttttaactttatgtagataagatttacctggagggtttggtaagtaggtttggagagcccccacatttacattttaacaaggtctcatgtgatgctgacgcttgacccataggtctggaaactacccaagaatttaaaagacccaattttcttcatgattcagtaatctgtatgtgctcttaaccactgtgtcagcggcatcagtttattttttctcccttacttttatgttatcaacctctgtgctcatcagttaaactaaaagatcaatccactccaacctggaagattgcattttctttccttcttttcttgcctcttcctgctcctccctttcctttctttctcctcctctttcttctctccctctttctctctctttcacccccttcctcactccccaattccctccctcccatataattctgtaactctgatctctttcaaatccagatgtaaatctcactttggctgtgaaatcatctctgatttaccccagttgatacacaattctcctccatgtggaactgctcagtacttatgaactcacttttattagacttgtttgtactccttgcttcattaattagtaaattaaagcctttgtgtatccctatggtgcatggtcttaattatattattatactatttgttacatgcattttttttttcctttttataacaatgcctgctggaatgattggctcacaatcagtgcataataaatattattagcccaataatgtactgagtcaggggctgcaaagcagtatttcatcacgcaatgacccaaggttcacaagaaatctaattagtgcttcaactaaagccaccagtcaagtctgggggaaactggctccaaatcacaatgctgctttagtttcctcagtagctgctgatattatcctattaatgggggaactttatggaagaattattaaataggcttggtctggttgctaggctgtctgcgtgactataacagggattctcagaagccatgttaagcatgttcaaatactcctaaaatggctgctggtgatagagaaagtagaattctccaaagttaatttttatacttctttaaaagcctggtttgctctaaaggaactcataaatgagacatattttaaccacttcatcatatttgttggatcactctgttctgaacataagcaattttggaatgaaggccttctggccacacgggtaatatatgtgttgcaaaaagtgggacaccatgagaggtatggaatgaatgaacccgctctctctctctccttctctctacttcaccactcccaccccaacggccccatctaagatctggatgactaatggaaggttaattctctgaggcctaaaggaaaatttcacactttctcagtagttcaaaagtttggctttcccctaagtgataacatacaaatggagtaacagcagaactctcaacattaaggagtttctgtgaaggtgccaaggcatttatttaaaagttgctaatcagatttcaaggcccaaagtcccggctccctcacattagtgatcagatttgttaactttaatttttcataacaatcccataaatttatgtgtttatgagttttttagtattttagtccatttgggctgctacagcaaaacaccttcagttggataatttataaacaagagaaatttattgttctcagttttggaaactaggaaatccaagatcaaggcaccagcaaagtttggggtctggtaagagtccagtctctccttcaaagatggtgccttgttgctgcattcccagaagggaggacactgtgtcctcacatggcagaagggcaagacagctcccttcttttataagagcacgaatcctattttataagtgcagagccctcatgacttaataactttccgaaagtccccatctcttaatactatcacattaggtattaggttccagtatatgaattttggaacaatattcagatcatagcaattagtttatttttaaatttttttcctgattggttcataattagatttattgttatatggaagctgaggctacagacttttttcctctgtatcatagacaagatattagaaatgcagcaacggcatttgcaaccaatatccaggtgtagacagtagttctcaatcactggagatattgctccccaggagacatttgaaaatgtcttatgacacacttgattgtcacaaagatggaggggaggaggaactctacagcatctagtgagtacaggccaagcatgatctcaaacattttaaaaacacagaacagcattcccaaacaaaaaatcatccagcccaaaacgtaaatcatgccaatactgaaaaacacggagctagatcatgggtagactttggagacaggttaatgtagactcttctacatattatctatgcaaactcgggaacactaattaaccctaacacctcaatatcctatccataaccagggtttagaaattattccagcgcaatctctggaaaggaccgaatgatgtaatttatgcaaggtacctatttcaatgtcagatacagagcaagcactcaataaatggtagccctggcatatcacaggcactccataaatgttagcttcccattagttcaaatatattttgaccagaagcttctcctagagaaactgtcattctaagacaaactaacttcagtgaaaatgtccagaagttcccagtgtaagctaaaagaacagttgtcttgtacacaaatatttaggtgatcaggcttctctgctcacataactcaactatttaaatatatatttgatatttgttatttgaggcgggctggtagaaattgtatgctaaaagtagatatttcctatgattctgtagaatatttaccaggagaaggaaagagaatgcttaattattaggaataatcatccaataaactgttcacttgaaagaaaggaataaggagaatatgggggaaattctagttatatataatcacttaggaaactccaatagcagtaaaagcattggttaatatagttgttatgatctcgaaaatgcagaccctcaaaatcccaaatcaatattttcctcaatagtcaaaaagcagaatttgtttaaaaattattttgtataattagaaaaagcttctacctttcttaaccagaaattgctttttaagtctgctttttcaagtattagagtactcataaatatttcagaaaagccattcagtttcagcaccacatgaaaaaggaatgataactttatatgtgtatctctgattcaggacacattttctgaaccacccatcatattccatggacccttaaaattctctggttcagcaagttaacactgcccacttcaccttaacaaagaaaataagaaagctttaggaggcaaatttaaagaaggagaacattctccctgcaatataaagaccatggaggctatacgctgattgatatttctgtacaaatgggtaaagaaatatcagaaatgggtacagaaatatcagctactctactaaagtcaatgccgtgtctcaaatgctgcaaaattacagcagtctgtatcaattctcttttgagcaatagtttacaaagccattcaaaaactgtttaaatttttattaaattcaaattttaacctttaatatcagcagattagaagatcttgctaaaaaataatttgagaagcattttctacataggcacttgagttattggcagcaattgctgaaaagttagcatttttatttctctgttgttataatgtgtctaaatattaggttggtgcaaaagtaattgcagtttttaccattgaaagtaatgacaaaaaattcaactacttttgcaccagcctaataatttggtataagctgtctatctatatgtgtatctaccatctatctcagtatcctctttcttgttggacatgaaaaaaataatataagctaaatttcctctgttcatttatatatgccgtgggatgatactgcattggtaaatgaattcatcggtcaatggatgagttatttgtgtactttgttccatgaagacatattaagtttcacctaaatctttcactatgtttggattccagtacaaagtagtttttgagatttgagaaaggacaacaatttaattcctatacagatggtgaaattgaaaggcagaagaaacacctgcattttggagagatggagatgagccacaaagtagagagtcagagtgtgtgagaactgtccaataaagccacccaaaatctgaggtgggctgggggatgtgttcagcacatagtacagacaatcccctaattacagttgttcagcttaggattctgcgaccttatgatggtaagaaagtgatacatattcactagaaaccgtacgtcgagtacccacataaccattctgtttctcactttcagtacagtattcaataaattacatgagacagtcaacactttattattataaaataggctttgtattagatgaatttgctcaactgtagcctaatgtgcgtgctctgatcatgtttagtctaggccaagctatgatgttcagtaagttaggtgtattaaatgcatttttcactgggctgtaactccatggtaagtcaagaagcatctgtatttgtttagaaaatacttggattcaatttccaactctaatcttgtgacactttaagacatcctcaattacaaacacacatacacacacacacacgagagagacagagacagagaaacacacatgataatttttttaaaaattaaatgtacttaaatttaaaagatgctgtgcacataatttgtggaaataaatgagagaaatggtttcacaaaacaaatgttgaagaactgtagttatgcaaaaagccaaaagtcagtatttcgtgacatactctttggcctctaagcaggaataacgcactgttttaatcttgtcattttatccattttattttgacccattgcttatactgagttcaaaggtattttgactttataatttttctattttcaatttcattgctgatttgtcaggaaatctctgaggagcccagttttctcctttaactaatagagataagaggatcactcttcccgtctcaaatcatcctctattcacaccaggttaagcctcactatctatatttacattgcactttgcatttttttctatggtacgtttcataatttgaaaacattatttttgtactaatttatctatgagcgattataggacatgttgtaggaaccatgggtgttttgctaacagatgtaggccaagtcaatgagttgctactgcctaactcagtgtagtcacctatggaatagctataaaatgaataaattaataatgaattttttttttaagacaaagtttcactcttgttgcccagaatggagcacaatggcgcgatctcggctcactgcaacctccacctcccgggttcaggcaattctcctgcctcagcctcctgagtagttggaattacaggcatgcaccaccacgcctagctaatttttgcatttttagtagagacggggtttcaccatgttggtcagcctgttctcgaactcctgactttaggtgatccatccgccccagcctcacaaagtgctgggattacaggcgtgagccagcatgcctggccaataatgggattttaatagcacttgttacaaaaatcttcatttttaatgacatttggaactattttttaattcttaaattgtctaacattttatagtaaactttattttacgtcactttctaatgtacgcaagcataacttcagaatttactgagattttttgaatgacttctattaaactaatttaattgcataattttctacgtagcaaagttatttttttccaatttttaaatttctctgattctttaaaattagcattatcaattattttttatgcaagtttataagaagcaactgattcactaatcaggcttatttatgtcaaagtttctaattatttccaatatagtgaggtttttagcttaatttttattagcatttctacaaaactcaatttttctgagtcaaatcactcagattctatttttttgttcaggataaaaatgtacctatgacaagtagtattgggttttataaaaccataatttatatctgatgattatgtcaatctgcaatatgtattgtgaatcactttatttcttggagaaaggaacagggtaaaagtttcagactctgtgaatatctcttagagaaaaaaatatcatagttacataatgatgcaggatctgtggatataataaggtctaaatggcaggactaaatgcgaggactaaagcattctatgcttccacattatacctatgacacaagctttgatatttaaaaataaacaaaaacaaacccagatactcccaaaatatgcacaaaaaacttcagcttttataagaaaaaaagcaaatatcagtttatataataggtttcctaaatgttttgtgagaatctagtttttgtataatatttatatttgtattttcattatttcaaggctgggtttgatgtattggaagcaagggcacagatttggtaaagcagtgaatgcttccaaagacaaaaatttatttctgatataacttttgaagcaatgtgaattttcttctatcaagtttccttaaatcgaaatcaaactataacaatatcttggtttctatgggttctctgtcatgtgcatcctcaagtatatgtgaccaaaggtttttaagccataatatcactattatatcatcacctacctaccataagaatgctaaaaattgtcctctttgagattttgatagtttaatatttctgtgtggaaaaaaaatcaaacccaacaaaagaaaataatatatgataaagaattacaaggccttctatcccaccacttgttataggtttaatggtgtggccctcaaaaggatacactgatgtcctaaccctcagtgcctcagaatgtgaacttatttgaaaatagggtcttggctgggtgcagtggctcatgcatgcaatcccagcactttgggaggccgaggcagggggatcacctgaggtcaggagtttaagatcagcctagcaaatacggtgaaaccacgtctcaactaaaaatacaaaaattagtggagcatggtggtgggtgcctgtaatcccagctacttgggaggctgaggcaggagaatcacttgcaccctggaggcagaggttgcagtgagctgagatcgcaccattgtactccagcctgggcaacaagagtgaatctctgagaaagagaaatggaaggaaggaaggaaggaaggaaggaaggaaggaaggaaggaaggaaggaaggaaggaaggaaggaaggagagagacagagagaaagagagagagaaaagaaggaaagaaagaggaaagaaaagaaagaagggagggaggagggagggaaggaaggaaagaaaatagaaaatagggtctttttagaggtaaaatcaagttaaaatgaggtcattcatgtgggccctaatccaatatgattttttgctctgactaaaagaagaaattgggacaaagagatagacacacacagagggaggaggatgtgaaaatacgcagagaaaccatgtgaagacagagaactggagaaatgcatctgtaagtcaagaaatgcggaagactgcctgcacaccaccagatactaggaagacacaaggaacgatttctctgcagatttcagaagcagagtgaccctgccaacatcttgatttcagatttttagcctctacaactatgaaatgatagtttcttttgctgtaagtcacccagcttttggtactttttgtggtagccctaaacaacaaattcaactctttttccagtattaacagtagtaaaattaaaacaaggataataagaaaagaaaatctacttttctgcttactcttataaaatctgcctagcactcatttctgctgatttgattacatttacatacaattttaattaaagaactactaataaatgtttcaattacaggaaaaaatacacttaatgaagaaattgtctatgatgatgatctgagaagccttttcagaaaatgttgttgatatatttatttttcttttctactattacagagaagactggaggagaaactaattccaagcccccatacatgatcaactgagtcataaatccttccccagtgtaggtgagagttcacagatactactctcataatctctctagtaagtctttccatttctcaatcatttaagcagtagaggacactgtttttatttctttgcattttcaatgtataaatcgtgcaataacacattgttcaattttttctaagttggtttaaatgctgagaattctcctgagttctcttccttggcagaaaaaataaatttctggaatattttcaaaagcatatccttgcaaatggaaatggtaagcttaataaaccatgctgtttgaggtcagccttgctgaatattgctcctcatatcatctttagttatataaggtcataagggatacttacgttcaagatcataaacaaaatgttggtgtagctcagcaatttcttttctatgcttaagaattattttcaaaaacaatatcacttttaacatacttctgattctcttgatgataaccccaggctttgatagtttgtttttcttttcagcttttgcactgggcctttgacatatgaatatacctgtatcactctcataaacttcagaagctttgttgcattttccttcaaattctctctgggtcaacacttaaagtataatccattaaccaagcccttgcaatatccacagtagaaaatgaagataagtaaatattgctgtgattcttttactgacattttttccaattcttacccctttcaaacagcgaatcagttctcgaaatgaaatcaatcttgtagacatgattaccaattataaaaagatgaaattttcaaattttattaattggatcaatttttagtatcattaagattaccttgctttcatttacattaggtgaagttatggtatacaatgacactaataagcaaaggcgagtttaaaataacaagagctaccatttattcaatgtggtattatgtggaaagaaacagtacctgatgctttgcaagcattatcttgcttaatttgcttcataaaactatgaaaaacatattatttcagttttataggtgagggatgtaatcgctagtacaatataggaaacacatgtcagagccaagatttgaagttgagtctctcagactccaaaatctgaaactttttcaaatatgccgtcttgttttccacactgatgcttttgacccttgccataaagtcagcatgacctctttgacaatgtgaatacagttaacactgtgcactttgaacaaaagaaaaggaagtaaaaggacaagaccattttcaggcaaaatgaagaatatgcaaaatgtcccctttttttctttctttttgctgatttccttcctaattccctcctcactactcccacctctaagtcaaaagctttttcttctaccttcaaacatctgcagctatgctatttcttaatttacctatcaaaaccacttttctctccaaccactcttcccttctcccaatatacttttatatcagtagttgttatccaatgactatgaatttaagtcttttgtttctttgggaacagtgtgtgcatgtaagaagaagcagtacagtataataaagaaggcaggtttgggagccaggctcttggctgcatcactaggtgacctttttgtagcctctttgtgcctcagtttcatcatttgtcaagtagtgcctatcccagcacttactgtgggaattaagtgaagtgattagaacaatgcctgccacatagttggtaatatatgtgttagctgttatccaaatgtatctttcattgaattaaaaatgtaaataaaatatgtcttctactaaaggaattgcacaaattaccatgaaaaagtaaaaaaaaaagtattgggattttgttttattacacctctaaaaacatattacgtgaggactttagacatataaggttacttctatgaagaaacagaatggaaaatgtcaagtcatttaagatgctcacttattacattaaaatattttccaggcaggtgtggtggctcaagcctgtaatcccagcactgtgggaggccgaggtgggcagatcacttgaggccaggaattcgagaccagcctggccgacatggcaaaccccatcattactaaaaaaatacaaaaattagctagatgtgatcccagctgcttgggaggctaagtcacgagaactgcttgagcccaggaggcagaggttgcagtgagccaagatcacgccaccacactccagcctgggtgacagagtgagactctgtcaaaaggacggaaggaaggaaggaaataaaatattttccattgattacccatgctttttattttgaattaatagtgttcgatgcattattaaaaaatagaatttaaaataaattgtagaaaatatggagagaaatatttatgtttcaaatttcccaagagtagggctttggtgcattataatcccctgatagctggcatgatccactttgttggttacttttacagggtccttctactctcttccttagtctccaggcttttaataatcacacagaatattcttttcactacagaacatacctacctatattttggctgtttctcaagctgacttatttcccagacatattcatcctttaagtacgcaaaaatgactttcataatatttccattgataggcaatacacaaatatgtttaaatgaaggaataatttattgcattgtactttaaaatccacattccttgctatacataatctgaaaccactgtaaaagtacacttttttaatgcaacagcaggcatacattttttccagtttgatgtaggcaggacctcaaataatgtcaaagtaaagatggtcaatctattcactattggaggaaaacattcactgtgtatcagcttgagttggagaaattacagttaagaaatgttttgtaactaatgatggcttccacgtttgtaaatcaatgactcataatgtatacatgtaaacctatatttcattattttgttagtaaaccccattataacatatactttaaccctattattcaatataaaatggcaaatgcatttttatgattcatttgtcgtattgttattttactcaagatttgttcaaatgttttactttttgtaagttaaactttctatgcttaaggagtatatagctacaagaaacagataaacactaaaaattacagttctaagacttagttgaatatctttcagtaatttcccttagagatatggtcacactgaccaagctacataaatatattttttaaaatttagtataccaatgtgtctattcatgataggttgtgtttttctccttgtacctaaaagtttgatggtttcttttccactctgtctctctctctctcttattgagctacctcgtactagtcctgcctaaagttttatattgtttctattctaactatactcagaaatacataatttgaaacttgaatataacctcttttgtatttctaatttttggtgagcattattctggttgttagccccttgaaggcaggtactttgtgttacattcccaatttatctgacaaaatatttagttcagcataaataatatgcttagcattcaagatataatttgtgattaatttattttgctttataagaggaattctgggggtagcatacacgccaatcatccttgaaatatatataaactacagtgcctctagagtgttatagaaaagccagtggattaaacatcaaaacctcttagagtctctgaatcatattattctattacttctcttattttctttatctatctttgtctcctattataagaaagaagacataaagatataaaaaacttttcctacctctgccttgaagaaagtttaactataaccttcataattatgaccagggacaagttaatgacagattccagctttggtatggctaaggtagaccactcaagggatcaactaactaatatcaaggacagtaaggttcttaccccattcatgagcttcaagtgttctatctcaccccaaaagagattataactctttttttacaatttcattttataatataaaccactatttaacctatatttctgaatcactggactgaataattttatatcaatttattccaactgctatgaatactgaaagtgcatgaatggaagatggcggcccatgaggcaggccttgttaacagtgtttccccagcagaagggtaaaacacaaataatccctccagagaatcaatttgcaaaaggagctcttcaaggttctgaactcctttccttgctctgctgtactaattagatctgacctaacaatgattctgcttatcttggcgttgtgtcactacccttagctatactttaaattaagaaactaacataatttattttgagttactagtacaaaagaaagtaatcttcttgatgggattcagtttgaggcagtaggttctgtataaaaatttttatcgtagatacaattgtcacctgttttctagaaaaaatatattaaatataacctaatgaatatgccaaacttactaggtctgtatttttgctttatataaaatgtcatcaaatttaaatataattcccaataaagtccacatctctgaattatctattacttgcattttggggtgtgtttatactacctagaatgttaacccttattgtgccttaaatgtgcatttgtaaaatgtaggcacttttataactatgagtgaggctggtaaggtagtgtttaggattctccatgtcagttagtgaaagtaagaagtacagtgttaaaactattgtaaatagtttccggggcaagtatagactgagtccatccagaatgactgtaaccaatttgacatcatgttatggataaagaagcaatgaaaaataaaccaaatagctacattatatcatattcttaactttcataagccatgttttatggaaaactttttagttttctcaaaaggctaatatatttcaatattttgaatacatcattgttaattttgagttggcagaggtaaattaaccaactaccattacgttttaggattaagagatatagcttttaataaagttactgaaatgcaaaaaaaaagagaaactaacataagttaaaattgattgtacatagtgtcaagacagcaaactcaaatgtctaaaaggaccagggagaaaatgtcaataaataaatgtttgtgttcaaggaaacccaaaactagagcaattgagggcccacacaatctaagcatagtgttttctgactcttgatgcatcaataaaatacttggcctctgataattttattttataagataaaccagtatataacctatagttcaagatcactggacttcacacttttataacgatttactcaggtaactaaaatatttcttcgctgagaagatcaccctactgcctcactttcaacacattaattaaagatcttagaaccataacaagctttaaggacttactaaacaattaggcaagaaattacaattttgccagtcatcccaggtaatcataccatcctgactcataaaatttccttatgaacatattgacaacttttaggaaaaaatctttctaacagactgcttgggaaaattcataatgtctctggcctggtcacacagcttaagtactttccgtagaaaatattcatgggatttatagaaagtcagtctacagtgtttacagattaagaatcagacaatcagggtcctcttcatggaaaatgaggatctatttacagtttatcaataatcagagatgctacgaagttgttagaatgagctaggtgtagccttgaggacttagtaaaagtcctcaaaggaaacttaagcataagcagagtaacttctctctgaagaataaatcaggatacttcctgatgtctaccgaaggtcccttgaagccataagcccaaacatttttaaattatttctgtcccaaatcctctcgctaaggaattaatgtcatcctttaaagatttagcatcatatgaatggagaagagccaggtaggtgctttcctagagagaaaaaataaatcaaacacaattcatactttattccagaaattaagtgttaacatgtcaaatgcttttgtctttaatttgaatgtctttcccttcataattatgtagagcagaggtttagtatttttgaggctattaaaattcctgagataaacttgatttttctctatgccgtcacgctccagaaaacataagaagaatgttaattctaacctaaaagaacccaactacttctgtggataatcagtttaaacatccatgggtcagaggaggggatgacagtttattgtgataaacacatgtctaagagaaccagatcaaggtcactgacatgtttaatattaattgctaaacaactgtcagatggcaatggtttgagttcaccacctctcatgagttgaatccaaattgctctctgaaggagaaatcatctactaaattctgttctttcaacaatgaaaacaggcatacctgtcaattttctatataaaaaataccattgtgtttattcactcacgtggattttcagctctgccaattcaatttcttcactgaacctactagtatacgcctcttcaatatagtcacgttcaaataaataagagtaatattctcattgagaaagggatatatacctcagataaattcattgttccctcttaccctctgttgttgataaatttagtttccaaacattctaaagcaatcttttgaaatcatctgttggcttgagtacaaagaacatgaggtccaactaattccaagcatttctttaatatggtaaaggtgttgctttgattgttactctcagccacgaactaccattggatcatttaattccttcaaaagcaattgaaggactggcttcaaacctttcaaaatctgttttcatatctacatatactgagaggaatagagagaagtttctgaataaaataataatactttgcagttctctgaaacttgagagggaaccagagaatgtttattactgagttttaatgtcttttaaagagccaacacctgatacttcaaaaacgttaatcactccaataaacattttactcccagaaattcatcttaaatccatcttataacataaacaagcctagtaagtagcattattaggagaaatttctggctgagttccacacatatattcaacttcctgaacaccctctaaaagcaattttaccttacttgacacaatacagaaattaatcagcataataagtaagctaaaacttcaataaaagtgtttgcatcttgtccaggcaggtggctcatgcctgtaatcccagcactttgggaggactaggcaggtggatcaagaggtcaggagatgaagaccatcctggccaacatggtgaaaccctgtctctaccaaaatacaaaaaatgagccagatgtggtggtgcacacctgtagtcccagctactcgggaggctgaggcaggggaatcagttgaactcgagaggcggtgattgcagtgagctgagatcacaccactgcactccagcctggtgaaaaagtgagactccgtctcaaaaaaaaaaaagtgtatcttaatttgaaaatattcataaagaaaagtgtaccctggtaagggggacagataacctaaaagaattatagggggaagagttttacatatataatgatcacattttaaaaattatagttgacctgcagataaataaagtatggtgtttttgcctttattccttaaatataatacatatcctttctctcaatgaccggctaatccaacactgatgattccttgaaacatccctgtgacttaaagtttacaatttctaagaacttttcctaactcaccatctctcagttattcacacacttaaattttcttttatcctattgaaatcatgcaagtattgtctgcaaccaagataggtaaacatatcttctagaccactagaacacatggctgttttccagatatacaataagtgatgtcacagacaaagaatcaagatacacacttctctttaccactgaaaatgttcacctcacatttttatctcaacttaggtgggtgtgtttttgttttttgattttgtttttcctacttatgaaaatagtgccaaagatcttcagttggcactccaaagcacagacaattgcaaccaatgttctagagttacttctgaatattatcctagacaagtagcaggagcactgacatgttttcataagagaataaaagacatacaaagatttattatctggcttcataaatttaaagcaactgtagtgccttgaatgtctttgtataaacttttatatgactctaaaagaagataaaaatctaatagagactttcagaaggtcaaatatgaaagatgatcatgtctaatgaataaattgatttctgctggagtaaataggtcacaattccaaaaagaatctgtattattttttgacagtgcacctaaagtaaaaatgtggctccatattatgtaagattttggtacaatatttaaaattctaaaatcattaagcaattccaacctatacagaagtatgacaccttgggattatctagactatatggctaactcttttaattgtatacagatgttaagtcttacctctgcatgtgtgcattgagaaaccagatgaaaaaaaaaacttaactgtacttttcaaaaaacttggttagatatttttatttaaacatttggttttgtacagtatacatttaaattacattgcttaatgaatccatctgaaaacagtcactggttgcttctgtgatttgtgaataggagaacatataaatatagcagaatgactttgtctagcaacatgttcttgccaagataattgggaattaaatatttaaatacatggaaataatatctttgcggttacatatgtgacttccaaatcagaccaaactaattccttaggaaggccaagagatagtgaagccatagcatcagagtgacacccagaaattacagacgacaagcattatgcaaaggcatagaaaatttgagattttggttttaagaaattttcctctttgtaagtcaatgtcttagtaaacaggaactatgtattcattacaaacatattgatagatgtgtatgtgtgggcattcatgtgtgtgtatacatgactataattcacaatttaatttgggtagataaatagatattgtatagatccacatatactttcatttggctatatataaaatatatatacataatatatagaatttcatctggttattatattaatataccataaataataagagtgtgtgtgtgtgtgtgtgagcgcatgtgtgtgtgtgtgaaatttagctataaactttgagaggggaaagagaaagcaaaaaaaaaaagaaaaggaaaagttaaacctcagaagagaatacactgatctagtgagtttttttaaatcttgaaaaaatggttttaaatttttgtttgatacttttgtaatctcaaagctgtcgcaataacatatagtggttttgaattgaaaaataaaaagataattgcctgcgctcagaagctggagatcagtttgggcaacacagtgagatctcacctgtacaataacatattttaaaaaattagccattggagcagtgcatgcctgtagtcccagctacatgggaggctgagtcgggaggatggcttgagcctgggggactgaagctggagtgagccatcactgcctcattgcaactcaagccagggtgacagcaacaccttgtctcaaaaaaaaaaagatattaatggcttaaatatgcataatctcatgtttgttaaatgatgcacagccatgaatttactatcaataaatatttttaccattttcttttttgttatcttttagatctccatcaaaataaacataagtaaattaattctttatctttacttttgcactatcttctctcgtttatagctttatcttttcaatcagtttctagcttcctttggttttattagtaatgtattacatttgcatagcattatgtattatattgaacaatataaaagtgccttttataagtaaaaatcgttgattattagcaatttcatatggcttaaacttaactcttctcaaagtgcatttttatgaattccctcatttgatcatcaaccttgttataagattaatactcaggttacacaaaagaaaataaggtttcaaagagttattactaagtctgaatcagctagatatgttaaagtactggtgcattgattgtagattaaagatgtgaacatgcatatacaaaggcattgtcctgaaattggttttaattaaaagctcaaaatccacatttccatcttcccgccacaatctcttaccccactaaaaagttatcatgatgattaacatggggccttacttcactgaactactaattattcttttcagtgcttcttttattattatgactttaacaatacatcttctgatcttactaatatattttttattaagaagcttagttgtttctaccaagattaaagaggagatcatagccaagtttcttttaaaaatgaagactgcttattcttagcaagaggagaaaaaattgagggcaaaattttgtggaaatttaatttgcctcatttgtccacagtaggtaagtatggcaactgtatgcaaaatgcagcagccacgcatttcatcagtgataatatgtgactagactttctaccctctctgtttgtttttgtttttgtttggtagaggtagcacctcccagtgttgctcaggctgttcttgaactcctggcctcaaggaatcctcctgccttgtcctcccaaagtgctgggattacagatgtgagctgccacacctgcctttcttctcaattttttaatcaatataaattataaaatgtggttcacaactaaggttgaaaaatatctagtccttcaccccttaccccttctcattccccaaaccctgtgaatctactgtaaaatgaattcataaaccaagagtcattgcttttttattctactgcttacattttacttggcaaacacagaaagaagttgggtagtacctcatggaagaacaaaaaagaagaaccctggggaacaatttctgggagtatatcataccacatgaaatctggaaaactccttcattctcatctgtcttttttccattctaaatcaacacactaattggataaaattttgcccagttaacttatacttcctgcaaatattacttcaaggatctcacttaaaaatgtaaaataattaaatccccccacaaaaagaaataatttaaaaatatacaaaggtatttgatacattttattcttattctctcaaaattattatattttgagcagaattattatattgaaattctgtattttccttacttagcattgcactgggaataagctggacaccatctgtttgattcaattgtttacctcaaaggggaagtaagttctagaaaacaactctgaaaaactgtgtagatgaactttctgattctacgacatagaataaggagctatatagagaattcttagaactatgtcatagaatcagaaaatgtataaggcagaattcttagaattatgttgcaatcagatgaactgacatactcttttttttttcctttttgcctcttcgctttacaatcaagttaaaccaatttaccttgactgtgtttgcactattcctacttcatctttattgagtaattatgttccttctcatgacaacaaaactacattttgaaaccttctcatttaaagcaggtacacaagacaagacagacaccgatctccagtgcagaggtgcattggacaatgtgacaagggacgcagtggtaattataaaagatctgttgacattatgtcttttctaaatcccattagaatgatgcattttaaacttattatttgatcaggatgaggagagtaagataattaaaatctttacagtacctatatttcatatactaaaacacagtaacaatatgtgagaattatatttcaagcattgggtcatttctgtgtcttataagtctctttgctatttaagaacccatggtatttttttatttctatttctatttcaaatattaaaatgtttatacccatatgtctatttcagaagaggtattgtaaaatgatttaaaattttgtggtcccttaataaattctatataaaaagcatagattaaagtggtcaggactatttaaaaaccagtatttgtgtgtatgtatatgtgtgtattttaagagagtgaatatccatgaaacatatcctcataaactggcctaactggtcttcatagaaaagcattattttcacgctattttatctatagaattaattgttttgcatagtcatagaattttctatatacaagaatccccagtgcccatcttcctacaagttaaataatgcataagtgtatcctgaaaaatgctagaatatctctcttcagagaacccatgtaaataaattagctcatattcttggaaaacagccttgctgtgtctgtgtgttctccttcaccacacctggacagacctcaactcgtaaacaaacatcctaagatcttaagtataattagtgcaaccaaaacacttgaatatcaatattattctttttaattgcattagcttaaaatattgtatctttttgttgtctaagaaccagagccctatggttttctcttaatgttaaattgtctataataatgagtcaaagtcatattagaaaatattagtactcacatggccattatctattatgccccattgatgaacgctttgggagggtgatgttaaatcttcttctattttatttaggaatctcattggatatcatagcacagtctacacatttcagtgtctcctgggtggcagacctcacagaatgaagccaggagccttatgctgagagaataggaatgttcaatgggttcttccttcatcaagaaaaaaagcacccagaaaacaaatagctaacagccatcttgaagctatcttgtgtgcttgtctcagtaaaaaaactaaacagaaggaggaaaaaacaaacttgacatggttaaaaagcagaggctgctcatctggatttatcttgcgttatgcttttttaatcaaaaattcttcaaagcttactgattgtttggttcatgaggtgaagggcctgtatcttcaaagaaagaagaggcaagatctgctaaaagagaaagcctctcgtgatgatgtacttactgccactcagaccagaaaagattctggccctgatgcagttaatcacttgggccatgagttggtcactgctgtatcctacggagagcctgaacaagtagaacttttgttgagtcattcaactgtagaatttctgcttcaaaggcaacaaagtcctttcctccaagatattaaaacatagactaaccaggaatgatttatgtattttaagatacaaataatacggatttttttaacactattactaaattatgtttaaggtctttgagtttaaaactgttaggaggactctcaggctatataaattacacagggctctcggagatcacaaactgtctaaagaaaaagggtcatgaggaaggcaccatctctccccatgttttcatgactgaatttccataatttatttagtttctaccaatgacagaaggcgggtggaggaaggaacaagaaagctatcttaaaaggagatacaacagagtaaatattttcccagttagaatcttagtgactttgaggggattaaaagaacctactgtgaataattatacatcaataacttggataatccagaaaaagtatataaattcctagaaacatacaacctatcaactgaatcatgaatataaaatctgaacagttcattaactattaaggagattaaatcagtaattaaaagcctcccaaaaaagaaaagcccagatgagatggttgcactggagaattacacaaaacaataaaaaaaaatagtgctaattcttctcagaattttctaagaaatagaagagaagagaacatttccatacttattttatgaggccagcattgtggtgatagggataccaaagctagacaaggactacaagaaaagaaaacaacaggccaatatccctagtgaacacagatgcaaaaattcacaacaaaatactaacaaagcaaatttaacagcatattaaaagtatcatacatcatgacgaagagggatctattcctgggttgcagggatggttcaacataccaaaagcaaatcaatgtaatacaccacattagtagaataaagagtgatcatctcaatagatgcagggggtaaaaaagtattttactaaattcaaccccttttcatgataaaaacacttaacaaactaggaatagaaaaattacttcaacataataaaggccatatgtgaaaaacccagagctaacaacatactcaaaggtgaaaaactaagagctcttcctggataatcaggaacaaggtattaatgctcactcttgccacttctattcaagatagtattggaagtcccagctagagcaatgaagtaagaaagataaataaaatgcatcaaagccagcaaaaagtaaaaaaaatctctgtttgcagatggcttgattttatatgtagaaaaccctaaagactccatagcaaaaaaaaaaaaaaaaaaaagttggaactaataagcaaaaaagttgcaggatacaaagtcaacatacaaaaacaattgtttttttttttattcctgaaaaaaagatattaatagtttgataaggattgcattgaatctgctgattgctttagatagtttggacatcttaacaatattaagcattccaatttggaaacacaggatgcctttctatttatctgtgtcttatttaatcagtatataagttttcagtatataggtctttcaactccttgggtaagtttatcactaactgttttattatttttgttgatattataaataaaattggtttaattttttatttttttattgtatatatccatatgcaaaagattgaaactggatccttatcttacacacaaaaatcaactcataatagattaaagacctaaacataagacctgcaactgtaaaatgcctaaaataaaacacaggtgaaaagctttaaaacattgctcttggcaatgatttcctgaatacgacaccaaaagtacagaaaagaggaaaattggacaaataagactacattaaactaaaaagcatatgtgcagtaaaggaaatgagtgaaaaggcaatctatggaatgagagaaaatatatgcaaaccatatatcttataagaaatcaataaccaaaatatataaaaaactccataactcaatggcagaaacacaacttgattaaaaagcgggcaaagaacttgtttagacatttgttccaagaaatacaaatggccaacaagtatataaaaagatgatcaatatcagtaatcaagcaaggaaatgcaaatcaaaaccacaaggaggagggaaagcaatgcgatatcaaccgacacctgttacgatggccataaccaaaacacaaaataacaactgtcagcaaggatgggaagacattggaacccttgtgcacttttggtgagaatgtaaaatggtgcagccactgtgtgaaacagtatggaggttcctcaaacaattaaaaatagaactaccatatgattcagtatttaccatgtgatttctggtattcacccaaaggaactgaaaactaggaccctgaagaggcatctgcacttctgtgttcgttgcagcattactcgcaatagccaaagggcagaaacaacctgtgtccattgacagataaatggaaaaagaaaatgtggtatgtacatacaatgaaatattattcttccttagagaaataggaacatcttgttatatgctacaacataaaccttgaggatatcatgctaagtgaaagaaaccagtcacaggagacaaacattgcatgattccacttctatgaggtacctaaaatgatcaagttcatataagtagaaagtagaacagtagctgacaggggataatagggcatagggaagatagggagttgctgttcaatgggtagagagtttcagtcacgcaaggtgaaaaaagttctagagatcttccctacaacaatgttcatattattaacaatagagtcctgcacacttagcaatttgttaagaggataaattacatgttatgtttttttttaaatctcaatcaaaggaaagaaaaaaagaatcttagtgatttttagagcagtgattatttccctgaattatttccatgttcaccccatcattaaaaaaagaaaaatccttggttgttcattcaaccacagagaagtggttataaatcccaacatattggtactttactgttaacactgacttgagcagacatcactcatgataattcctgtgtttgccatttgcattgtatcaccctgacttgtcctggtacgcaccagcaccactctgctcacttgttaatacacacattttccactgcacatgttggttacaggtcactttttccttaaatttaattgcaacacttaagcatggactaaccaggactcatgtttttattaatacatttttaagaacccatgattgatattcttttagccctggggatggggatatgaaaaaaaacaagaatcatgaagtggtccagaaaattgctctggaccatcctgatttctctcctgtattaattcctattgaacttactatcctttctattgaattttagtgcagaattgctttctgatagtgtctatctttattctctttccccattaaatcatctcactgttaccttactttctaacaccacttcctgcacaggtgttgtgtgtcccataatctcattgcttgagtgatttgaactaatttaactcacatgactgacagttcagtggagggtgtccttttgacagggtggagaagaagcttgactgtaatattgctcagctgtactgctatggacctcatttaagaccacaaacactttttcaatgatttatttaactttttgaacagataatatattcacaaagctcaaaaactaaaaagcacaaaaagatgtgtgctgcaatgtttccaacctattcttgtttgccgtctgcctttcatcctcgctctaccctccatccaggtgaccctgggatgtagacagcagtacctaaagtttcccagacgcttctaaagcagaacattgttgttttcagttgtaaacaaggaggagcctggtgtgatttcaggttccagtttccagatgtcgcctctctgtcagggatcaaaaccacttacagtgccaatttcacttgtcaagcaatcaaacactaaataaacaaaccaaatggatactgaacacccacgaggtctgtttgtgttatagattatggagaggatagggataaacaagtaaattattaatcttgaaacagatatgtggaaaaccatatctacattaaattgtcaataaaactgcattttctaattaagcaggtgtgagatttccatatatgcattcacccccaacaacatatttatttaggacttggcagaagtttaggtgtcatcaatgagaatccactcatttaactaatgagaaaactgaagttcagagatgcatcagggtttataattaagaatatgaagagtatggatccagccagacttggtttaatccaagcttgtccaacccacggcccacaggccccatgcagcccaggatggttttgaatgcagcccaacacaaattcttaaagtttcttaaaacattatagatttttttgcaacattttttaagctcatcagctatcgttagtgtattttatatgtggcccaagacaattcttcttcttccaatgtggtgaagggaaaccaaaagattggacacccctggcttaatcctaccacttagcagctgtgtgacattagacaaactacataactcctatgtgcttaaatcttcccatctgcaaaatggaaataagaatatatccttcataagactgtagtgattaagtgagttaacatatgtaaatagctaagaaggatgcttgacatagaataagcaccatagaagtgcaagctgttataggttaagtgtcttgtgaaagatgagaacagctgggagagtctagagagggttacatgctgataaaatgatgtactgaattatccattacaaagcattagaggaaaataaaattcataataaggtaatgtgcacattgcacacgtgaaaaaagaatttaagaaggctggagtaaaataagcaaattacactgatttagctcataaacaaggaaataaaaaaatcaataaggtggacaaataagtaggctctcataagcatcactgggccaggacaaaggtctcagagactccaaatctactcagttctggaaatgcttcctttatttatttatttatttttaattttctgagggaaaatacagaatgaaaaggacgtatactcacaggtaagtgccaaatgttttgataggaaaacattttaaacactaattgactttgaatcacgtttgagtaaattttggtcttcattgtatttaagtgatagtctaattactacctatgatttcagaacttttaccaaataagaaaataaaaacaattagctattgctcatctttttctatgtgagtgctaacataaatttttaaaatataaaacaaagtgaaagattagtataattttgcttttcattttaaaataaatatagctttccgtttaaactgtcttcagatacatttctctcagtatctaaaacaattactaaacaagatacgtttcaaagtaagaagtcatgcttttattaaagagaaaatggataataatgttcacaagtaccactgattcacaatttctagattagttatatttaagtgattgaacaacaaataaggaaagtcttaaaaataaatatttttctgcagaaaatacacaaatatattccactcttgagagatctcacctttgcataatataagacactcatctgatgcagttagcctatagatcctttaatgaccttacagccaaatctaatcaagcttagattgcaacagaaagtaaaggacacactcctattttatcaaaatgtgaatgctgagaaaaagagaagagggaataatatgccttttaaatttatgataagataattagcaaccttgctaatgtagttcttcaaacattaaatcctcgttttcattcttcttccctaccaaatttaatatactatgagaactctttagcttaattatgaaaataataataatagagttaagggtctgtcaatccagcttaagcccctatctagaatttagaacctggcatcctaattaaactgcaaatactttatttacaaagttattgtttatacattgtaatgaattaatctgattgaatctctgactgattatgggctaccatgtatattttcaaagcaatgagaggggcatacaattgcatttccaacattcagtcgctcagcataattagagaaagtaactatagacgtcaataatcaatgtgcacttgcaccctggagacctgggcaccattacgattccaggaacctctttgagttgtcattttaattatttgcatattaagatctctgcaggcaggcaatacttcaaaagataggccaaaacagctccttcaaatgttattaagttcaacattgccaaatatattttagttgccaattttgaaaaccaaagagattatttaaagtctatcacaaaactgttacagtgagaagactgagttaactacctgtgaccctaggccatcagtgcagacctggggttgctgaagatttggaaaagtgaatcaaaatttttttttctggaaaaaataataaaaagtaacaatacctaccatcatacaactacaataaaataaatgctttacaaataatgtcaaataatagatactccataaattctggtgaatctttgttattataagtagtagcagaggcaacatcaacattcacattcctgattcccatagcactgctttttctatgaattaatgttgtttcctcaactagactgaagaattaataaaaagtcctattttaccttaagtacaaagtgttttgtctacatgctaattaagtacgccaaattgttttctatgcttctagaagacaaataatgatttatgggtcctaaagagcacttggaatagtgctggatccacagtaaatgtccagtaattggttatttattgcttgatataagtaagcacacaaaatgaaggattcaatgttaaagaatcaaacagagatttatgagtgtgatcaaacagagttactatgttggaggtaaatttaattcttgtatatttcaaatatatgtcaaatatttctgggacattttgaattgactttcctctctgtgaatggcaacactacccaacatctatggtaagcctcattttctcttatccccaacaatgcctcacacacacaatgaacaagaaatgagaaacaatgtggtcaggctttctgtcataaaatctgattatagagcaggatttgctatgcagaagaatttagaggaagtcagagccacaaagtgtggctgtgccaccaaactacatttttttcacacacaaaaaagagaaagtagaataagaggctgaatggaaaggagaaataacatagacagtactgagtacttgttaacatccaatatataaaagagctacctgaataaacagagaaaaatatgactatagtattattattgctacaattcaaaccctttgagtgtgtgtgtgtgtgtgtgtgtgtgaaaaatagatacacaaaaatatcaaatgtggctatttatagatcttaaatacttaaagggtatgattattacaccttggctccttctcactcacattttaaagatgtagggaaaggtgatgcctaaaaagactaccattcctaaaatcttatgatttcacaattttctgcatagaagtagttgcttttaaaactctagtatgtatttgagctgtatgactccctgagaatggaatatgctaggatccagtaaagggatattgaggtttggcctaagggctaaacaaataaatacgttgaggccagaggcatagtcaaaggttagctccttggtaagaaaatagataatccccctctgaaaactccaggtgaatctagggcccagaaaaaaatacccacttctccagggtcatgcaaggctaaaacagaccagcctaggagcatggatacaaactggactagcaagcaccacaacctcagaaattagaatttggtgaggcagcttttcattagtaagatgaataacaagagggaatacttgttttaaaattgcatcaagctaactgaaaaagaaagattaggtgcaggcatccacaatttgttattatgtttttcaatcttggagaccggaattctcctgtgctttgaattaacagcacgcaagtgatacactatagagaagaaaagtcaaaaaattagtaaatcaatagggctgcctttatataacttgccaccataatttttccctggatgcttccaacgtatctatagttttgtttattcatttggcaaaatagggcacccacatccttggcacagttcatgggcttgaattgtaaccgggaagaagacaaatataattcctgctgtgatactgtgatttaaaatgagatatatacatttggtcttcactcccttctcctgacatataactcttaaaatctttgaaatctctggagtgataagaatatcatttgtatgctaatgaatgtttgctggctggcagcctctagatagcttcagaatgggggccagtcaccaagaccaagacagaattagagggttaaaactttcagccccaccaccaacatccaagtaggtgagaaaggctgaaagctaagttgataaccaatgaccaatgatttaatcaatcaggcctatgtaatgaagcttccataataactcaaaaggactggagtcagggagcttcctgacagctgaacatgtggaggatcccagagagagtatggcagctctgtgccccttcttccgtacatcttcatctgactgtttatctgtatcctttgtaatattctttataataatcaagccaaatgtaaagtattaagtgtttccctgacttctgtgagctgctctcgcaaattaatggaacccaaggatggggtctacagccagtcagtcaaaacctgtgcttgcaactggcattggaagtcggtcgggaggcactcttctgaaaatgatccttcaacttaagggatctaacactttctgctgctagactgtgtctgaattgacttaaattagagaacacttggcaggtgtctgttggagaactgctggcttgatgtttgggggaaaacccccacacatctcatgttagaggtattgtgttggctctgcaagagtaggaaagccactttgactcttcccacatatcttacatctgctctcatggaaattacagtggctatagacagagaatgaattcttaaacttaagaaaaacaatatagtttcagagagtgatccatgattggagctgtaaagaaaccagaagatgtggttgagagggactgggggaagggaaagaggggccacaggttggtggattctttaattagatgggctaattggaacatcctcactaaaaaggtagcatctgagctgagagtgaaatgacaagaacaagctagtcatgtaatcttctggggacagttttacaaataaaagtaaaaacaagtatgaaagccccaactaggaacaacttaaagtatgtaagaaaagcaaagacaggtaaagccaatgagccagtgaaggaaagtgaggtatgatgcagcctggagtcacagatcatttggcctgaaaaaggagttgaaatttagacattagatgaaaagactattctagccatcttgctactagatgatggtggcctgactaatgcatcacctgtgaaaatgaaaagacccatataaattcgggatacattttggaagtgaccctaagtaatccttcaattgttggggtgattatgtatgtttgtgttttaaagtgcggttcagtgagggatcagatgactcctaggtgtatttcgcttgaacaacaaggcatatactaatgatatctattgagaagaaacttcggcagaaattatgaactagaaaatggagaatggatagctctgttttggtcttgagaagtttgagatagctcttagacatcccagtggaaaggtcaagcagagggttttttacataaattaggagctcattgcagagatcaggattagagatatacatttgggattcatcagcatttagatggcattaaacgccacagtactgaatcaccttcagaaagattacagtctttcagaccagcatttggaagccaacagagcagaagtcagcaagaaaggccaagaagagcagtaggtatggaggagaacatagcatcatgatgccacagcagaaagtgtttgaagaagaaaagaactgtcaactttgtgacttgctaccgctgagtaaaaaaatgaggacagaaatgtgatcactggatttggcgcatagtgaccttggtaacagtctattcaatcaagaatggcaaatagcctggaagaaactgttgaggtcgatgcgtatgatacaatgaattaaaatacatcaatatttctagcaaagaaatactatcatttttacctatacttcaattcatccctgatttcatgaatatcacaatatagaatttggttataatttattgtttcatagcagttagttttttgaagctgtgaaaactcacaataattagcagcaaataattaatgtgcttataaaatactctggggaaatatgccctgacacttagtatcccaaatggcattactcttaaaagcaatacatgtgaccctctggctataatagtaaaaaataatttttaaaaatgaagaacaaagtaaactcttttaaagacttactttcaaatgtcacaatagcaataaattattgatttccacatctaaaattaatgtttttatttatttatttatttagttttttaattgatcgttcttggatgtttctcacagagggggacttggcagggtcataggacaacagtggagggaaggtcagcagataaacaagtgaacaaaggtctctggttttcctaggcagaggaccctgcggccttccgcagtgtttgtgtccctgggtacttgagattagggagtggtgatgactcttaacgagcatgctgccttcaagcatctgtttaacaaagcacatcttgcaccgcccttaatccatttaaccctgactggacacagcacatgtttcagagagcacaggtttgggggtaaggtcacagatcaacaggatcccaaggcagaagaatttttcttagtacagaacgaaatgaaaagtctcccacgtctacttctttccacacagacagggcaaccatccgatttctcaatcttttccccacctttccccgctttctattccacaaaaccgccattgtcatcatggcccgttctcaatgagctgttgggtacccctcccagacggggtggtggccgggcagaggggctcctcacttcccagtaggggcggccgggcagaggcacccctcacctcccggacggggcggccgggcagaggcacccctcacctcccggacggggcggctggccgggcggggggctgaccccccccacctccctcccggacggggcggctggccgggagggggctgaaccccccgcctccctcccagatggggcggctggcctggcgggggctgacccccacctccctcccagacggggtggctgccgggcggaggggctcctcacttctcagacggggcggctgccgggcggaggggctcctcacttctcagacggggcggttgccaggcggagggtctcctcccttctcagacggggcggctgggcagagacgctcctcacctcccagacggggtcgcggccgggcagaggcgctccttacatcccagacagggcggtggggcaaaggcgctccccacatctcagaagatgggtggccgggcagagacactcctcacttcctagatgggatggcggccgggaagaggtgctcctcacttcctagatgggatggcggccgggcagagaccctcctcactttccagactgggcagccaggcagaggggctcctcatgtcccagacgataggcggccaggcagagacgctcctcacttcccagacggggtggcggccaggcagaggctgcactctcggcactttgggaggccaaggcaggcggctgggaggtggaggttgtagcgagccaagatcacgccactgcactccagcctgggcaccattgagcactgagtgaaccagacaccgtctgcaatcccggcacctcgggaggccgaggctggcggatcactcgcggttaggagctggagaccagcccagccaacacagcaaaaccccgtctccaccaaaaaaatacgaaaaccagtcaggcgtggtggcacgtgcctgcaatcgcaggcactcggcaggctgaggcaggagactcaggcagggaggttgcagtgagccgagatggcagcagtacagtccagcttcggcttggcatcagagggagaccgtggaaagagagggagagggagaccgtggggagagggagaccgtggggagagggagagggagagggagagggagaggggtaattttgtatttttagtagagatggggtttctccatgttgatcaggacagtcaaactcccaaactcaggtgatccgcccgcctcgggctcccaaagtgcggggattacaggcatgagccactgtgcccggctaactcaggatttttccctttgctgatgtagcctgacagcaggagggagcctataataatgagaaaggcgcgaatcaaaaacagcacagtggcaagtgcgatggccttataagggatcttaggaggggttttcttaaactgaaggtccatgtagccatcgtctgtgctggagagccttgaatatttcactttactactggggattccagtagccaggttggtacgggacggcatcataacaggctgacacagcggagcgccgcgccaggccgcccgcacacccagagctcgcccacggttggcagcgcccaaggttgcacggcatggcccgcttaagtgccactcagccctaatgtttttatttatgaagtaacttaacttttggtaacataatatataacttctctttcacagattattttatttttttagaattctagagtttgaatgaatccaattaagtgtgctctgtgtgtcttctcagcctgcccttagcaagactcacaatgtgagttctgttctacttgctatcaggagaaaccgcacaggaacccaaagaatactgcctgctggaaaaaaaaaaaaaaaaaaaaaaaaaaaaaaagctcatttcttcacaaagtctctggctgtggcaaatagaacacaccatccgtttatagagtctgctaattggcactagggcattgtctgggcttgcacttctttactggcaaatgcagctcatttttatttatgctcttcaatagattcagctaccaatacatacagatttggattatgaaaaattatctaggcaggtaaaaggaattgaaatttcagacagttcagtggattaggagggagggtgaggtaggcccaaactaccttgaagaaggagtattttgtgaaaatgagccaagccccatgttcacttttgaataataaaaacactcatccacatgccgacatgacacagggattttattgtgaattgtcacacacggtagttttattagtacctattcaacactaagctaatttaaaagcacttgaaaccttgggcagacgtttttaaatgaaaaaaaaaaaagttcaaaaagctctgcatcatatactatctactataaataaaataagactcagttcttctgagccctgaaacacattcatttccacatgagctgcctgcaccaaggatcactttcatcattctctagggcaacacagttccctgttctgtcagaactttatggcattcacccttttgcctagttttcactgcttggtccatttataatacatctcctcccatactagattcctataagaggtctcatttaatttcttttaaaattaaattaatacaattaactttgaaaaactggtagtctttactaaatctcaacataagcatactccatggcctagacttttcactcttaagtatagacccagcagaaaaaacgacacacacatccaccaaaagacatgcactaaagtgttcgtagcagcgctatttatttgtattacttttatttttatgttttatttttgtgggcatatagtaggtgtatatgtttatgaggtacatgaaatgttttgatgcaggcatgcaatatgaaataagcacatcatggaaaatggggtctctgtctcctcaaacatttatcctttcggttacaaacaatccaattatactccttaagttatttataaatgtacaattaagttattaaaacaaatatgtgtggtcaaataaagagtagaatggataaaattctcacacaatggaaactgtaatacaatgagaatgaacaatctacaacttcatgcaacaaggataaatctcaataatagattgttgagccaaacatgtcaaataacagatcacagtgaattatttcattacataaagaacaaataccttatcctgactaatataccaggtctgagtaaaataattgggaaattttagccaatgtaaacatgtctaattccctttttataagtacaaaaccagtcacaattagactatgttcctagaagaaagtattagttatccttactgtgggagctaatgagtagagggggcttgaggggcttctgaaactctggtgttattcttgcatctgggtacagattacacaaatgtgttcagtttgtcaaagttcttcagagtgtataaatatgttaagatatgtacacatttctgtctttagaatacagtttgaaaacaattttaaaacccttaaatttctaaaacttgtttttaaaacatggacgttacacctaccctcatatttggactgaatttccagccttgtaacaagagagcattctccggaatatgaatagaactggtggcagactattcatgtcatgcgaacagttagtttgctttctaaactagattgtacttttcccaagagcaggagccatttcttttgtgtctgttcatgtgtctgttttgtgcacagatgcacagagaaacagcgttctgagtgacgctgattgttcacattgagtagcagtggcgggcaagcaaaaaagagcagggctgaaatttggaaggctttaaataataactggtttccaagtttggatgccatcttctaggcaacagtcaactgtaaagattttgagtgaggcaataacataaggaaaatattattttaggcatgcatacgtactagaatcgagaaaatcaatgccagcagaccagtcagcaggcttagtttaagcctaaactagaatgatcctggcaccaatggaaaagagggatgggcatatatgaaaaaaagtcagacaaaaataatctatagagctttgaaagtgatagaggtcaagagagttgtaagttctaaagtgattgagttttgcagactgagtgagagcttaatagaggaaggaaaaccttatggattaattgatttgggaagacactgaaaaaatgacataatgggccaggtgcggtggctcacacctgtaatcctagcattttgggagtccacggtgggccgatcacctgtgggtcaggagttcgagatccacctggccaacatggcgaaacctcatctctactaaaaatgtaaaaatcagccaggcatggtggcaggcacctgtaatcacagctactccagagggtgaggcagggggaactgcttgaacccagtaggcagaggttgcagtgagccaatgtcgcaccactgcactccaactccagcttgggcgacagagtgagatcccgtctcaaaaacaaacaaacaaacaaacaaaaagacataacgaatagccaaagttggagctcaatgcagaactcatacaaagtacaggactcagatttcatatattaaatgtttctgttttcctcagggtattaaaaatactaaagaggcacagagatatagtgagaaagcatgagaagatttagaaatgctaaacatcatcaaaattaaaaacactatttctgtgaaaggatagactgagaggaaaatattttcaaatcacaaatctgacaaaagacttgaattcagactatataaggaattctcaaatgtcaacattcagaaaacctacaaatcaatttaaaagtggacaaaataattaaacagacacttcaccaaacaggctatatgggggcaaataaacacaggaaaaaaagtttagcattagtcatcagcaaaatgcaaaataacaccacaatgaaatgcaaattaacaccatgttctatacatatattacaatgaataaaatgaaaaacactgatagtaccaagtcccgacaaagatgtggaacaactagaactctaacacattgctggtgagaatgcaaaatggtacagttcctctggaaaacagtttggcagtatcctataaaattaaatatatacttaccatatgtccccaagattctacttttagatgtttatccaagaaaaatgaaagcatgtatccagagaaagatttgtatatgaatgtttacagttgttctatttataaatttatcaggtacatggataaacatactgtggtacctccctacaatggaataatacataccaataaaaaggagcaatctatttacagagagaacttgcatatatctcaaaggtcaagctgacagaaacaagctagtctcaaacagttccacatgttatgattacatttatacgacattctcaaagagacaaaactatagttacagagaaatggtcagtggatgccatgggtaaaggtgggagaagagtatatctacaaaaggacagcaagaggaagtattgttgggcattggaactgttcttgtatcctgactgtagtggtggttatacaaaactgcacgtgttaaaattcacagaacttcatataccactcaaaaagtcaattttcttatatgttaatttaaaaaaatcttctaaggaaatgcacagatagaacataaagcaaccatttaaatgtcagtattcttttgtatttttactgttatttatctaagagtatctaaaaattccacagtaataggacaagtaacttactagatactccagtatgcctataaaaattacataaaaacaaatttaagaaattgaacttttttgccaaacaactgaaatttaatttataccagattatacaaaatacttaatgtaaaactagttaccaaacctaattagcaaatgtacagtaattgacctaattggcaaatttcttattatttattgagatcactgactacccagctgggcttactaaaaaactgagaagtagtcaaaagactaaagaaaaaaaatccaaatatattgaacatgggagggattttgctcttaaatttaagattctctgtaatcaactgtgaaaatctgaatacatttgttttctaggtgaacaagggacaataataaatcataactgtcaattttgctcaaaatatggtttaggagtacattttggacttctcaggcagttaattggttttgcagttttgaaggatgtggtgctcagtttttgaggggttgaaaacaactcaactgctagaatttcaggaggaaaacaataactataacaaaattcacagtggctttttaactaaggtgacttttttggaaagttaccctaaatgatctgaccagtttcatgtatcataatgattttgaattgagataagaataattggtacgtgatctcagaaaatctgaatttgaaggacgccaataacaaactagataaccactggcaaattagtaaacctctttgatcctcagtttactcatttgtaaaataaactatctgtattagataagaagttctaatctttactatattacatatatctctgtgtgcgtatcttagattcctaagcagggcccaacccaggtctgagttggggctcaggggtgcatcattgtaataggagcctttgtggtgctgaggcagatggtccttagtgcacgcctttagaaacactggaccagagagacagtccctcactcttgcagctttaacacttgaatgcagtcagtgtcttcttagcctacttttgtgtcatccctcttttctctttagcagagaccagactattagatttgtcttctttcatatcagaaaggcaaagaaattactatggttttccttagacctgtattttctgagaataatatagacaacctcagacagcccagggtgagcttccttttcaaaactgctttcagatgggatgtcttctacctcgtaggttcaccttccctgtaatttctgtaattcaaacaggcctcataaaccacaactgatctttaagaagtcacctttcagattgtctcccaaaaaaaatttaaactcctaagtgaaagatgaagtaatatgatataaaagaaaatctaatgatacccttaaaataagattttactcaggcaaactaaaaggcctactaaagaaaattatctttgacctttactttcgatttcttatgtaatcctacccagttgcttttccaacaataagagaaaaattacatttaaaaatattttgatatttatttaagggaattctactattggctctcaaaggaagttttaattttatttgaaaggcaaagcaaattttagattaatcttagcctctgagtttaaaaatgcaaatgtttccaataataatgataattgacatgccagcacatgacatttgctttgagaatattaaagctgaggaaatatggatataaacattcaacattaaactttgagataattatattaatcctaaatgaataataattcttcaaaaataaaaataatctttaaatgctaaaagaatcaacataatcacatttatttatgctatgcaagtatacatactgtgtggaagaatccagaagcagggttgatacctgacactctagccagaatctgatgagactgatagtttggaactcagtccctttccttacaaactaggttgtcttgggcaagtaatttaactttgctgagcctcattttctaaatctataaaataataacaacctatcaaatctttctgcattaatcacatgttaaatgaggataaagacaccttttaattagaattttcaaatatctaaactgtggtgcttgcaaagtttcacattcttttcacgtttgtaaaattgaaaacattttactagtccccataaatctgaaaaagaatttctaattctagttttcgaaattcaaaagaaaaagaggcacgtttctgtcttattaatgtatggttttcttcttgttttccttcgacggtcgtctgtaacctcccttttgttttgtttaggtttttaatcgacaaataataattttacttatttatagggtacaatgtgttgttttgatgtatgattaaatcagggtaattaacaaatccaatgcttcatatacttaccatttttttgtggtaaaaacatttaaaatctacccccttagcaattttgaaatatacagtgcattatgatttattatagtcagcattctgtacagtaaatcactaaagcttatttcttctatctatggaaactttgtactctttaatcaacattccccttttgccatccaactccccacctccagcctctggtaaccaccattctactctttatgacttcaccttttttagattccacccgtaagtgagatcatgcagtatttgtccttttacacctagcttatttcacttagcatagtgtcccccgatttcatccaagttgtcaaaaatgacaggatttcctccccttttaaggctgaatagtatttcattatgcatatataccacatttttttaatccatttatcagttgatggacacccaggttgcttccatgtaatcttgacctaagttacaaatttgcgaactctttagattcttatatccttagtatatgagaaatatttaaatcaataaagcatcataattgtaaaaaaaaaaaaaaaacagaagaacaaatatgactgtggcagcatcaatagaaaccaattggtttgtgtaaattaaaaaaaaaatcagataaaactgaaatcagtcacttagaacaatattttaaaatcagtatcctgagcatatggtcatgtctgggttttcatttccaaaagagtaaatccctgaagatactttgcatatttttatcctctcagttagactttgctctttaaaataaaacctaccctggttaacaccgtatctccagagaaaaacacaatgcctgctacttaataggtgttaactttttatgtaattgatgaatgaaccaatgaaaaatgtataataattcttaagaaacaacaagtagtgttatctactcatagccaagtgaaaggacaactaaatattctgaagaatagcgcaaaaattgtgcttacccctttaaaatacaagtgatatcaatcgtttactagttccaaacaaagcactttctttgcatttgcttgaggcagtagagcataatggtttggggcaggcatactttttgggtcagatgagaatgggttagaatccaggctgtccttataaacaccattaacttgggcaagtactttcatttgttgagactcattttctttcttgcaaaactgggaaaatcaattttaacttatgacgctactgaaagatttaaatggcaacattttactggctatttgttaagttgcatacctgagaggactcctagccctaagagtgaaaaattaaatcaatattatttctgaacaactttacttaacaattataagagctgagtaagaaagaaagaaaatttgtattatatgagatgcatacaaaatattttagcataaaccagaaatatttttgcataagccaagaaaagagacaaaatgttaacagatttaagtggttagaaatgtgcttgacattcatgaaaatgcagtattccttatacaaaaataacaatttagttttattaggaaatacagaaaacttgaatagaaatctatttcagaaatacactcagaaatacttaaatatgaatccacagtgagctgatttattttgggcattaattaggtattctattacattatcaatcttttgatattctgcattgctggcctcataagactgttgcctgagtgaaacacatctaaagactacctcaatctaccttaaagttaaggagtagcagagaacaaatggctgaataaagagctcctcacattttataaaacatttcattgtctactgcaagctacttagctcaatttaaatactgaaatccatctttagccttccaaattatgtttcttatcagcaatgttagtgtaggtattactctgaaaactattataaacagtgtaaaaaatatgtatgtaagtcatgaaaatcattctgtttcccataatgaaatcaaaagctcattgcgtgtggatgaaagaaaaaattgagagaacagagagatggttttaaggaatattttggtgatactgcaaaccaacatgtaatgttttaaatttatcattaattcttcttgatattgcttagaattccagccatgtaggacctaaaagaattgttctgggttgaattgtggcaccccctcagagagtatgctataagcctaaccctcagaacttcagaatgtgaccttatatggaaataacgtctctacaaatgttaaaatgaggtcatttgtgtgggctccaatccagtatgactggcgtctttataaaaaggtgaaatttggtcacagggacagacatgcacagaaagaagatattgtgaagacacaccgggagaagctggctgtatgactagagtgacgcatctgcaagtgaaagaacaccaaggaccaccagggaaaaccagaagttaaaagaagcagagaataatcatcctagagtcatcagagggagcactgccctgtcagtaccatgatttcagacgtctatcctccagaaccgagacaataaatgtcaataaaccaccaatgtcttcaaactttggtactgaagccctaggaaactaacacagggacattccagagcttacagtcccataagccaaaacactgaggtgaaaaaaggtgaaatcttgctgaccaagatcttacagttacttcagacagaactctagaatcaagagcctggttttcttgactttaagtttaggcctgtcatttccccttggagaactgacagattggaaatgctaaattttaaaaaagttcatcaagttaattcctttaagctattttatttagtgacttctgtttaaactaaaaataaatactgtgactctgcccttttgatttttttctaagtagccatgctccaatttctgaagcctttttaatctaaaagataaaattgaaattcttattaacttagttgatacttcatttttatctcatgatccctttactattacatgcaagaggatgtgaaatttaaaaactatgattaaaattttacaacaaaaactatgaggaaaaggaaagtgtcataaaataccatcagttattttagttaaatagtcattttctcataatgtttgaattattgtaacctcccctaaggtatcaatatttttaacacacagatatcacggaacatctcctttctgatgttacttgtaggaacaattatttatttaactaatttttgaaaccgatgaggccagagaaagatcttcatgcatctttgcatctctagcatctagggccacaccaaacacaaagttggtgttccataaaggatgaataatacatcaattcaacaagtatctatttatcagatactatgagctagacagtcctctatatgctgagtataggataataaagaaaacacataagaatgcttgtcattattgagcttatgttctagtgagtacagacagagaagaaataagataattaaattagacggtatattggaaagtaattctcctcagaactaaggagaaaaataaggcggggagcaaaatttagggaatatggttgttgctattttaagtagggtgggaggggaaggttgtagaatttcaacttgacatttgacacttgagcaaaatattaaagaatgtttcagcatggctgaaagctttaaatcctagttgtgtcttttcacttctaataaataagaggacactgattcccagtgtacccaggatggtcctacttttacatgtatttaatcctagtttaactattaataactcctcctgtaattcttactggaatctcagattgaatgatatatagtctcattatttagatcattatctctacataatagttacaaatgtttgttaaatgaatgagtttttaaaaaggtatatctcagtctcacattttatcatttttatttgtcaagctgtttaaccactttaagcagcaactttgccatcaatctcaaaaccgtgaaaccaagattgatgctgggagagtcttttaatatccttaggtgaaaaactcaaaagatacacttatgattaacatcaacaataacaattttctctcactatgtaagttttatttagtatcccccttgtctttcatttcaccgctgagacgaacatctttatagaggtccagatggtgcagagagattatgacaatgaaaagtagctcatgctgagggcctcaaggaaaaacacgtctcggcttgcctgacagaccaatttcaattacgtacttactatgcccctcaacagctgaggtgctccctcttaccatgccttgtgcaacttcggataacacctgaggggattcatggttacacacaaaagagaagcgacatggacaagtaaaattcttcctactttacataagtgatgccacacccattttagaaataggggattcatcacaaatgatccactctatagaaatctcatgttttctgagagtaaatcttaagagaggacttcagggttccttgttatgaggacattttgaaacatcacgtgtttgtcaggctggcccaaacaatttctacaggcaggttgtcagaagaagatgccttcacctcagatgtgtaacgcttacttccctcaacccccatttcagtttcagaaagaagtgctaattagaactggggtagcttttgcgagtctgcataaattcagctatgtcaacgttgcttctgcccctctgcaaagtggaaaacagtgatgttctacataccatgttaatgtagaaataacttctatgctcatttagccacttcagcacatccaggaaaatgacattatgaatgagctacattacctagaggaaagagacagactaaatgtggacttctatacaacttaatatgcatctaatgtacaacttaagcagtatcttccacactaaatgacaggcaagttatctccatacatcagtatatgttaaggacatgacacagctttattgttgaaggaatttgaaatttccagccatacctggattttcctatatccatttattagtcagctacttgcagaagtcaaagtaattgccacattcattactgtgtttgcctccatttaatcagttttgcttaagcttctcctatcctcctctggaatccagacaagcaaaggccactatcaaaaagtgacaatgttacatatgtatacgtatgtgtgcacattttgccactgctaaaatccctttatttgcgttatgtaaatgacctacgttagtcacaggacatttacctcaatttaatatctgttatttagagtgcttgtttctggcaagacaaatgtcaacagtttttgaaaactaagcactgtttattgtttagctggcagttataaataaccacatctaacatttctgttatgtctttgggaaaaaaaattgtaatttttgtaaaccaaagtgtttcacgagaaattgccacagattattccataagatctttctttatatttccagctcccattctctcctcttgtattacataactatttactagccctacaatgcacatatctgatattgaacttactgaattatagtctggtgagttgaataaattctttgtcatttttggaaggaacaaagtctgtgtatgcattgacacacctaagtttcattaaccaacaaacaaaattatatgcaaagtgtctttcattttgactacataatatcaaataactagcttgaatgaattttatagccccaactggacatcatctccatttacagaagccatgtgggtcaagtacccagcatctttctgggcacctcatctgtgagtggacaggttacctgtcaccagcaaaaatgcttaccaattattaaccttccattaaatcatcacccaacacttggccctattgtaattacccccttcaaatggcttttctattactatttaaggtctgatttagatcacagatatgtgttaatatatccatatctgggaacagtgaggagcagaaggaaaaacataggctaacaattaatggagggaagaatgtgtcttaggcaatttcttagatcatctttagagaatacaggacaactgtaagtaaattacacattgtacagcattgaaaagtccttggatttgactctataaggaaaccacagtacactcattaagttagcaccaaacagttatgggatccaagtcaaaattatataataaaggatgaatacaacaatggcattcagggtgtcagcattggaaatatctgctttagcgtctaaatatttatttgctatacctgggaactaatctgatatccatttgtgtagtttgatcaatttgtctgtgagtaataaattagtaacccactacaaactagaaaaaagtgtacataaatgacccccaaagtggttgacctctacatgttcatgggatgacttttcatagaaccccttcaattatcacattggtattagcaagaccaatatttttatttacagattttcatgtaagtgtgcattccctcccttttatgtagcagacattttatcctggctagaaaatcaggttttttagacactgtaattgttctagtcttaagattacagaataggattatacagtatacaaacgtactgttaaaaggattttatgcttattcctatcccctcggtatttaataagagagaatccaaatcatttacagatgtctgtgggtagtaaagaaaaagtctatgtgtatagtactcattatcgctaaagaaaaataaacagatctgtgagcgagaaggcagggaagatgctggctacctggaatataagacagacacatactgagacctggacccagggacaagaaaccttagttcattcaagctcctgtcttcctggaagggatatccctatggctcttcttccacaagccattattccacaaacaattaactcctttaattaaaacatttttcctccaatggagactttgcaaaaatgttgaaaatctcaagaatttaaacctgaacagaaggtacaatatttttcaatatattaaattcttgctcctgttgtttaagtctagttttcctgatagaaaaaaacaactggatcaaagaaaatgagatagtaatggaggaaagtgatattttggttttgaaataaagatgagagactttcctttttcataaggactttagacttttcccctagtaacctaaaatacacctttgccttttatggaattgtcccacttgccatttcatttcacttcatttcatttcatttcattggtaatgggtggaagcccatgcagtggtaattgccagtgagaactgaaactacctatccgccatccaggttactgtttacattaacacacatttactatttcattgctctcattggtataacaactattctaggagagccatgcccaggtaaacaacttgatggttaattacagaaaactcccaaaagactcatcaagactgcagtaggaagtatcaaccaacagtttatgccctaaaacttctctgaaccccttccctcaaacgtctcacaatgctatttccaccaatcctaactgttacatcaggatcattatccaatctcaaccaaaccctaacataaaaaggtcagccttaaaccaaacttccaactgtcaatttattctgattctgcctttactcttctgagaccttgccacagcctggtctaggtggtcactctcactgaaggaagcaatgtgtcgtgagaaacacgctcacctgtccaaacccaaagaatggacctggaggcacgaagaacagcgaaagtgagacttttaatactagtcttgcaagatcgggtgtctggtgagcaggcacatccaggcagtcacaacaggtaatttatctcctagcacataagtccttcccccagttcctcactaatcaagtactatggcgttacaatcttcccggacgtcacctaagtttcattatcccccttgtaaggttataccctgctccacttctccgcttaaattttgatttcccaataacaaaactttcttcccttttataggctgacccttcgtctacattctgttcacttatggtgaccttctaggtgcatgaccatgtggtttgttacatttgcaggctggctgccagtatttagatatatcatgccttgaaaatggaccattgaaattatattctcacatgtactcagtttgtcttatcaatatttcgtataggtggtatttggggagcagccttttgacatcatccatttcttacaaaaagagaagtgtgtgcagattagtgggaaagactgttctagtaaaaagtatacatcatattatgataatccttcctgaaggaaatttaacctctggtttcagacgccacccaggttttcctgctttttcgaatagtcggttcgtcattcctcacgtaaggaaagtggtaaacacactaccagaggccagagcaagtatcatggaatggaaagttataggagagtcatttaataaacatattcactgcatagtgtggtttagccatcctcagctaatcattttttttttttgaagcagaggcttattctgttgttcaggctggagtgcagtggcgtgatcacagttcattgcagtctcgacttgccaggctcaagctatcctcccacctcagcctctcaagtagctgggaccacaggtgcacatcatctcacctagctaattttcaaaaattcttttgtgtagataggctcccccatattgcccaggctggtcttgaactcctaggttcaagtgatcctccctcatcagcctcccaaagtgccaggattaccatgcctggctctcaactaatctctgaatttaaaaaattgcctctgagaaaagtaagggagagttctctattttgtatggatccagagaatcatttcaggcatcaacataataccaagaagaaccaagccacaaaaccattatgataatgagctaccatctacgaacacttactatttattgagtacttactataatccaggcaattagaatatactgtcactcttaatcttcacatcagtcttatctggtagatgttatcgtctcaattttcaaaagaagaaaatgcttcagataggttagggaaccatccctgaccacacaaactaaaactcctctattccaatcatcctctattgaaacgtaatgacttactttcttcatggcgtttttcaccatctgaaattagcctgttcatttattcacttgttaactctctgtttttccctcacaaatttaaagttcagattaggaacctcaccatctatctacctctctaactctactgcctagagtggtacctggaatatggtggatgctcgatctatgtcaagtgatacagtagcatattccacaaagaagcaagggctgaaatatgtgtttaaaaatttccccacataattctgatatgcttacctccctccccaccacagatatgtctgatataaatatctacgctgacacactgaaggaaaaataaggctttttgaatttttatattttctgagggaaaaaaaaccagaaaatttatgtgaaagctcactttgactgacaaaagtgatgattctctagcaatagcacagcccatgaatttgttagcttgcaatcaactgctaatagcacatttcagtattgctgactggctttagagattactgtttctgtgttgtttttcacattaaaatttcttttctagcatcagacagtgagttactagctatagggagtaaaaggcaggagtagaggaggtctgtagaatcaacttaaaaaattttttttcattgatttagtcagtaattccatacattttttctgaaccacgggtgaccttcatacacaaccaccaggttgttcattttgttttgtgttttagagcatcagtaaaacatacatggtcttactgaattctcagcaactaaagccaccacagatctgccttgaatcggtattctcaaagtgtcaggtgtaaggctagaagagaaggaatgctcctcactccaatcaatttgctcattcaaatcaatctactgcactcgccagccagttaacaacctctgggtcggcaagcaagactttttttttttcttgcttttaagatgtgaatcctgtggtatatttagctcatgctactgtgtttgtcttactgtctctcagaaatgtctttaccctttaaaagatccataaacattttcagaaatatggtggcaataaatagatcttacaccataaaaggcattctaaagaaatagcatagaccaacaaaaacagttcaaaaaaatattttctgggagcagttgtaccatggaattcctcaaattgtttttactacaaaagcaacaattcaaaaccaaattgcaattcaagataaaaatatgagtgatttatgattccctctctaggagaggaaaaatatctttcctttatccttcctttggttcatggccaagcccctataacaaaagacggattaaaaagagaaaagcatataaatttattttacagaagttttttgtggcatgaaaagtttcataacgaaataatgaccttaagaaacaggcaatcctacaatttttaagctagttttgataaacaaatggatagtcatggaaaagaatgattggataaaaagtatgctctagtggtaataaactgggagaaacttagtaagacctgtcggatcagattcttctctgtaacctttgccaaagataaggaggaacttatattctcggtattggcaaggtatctctgacatgagggtcttgtgacatgcatcagggggaggtgagaaaatccttcctaggttttgtggcctgcttcaagagacaagggaaggagaaggtcagagcatgaccttcctacttcagtgttctttttttattattattatttttactttttcaaattccttcttaaattattttaaagtaattgtgaccagaaccccatcacctcacttaaaaacatctggaaactggcgtttagagggatatatcatccgtcaaggtcagaggccaaacaggtttctgaataaagctggattgaaactaggtctgactgcaggggaaacaatactggagtgctgggaagggaagagtgtggtcgctttaaatgatacagaagcggggaagggaagtgctgggtagagaaaggccagtccctggctagggctccacccccacggacccaggtgagaacaggcatttcctgcccaaatgttgcatttcccaagactaccctggcccatcctgggcctataaaaaccggagaccctagcaggccaacacacagaagcggctggataccctgaggagcacatcagcagaagacgacacaagctgctggacggcgagagaacatcgagaggatgtccagggagcacgtcaagaggacgtggagggagtatgcaggtggaagagcacaccgacagacgtcggcacagcagccagccgtccaccatcgaaaggtggcggagtttggctggagcgaccagagaagagtccggctgcaaagcggcctgactccaggggaaaaccatctccctctggctcagccatcagctgagagctacttctactcaataaaacctgccactcattctcctagcccacatatgatccgattcttctggcacaccaaggcaagaaaccccaggatacagaaatccctctgtcggaaggggatctaatggatctggttaacacaagccgcctatagacggcaaactaagagagcatcatgtaacacacgcccactggggtttcaggagctgtgaatattcacccctagacactgccatggggtcagagccccacagcctgccagtctttatgcacccctagacgttcaaacagcagggcactgaagcagccagccacatccccatcgcacgccctgcgagggggacaagggaatctttcccatttcagaagctggattgaaactaggtctgattccagcaacaaagctccaagttgctggcactctctgccatttgtcctcctaatgtctatgctccctaggaaagttattctccaatgggtcaaagttatcatctagtgtgtacatgttcagaaaagctaatgacatatgttagcggagctgccccctacagctctgcttcggtttgggaggcaattggttgctttgctatttaccaacaatttcagaggcgggagagaagtttgaaggatttctaagggatagtgagggatgaaataaaaacctgaaggaaaaaccctgtggggttttcagttaacattccaaaaataattcagagactaggactggaaaactttgtataatttattttgcttcaaattattatattttatgtctcttataccctaaaatgattaggaagaaacagctaatagaacaaatacaccaagactggtctttggatgtggcaaaaatgccagggtagtctcttccaattttgtacactcttggagggaaagaactccagggattagtgcataaactggctgctttaaggaggacaaaacaactgccaccctgggatttataggaagtgggcaaaggagaatgttaaagttgatccatgaggaacagatttgccttaacgaaagcaggtcccaggcgattccccacatacagcgccttctctgtccaactaacccatcactcacattgctattcttgacagaaatgtctgtctgtctttttttgtggttacaacattcttcaaagaccaactcaaatctctcctcctccagaaaactctgttgatcactctctaattgccagcatctccagaatgcttactgcctatatatcctgaactacgtaactcggaatttaattttataagtgggcaagaaggtcttaaccttcccttcaacttgaccaaacttcacacaggtttgttactgaccacaggcccttgatctcccttttctaagaggatttactttagaccacttggaattgtaaattctttctgtgttcccttaacacgtaaatcttctgctagactcctgtcagttttacaacccaggaatgtctttctcaaggtcctgggagccatcccttttgaaataaaatcttcaggaatgctactgttactatctcccagtcttagggtgaaggtaagagcctaacctctacaagcatcaattagcaaacacagatggcctcgtcaggatgaccaacgttacccaattaagttttctaatacttttccacttgctcaccccagttatcaataactcttcttttgtttcagcacagttcagttctctctctctctcctcttgcaatagtcttgatccctgttgcaataatcttaagtcttccttacccgcttgtccaggataacttctctttgatacactgataaattcagtagctatttcctgtgtgctatctttcttagaccggaatataagatcctgtaactattttaattgaataatgtggtctttctggaaacttctctgttaatatagtccctctcttcccctgtttactgcttctaccttccccagtacacacacacacatcattgacactttatgactgaattctaagttttttaaaaaatacgtatttgtccaggtgtggtgctcatacctgtaatcccaacactttcggagactgaggcaggaagatcgcttgagcccataagttgaagaccagcctaggcaacaaagtgagacctcacttctacaaaaattaaagaaaaattaaagaaaaaaaaatagccaggcatgatggtatatgcacctgtggtcccagccactggagaggctgaggcaggcagtaggatcacttgagcccaggcagttgcagctacagtgagctgtgattactgcactgcactccagcctgggcaacagagcaagacctgtctcgacagaaaaaaaaaaaaaaaaaaggtgttttgttgttgttgctgttgtttgtttgttttaaatacatatttggacctcccttctccactgctttttaacaaggtgctgagtggctaggaaacattcagtaaatactagtttccttggtggtcaaaatatttttcttctctggaactcagaaaatagattacagatgaaatatacgggataagtcagcctgtggtagtcacctctaatgactattttgactttctttcttgcttcagtcacagtaggctcagagtccttctcaacatcacatttcaggcagccagcaccacgctatcaaattccgcacataaattgaaacctactagcctttcttaaagatgcccttttaatctaaagaatatttgattttaaactctgttttttgatgagattcatcaccttcatgcttaaagagccatttattatttggtaagtaaactagttcacattccttttaaaaaatcaatatcaaagattaaactaaggtttttttttttccacacatttgagttgcgaaatcactggcagagggtgtctaaaatgaaatagaccaaaatatgctcaaaaacaacagatttttgttttcttgaaagacaagaactttcctagtcagtacatcttctaaaataaggcccttagaatgtgattgcctagaaaatattcactgcttttcttcttaaagtgttcattgttatttttgaagaaatgaagcagagtagaatgttaccagttttaatagccatcacttttactcatcatctttctaattcctagggttcaaaatataaaggaaagaataaaggaaccaccataatagattatgaaacatagagatgaccacggaaatggtcttctaagataaaaatacatgcaatgaataattgagggagaagagtcaccatgcagtcacttagtacacattgtttcctgccttaagaggagccataggtctaggcatttattccccccaaaagtgggggtgagggtgaggggtgagggtgacgggataagactggtttcaaggtaggtttctagttgattcaataaccaaggtaaacagagaaatgaggtgattcgagtttctcagggactctcaaagacaataatatttaggtaaacaagaaatatataagtgttttaaggttttcataatttctattgctttactatttttttaacccctggagtaagtgggggtgttgtctgtcttgctgcaatggcctcctctctctgaaaattgttgcctcttcccatccacatgttgtacacactaaggtgccaagtttgtaccttgacacctatctccagctactcctgtacatcaggatacacaactcactcaagatgaccaataccattttcagaaaatttgcaattgagtgtggcttgttagtttaaaataaacggataaattcctaagcagtgagacaaaatctaaatgcaacacacatggaaataaaacatacaggagagaccaaaaagggagaaaaaaaaatagaacaaaaacatggctgcccaaggttctcatcggcttttctgtcccttcatcaggccctcgaaaggacccttaaattctgtaagatacgcctgtgtcctcataattcattatttttgctaatggtaacataaatgactttctgtagttaaaaaggaaaaagagagtaagatactcttaatagtgcctttgtttttataggcagtaacaatagaaaacactccaaaggacgcgaatgtctttttagccacagaaaactgaaggagaaagctgtgctagcaatgatctgaaaggcaagggacacaggtggaaggccagatggttgttgccagaaggggagaaaatgggccaagttcttgatacccttgggatatagagatgcaaggtgaatagaatgttggccaggagacacaactggccccaaaggatttgaccaggcaaaaggcactagtcactcatagctttacactatgacagttgaaatgctttttaaatgggttctagaatgttatacatggagaaaatctactctttcccctatcaggcaaaaaaggcaagagggaaacaactttaagcaagaatgaaaatgattttttcctctgactaattgaattttgaggagccttgaatgtccctcttatttcattttcttttgttgttacgttaaaataatcaaaaaatagttttttaaagtttaaaatatgtctgcctgtttactcagaccccaatggagggtcatatttctgtcaattctttgattgtcaaaaagagtcaggttctggtacaagatctttaacaactgaattactctgaattctgttttactgcttaagaaggatggttatatttgtctttcatagaatctcagagttggaaaaaatcttagaaaatgtcaaatttaatttctcattcatatatacacactacctgtgtcagtactttcttgatatttttccttaagtagactcagtttttacctcttaataggaatttaatagaaaatcaataacatgaactaaaaaccagtagcatatttcagaaatagaaagtattcatttaagaaaatgttcatctgaatatcacctaaaatcaactggcatacacatattaatgataacattttagttgaaatagagtcctttcctcttgccatctaacaaggatatcatgaaaggctttgtaaaatattgtgctaagaagcagacagctgttaatcccaaaactcttcactctaaatggaaatctctttcatctaacttggcatgttcttagtaaatacaccttaattcactctcagtgtccactattgaagaccacatatacccaggaagatgctgtgacacatgtaagaggagcagttctttgtagaataaatgctttgtaatgattttattctctgctatctgaggactatctgtatatattgactacttgcacaaacgaaacttttacacattctatatgctcacatttcttcaacatcttactgaacaaaacaatttcacagtaggataccagtgaggattttcataatgaaaatctgcatgagagcacagtaataacatgctataattgctcagagagaaataattcttcatgtccaagtttgccaatggcacactccattattatttgaagtggaacaggtcacttaaatttctctgtatccatgtcacaagtttcatttaagttgtgcgttttacttgcaaatttacaaagtgaaatatggtttattagaagagatagtactggaaattatttgtcagatgtcttttgtagtaacatttctattcacatcttagcttcatgcaaggaataggaccatataaaaataaagctagaacacaaatcatcacatattcatatgtcaggactctgagcttaaagaagaaatcccttttatatctgtgataaactcagatgtctagctttccctgcaaccatgcatatcccttactggataaattgctaaaagaggttccctatacaaattcttatccataaaagcaggcatcctaatctgtacttgtcactgttattttctttaatatgtaagtcaattatagcaagctttaaatggaacctaatgagaaattctcataattaaagagaaaacagtacaggaacttcctgccaatataaactgttaatttcgcaacacatgctccatagactttttccaatttctatattttattcacactgtgtgtttccccaaaataatgcttttaatgaaattttcccattgagtacaattttcttaatttaaatgataactacatttttaatctgaaacctctttaagatcctcattggcaaaagacaagattgagaatcacttccattttcaggaaattgtgtaaaatcagcatggcagatatagcaatagatgtttctctttattttccactttgagacctgggagcttattatttgaatagccatgaaaaacagaatggattaacaacaaaaaaagagatcatacacatttttcttatcagaagtcaaaatggtatttcacttaactggctaaaaatacggaatgtaacatctcatatattaatgcatcttcctgtaagatctgttccaatatctaagcatatccaaatgctaaaatccacagaacagtgcaaggaaaaaatactagtaaaacccaatggaaagctaccatcagaagctgagtgtattcatctagctttgcactgcagtaaagtacattccgtagagtacattctgaatagcaatagcctacctttaagctgcactgtcttacatatttcaaatcacactttgtttgaaagaacagactggttatttccaagatatctcatgaaaaacttattatagttcgaggaaaataagagttgaagccttggcggaatacccaaaggcattttgcttttctgactactattcaaatcttacttggcccaacttgacagccattctttctgacaacgttaagcggtttcagtaagtggtatgtaacctgcagttttctttcacttgggatactgtttatagctaattcaggcacaagggactagaaaacataatattttcataactataaattacttttatgtggtttctcaactactatgtagtgtaggatgatgtacaggagtggaagaaagaacaatgagcctggacaggtttttcaaatttgagcaacagaaacggatttaaaagacagattacagggtcctcactccagatatttgaattatgtgcagggcctgaaaacctgtgttttgaaaaatctctccaaattattcttatattggagtaccttctctagacacaccggggttgagattaactaccaaatattaatagtgtgtgactgttaagaggaagaacgtggtgcagtggggtggagtgtgggaggtggttcaagatataagggaagagaatatattactttatttattacttcattcagtcatttattacttcaagtagacttcataaagaaaactcactttgctttgaaagtatcttaaagtataaaaaaaactttaactttatacaagcaatgaacgtatgtttcaaatatgcaaattaaatattttaaatattccaaaaaaagtatccatcttaattttatcaaaaagaaaactgagactcaaagaattccactgacttgtccagaattacacagctaacaaggtcaattacaactaaaattcaaattcaattctgcaaaacttatggtctttgtaatactccatgctgcttccttcaaatagtaagttaatttatcttggcctcactttaccaatggccaaaatgaaagaatgtgccagaggttgagaaatgactaacccagtaattatttaaaacatccaagggaaggtgtatggcccaatagcaagatttggccgaaagaaagtaattaggaaaagaacttcttggaaatttaaaataatttttttctactttaaacaaatatccaaaataattttccttaatatttaaaaagaggaaaggacaaacattcattgaatatcttactatgtccactgactatcctatcctgcatgctatacttaaagtgtattatttgatttaatcctcaagacaaacctctaaatatagttgtactgaatacatcatacacgggaaaaagtacggttaaacaaattaatttgtcaacaattgaaacaaaaagtccatgttagaatctataccgccttcccttaaaatcctatgtctttctaatatagagaaagacaacatcatatgcaatgagcaacagaacacgagtagcctttttttttttttttccaccatggaaagccttggtttctaaaaatgcattgcatgagacctttgtaattatgcagaagacagctggttattctcagttttccctgaggaaagaatgggagataataaacttcaaccatacttgtgacatttagattactgggaaataatctttagaagtattgggcttctagaagtattaggcaacaagagcttttagagtcaactatggatgaggaccttcaggggattatcaccttaaaaatcctggatcatttctcacttactggtattactcatgcacacccctcctagcttgaaagcaagagaaagtctaaggagactgctcagcagcttgcagcactgtaaatttatgtgcaggcactttcaaaacaacttcagaaaacagatttccctttcaacttacttgtttttttcatttagtgtattctatcagagcaagtccaagacaaaagctttcccaagagaaaagctgagataaggaataatgtattcggtgaaaatatgtaagatttattctaggtttatcattcagaccaaacctagtatctataaattatccacatttccccctaaattttatatcatcacaaatgtacatcaaaacaggtattcctttttaattgtcgtgaaatatgttatctcaggcaagtgtaataacttgaaaaatattcatgatacttaattacttttgttctttaattcatttaacttccctctgagggtgttagcatttcctagtatttcagaacaatggtttacaagttgtcttccacagcaatatcacgttcccatgtaggaatccctatggacatgattagtttagatataaatgaggtttatcaggaataattcccagataactagctctagcctatcctattctcacagtaattgtcatatccagtgctccagataccacaagagacaaatgcccttttacattgctatcaagggccagtattctacatttatgtttagattaagttggctaaacttttgtatcagtgtaagtgctaacactgacgttttacagaagagcttgcattttagttgcatatgtattaaatgatttggagactattttaattactaagatgctttgttgagagattattttgatacatttacttcggggtaaagttgagctgtgtgccctctgagtcaatattaagaaaggagagaagaggggatttgatattgtcaggataaactaaaaaggaaagaagaaacttggttggggcaaggatagtggggtgggggaaatggtgaagggtcagttaaaaagccagtggtggctacatggctgggaaagaactttggtgagtagatgtgtctagcactatttttttatgtggttgatttgaggtgtgaaaaattagcttccacccctttcctttgtagaggatgatcactggtaaattatgtgtgactcactgatgcttttgtggaagtgaattctctttggagagcttaaacagaaaaatgaagaagcagttaacatctaggttttcgaagtatatactcagagatcaacatctttgaagaaagatatacaaagccattaatttctctagagagtgcttcatcatgccccatgagtttataattcttcaaggcctaggtcaaggtctattttctccaagaaactgtttctgattatccatccctcggtgatcttcctcccttatgtaaccctacaattctcacctcctgtgccttttaatttagcatctaatactgtaattcataaaaggcctaatcaaaatagattaaaaaaaacagacaatggaataaaattcagaccaaagcctagcaaccatcttattcattctgcatcggtactggctggtgacagcttacaccacctgctatacaatgatgcaatccaatgtgcgagaatctttttttgttacacctttacatgtgctttcaggtgttttggttacagctatgggtatcagaattttattgatgggtgagcattttcttttcctaagacctaaaagtagcaggggaaaaggctcagcatgttttacccaaatagattttttttttttccgaatggataaagacaaactttggagccaaatgcttcattgtttgtgcataaatctcaacaggctggttgaattaagctctacatattcatcaacaggcattgccaataaagacacaaatacaacaaattaatatttttcaaaactctgtgtcttcagaaaatttctatgaggctttgatgaacaaaacacaaacataagaagcaccaccattgtctcactgtttgggcgcaatcattctcaaggacatctgtgctgattccttttcaaacttggatggctgctatctgaatcaggcccagatgcttttgttggaaaaaaaaatctgaattttggggttttcatttaagttgagtaacagctttctccactcaaacatgcaatttattttacagtgtgagattaatagcaataattgcctgggaaataaagaagtcttgaagaaaaataccacatatcaaaaggctacttaaaaaaaaaatgcgggtctttgctcaagcaatgaagctatgcttcttatttgcaaatcattctattataacttcagtcatactatgcagactactttaaacatctgaaatttaacatctgaaatttaaacatctgaaaattttaagtttttaaatgaaaaatcaggagggttgatattaggcttgtaaatgtaatatttgcatttacatatttctatataaaattgcacaattttatctagaacagaacccacctggcagtcttaacacaataattatttgcctaggggcccagaaagtggccatcagtagagattcaatttttctgagatgaaactattgagtgaagtgcattccctccttgataggaagcccaactgagagataaagttttgatggattcattaacagcccggcctgtaaatctcatctccactgagattttaaagcaaatggcattattctttcattatgctgaggcccttactaccctgttccgagttggtatttgaacctaacggcctaagaatatttataaagtgaagaaaagtaagggtacatttttttttcctttattttttccctcaaggcttgtctcacaagtgcaattacctggctctgggtccaggaaagccaggtctcagcatacagaatacattcacactgtgtcttccagcaacccaccagacctctgcatttcccaaaccacagtacttctcaaaccagcacaccttggcagtgctagggggcagtgcacagaagccagatttggcaagagagaaaagggaaaatatttaagtgtcaatgtaaagccacagtacactgcatgattttattcagctcataaaagggttatttctaggagaagtaaggaattctgcaaacatataagacaaaatcagaatgaaatgattattcaaagaaacagaaggggtgcaaaaaaaagagatgtctcctaagtcttttttgaggggaaaagggagaaatctaataaatctaacagaaatgtttacaggttggttacaggtattttttttttttttgacagatgaacacattggaaaggtggtctgggacagatgtcaacaaaagggtttgccagtataatgactgcaaggtgcaactacagagtacccacagttctccatctcaagtaaatcaattcagccttgagaaactactttgacaattataaatataaatatatacacacacgcacatattatatacacacacacattatatacacacacacaattatgtttgtgtgtgtgtgtgtgtgtgtgtgtgtgcaaaatacccagaatgtcacttccctccccaaactgatatctgtatacatttctatgttgtattggatacatatttataaattcaaaatttggagatacatatttatggataaatacctatctctttgtaaactacaggcaccaatatagcagtttttaatcttttaaaatctagtttagcatggaaaattatcctcattcttgttctttctgaaaccctcttactttatatcatagtattttgatgaaaaagaatacaagaagatcataactctcaatcaatcaacaattatttggtggtgaccagtaatctgatcagccttgtgccagttgctttgttgataaaaggactcaaaaccactgtcctgacataaacaagataacaacatcagaaaaaaaaaaaattgtgaggtatgtcacttatctttctgggtctctacttgcttgatttttaagaatcatatacaaataacagcagcctcgtatttttattctgtttatagaaatcagagattatatatgattttagagaagggagaaattagaaaaaactctgtggtttgaggtgcgacctgcagaggtcctgacatgtggaagggttggggtgaaaagatgaaaggtgaaaggtcatttctgaccaggaaaacaacacattgcagaggcacagatctggaatttgtatagggcatgtgggcacttgggaagaggacattaaccagctcttatggaaaggagtagtttgcagaggcaaggctgagtcaggcagaggtagtcctagaaagccacacaggagtttagtttggatgcatgggcaagtcatgcatccattcattctacattcactgctcatttcctgagttcttcctctgtgccaggccatactgaaaagcgatgacccagagtgagagaggataggcatggtcccagaccacatgaagtagaatctaagactaaagtgccagatttaaaactgtatataagtgaagagtcttcacattcaacatgacatacttataaagattttaaaaaggtctttgatgtttcatagtatctaacgttgttgcctagttctctcaaagcataattaaaaatgtgattctcttgacatgttataagcaataaaatttggggagaggaggggatttctagatgtcaaagtaagtataaatgggcatagacatgattaggttaggctgaaaggttggttggtcattgtttacagttggtggtagaacatgccaagttagatgagtcccaaagagattttatagctatgagatatcatcttgtgtgttcctggctttcagattggtacttgtcaccatggaattctagagcagcaaggaagtgcagatcttattattttgagacagagtctctctgtctctcaacctggagtgcagtgagatgaccatagctcactgtagcctccatcttctgggctcaagccatcctcccacctcggccttccaaagtattgggattacaggcatgcgccaccacacccagctgccgtactttatttagtttcaaactctattttctgaatgatgaaggtggaattcaaattggtcaaggattttactaaagccacacagctggttagttggcaaatcctgagctaaaaataatgtatactgattcgtataaccacccccacctttaccaagtttgagatcagattttaagaggatgctgcaatctctattctcttcataaccagaggagcgtttagtccatggtcctggttcccacagtcaaactcttttggatctataatttatttgtgaatgaaaacaagccattacaaagtggcaataaagcaaatgtagggtgtggctatagcaataattaatcataatctcaggtcccaggtggttcatcttgagctgatatttttttcctactgtttgtgacatgatgaagatataaatagattttaagtttaaatggaaagcaaatccatttctctagcagttataagtgtattaatagattgtttagtcactcgaacatgtttataatctgttattttcttaagaaatactctcagggctgggtgcagtggctcacacctgtaatcccagcaatttgggaggctgaggtgggcagattacctgaggtcacgagttcaagaccagcctggccaacatggtgaaaccctgtctccactaaaaataaaaaaatcagccaggaatggtggtgggcgcctgtattcccagctacatgggaggctgaggcaggagaattgtttgaaccagggaggcagaggtttcagtgagcagagattgtgccactgcactctagcctagaggacaagagcgagattccatctcaaaaaaaaaaaaaaaaaattcatgctagtatagtaggaatcagttgcagagtcagggaagctaagctttgcaagaaaccttggaccatttttattcagtggtatcataaatttatttggaggtacgatactttagaatacacatatacacacacaaaacacatttgcttattatgtcagggggttcctacatcttttgaagtctctcttcagacccacccttagctaagaaaactgatttggtgcagtcatttaacttggtacatggatacatttctttcagcattaagtggtctaaggtcaactcatgtgtaggaaggtcctgagtcaggaaaggaggaatactagacacatcatgttcatttcaggtccaatcccattgcaacgctgggcaagataacttacagtctttggccctcaggttcttcctctgtaaaaaagataaatgatcacagtagtacatgactgctgtttattgagtacctactgtgttaatgctaggcactttacatatttgctttcaattactgctaatatcaatattttgtagtagacatgaatcaccttttcacagatgagaaaaccaaggattagaaatggaaatgtgcctcatatcacgaagtaaaaagatccaggatttgtaccatttgtctccaaaatgcatgtccttctctatgatatggaaattcctacttgtaaggaataaggcagcctcatttatctgcctacgtgaaaagagccttcaaaataatattataaaaaccagagtttcatatcaatgtgatatagttgagcatttttataattctagagaacagaatgaggcaggaatgagagggaatatgaagaaaaggataacaggataacattctttatgatggggtacctgatttttggtgtcactgactatcatatttggtaaggtagtttataaaggggtttagaaagttacactaacagcttagaagtccaataatattttccttctaaagtattcaaagaaagaacaatgagataactttaaggagagtaaactggcttttcagatgaactttctgaaatgattatcaaaaagagctctagttttcttatgtctaagataaattattacaccaccgcagcaatttcaggtctggactgcttcctgagtgtagccccaaataaaggtcctcaagacacttccaaatatgcaaatcagctgagtgggtttgtgtgtgtgttaaactgtattgagtttcagagtaaacctgcttcagagtcagctagggaaacaaaccacagtttgattttagcagagtgaaggacaagcacagtccatcccctttcacaccccatagcttcaccaggtatcagcacacagccctttaaagattaagctctaaatggccacactttttgagactttaataaaaaagctttttacagtatttctcctaaaaatgtctgaaaacaatttgttttcttgaagccaaagcacagaactacagcttcccctcctctccctattattgtgatttccaaatgaatggcattgagttgattgtttatcatgctggataatggcttaatttattacagaaaccctagtcagacattaaaaaactgtaaaagcccactgatctaccaaatccttttgagacatagggcctatgcgcattaaaaacctgctagaccatggtgagcctatgagataggaaacttttttgtctcattagcaccaggatttaaaaatacagcacctcctcaggttgaaatgccaagcttgagactgctgtgtgcagctgggtgtagaggacacctggataagtcttaatggtgtgtaaacagcaggattagtgtttctgagtctccgctgtgcagagattttccgttggcttactcaatttacacacaaaaggtcttaggttcctttgggaaaaaagtccagctagacaaagaaaggacagaggaccttttcctttcacagggtatttggattcatgcatgcattcatccatttaagaaatctttcccaaaacatcaactaagacccaggtactgtgctaggtatacagtggtaagcaaaatcagacatgtatctgatcatcataaaagctaaaaaagctgtgggtcaaacacacacatgaacttcagcctgatttcaagctccctgaatttataggaatgtcttatttatcttttcattttccaagagactagcagagtgacttataaataataggtgactaatacacataaaggtaatggaagtttttaaacaaagtgtgtatgattagttttaaagtagtaataataacaaccattgtcatttattgaaaccatactatgcagcaagcactgattactcgaaataatcttgaaataaattgataggagacatttaaaaatctatgtagaacccacaaccccccataatactgccatatcacaaaaaatattcatttctcctgcgaagctgaaggcattaagatgctgtgtgtactgatttttaagaaagtgtcccaaaatctctgggccttttccaaatgcctatgtgaacagaggagaaatttgcagtatctgtgagacgtcctttgaaacttggtttttgatgagtgcactgtgtccaaagcagtggttttcaggtatcaagaagcacccggaagaactgttataacacaaattgctgtgctacatctccagagattcagcaagtccagggtggggcctttctaacaagttctcagggaaggtcgatgctgacagtgtagggatcacattttgataacctgcctttataggatttcagtttcaaagtctgagtcctactatgagaaggctctctttaagaatgtataagaggaaaagagtgcgtgtgtgtgtatgcggtgagggggagaaaaatgaatggatgaaggcctcagaaaactctctgtggttcacctccatcccagaatgagcaattgtagttctagggtctacagacaggtgaaacgacagaagacagctaggaacagtgcaagaaatattcaggtattatctttcagcttgattactagaggataaagggaaaggaagctcttagactagaaatcccttgctatcctgtaatttatatttcattacaaaactaaagaataaaagtagtcttatccagagaggggaagtcagtccaaattctggagattcctaaaattagtgtgtgtctctgtgtgttaaatcatcccagttttataaaaaaggaattgaggctcaaagaggtcattttggaggatctccaggatcaaaaaggaagaacaccaaaagctgagtctggtccaggtctctctggttccagagtgtatttacccattggaattattctgtctctgccttctctaagtggctccaaatatataaatgtgtgtgtgtgtgtgtgtgtgtgtgtgtgtgtgtagtagcacctggcacacagtaattcccagtaagcatttgaaagttttttttttttttttttttttttttttggtggtgggggtagtagcacctggcacatagtaattaccagtaaacatttgatagtttttttttggtggtggggggatgtacatacatctactattaactgcttactgggaatgggaattactatgtgccaggtgctagtcatatttatattagctcatttaatcttaaaaacaatctgagaaggggatcttacagaatcccaattgtatagataaggaaatagaggattaaataaagtctcagaccttggagaacttgcaaaagaaaacaaacaacaaggacaaaaaaacgaactccaaaccaattttacctcagagctagaatttttcatgttttttctttcctaataccagctacctcccaccatttggccaaattggtctgtctctggctctttatttaattatgtttctacggaattagattatcagtatcaaatttaatatgtaaatgaaatatccaagaatataaagatttctactgttgaatatcaattattagagaaaaatgtgaagagttccaccacattgaaactgtggctaatggccacattagggatgatttatatctatattagagtttcagttaatgtgaaataaaatgtatccttagttttttccattctcaaaatgaaataaacctgaataaattattatgaattgtgtactatcttacgacagctttttgcagttaaattgattaattgttattatccaatgctgaaatcattttcttgtgataactgggcaagtgagttaaaattttctaaggagaccaaaggcaatccactctgacacaaggtgaatagttttaagctaaaggtgacttccttgcagtatccatggctgtcatgaaagtagatgttaaaatatcagatctatttaccctcttcttacttcacaaaacagaatgagttatatagttataatttacacgcctctttaagggcaagtacaatgccagtgctggtctgtactgacatagagataacactggttaacaacggaatgattatattataaaaagaaaggacaaaaaaattgggttagtattagagtttatggaactcagagaatgaggccaattcatgctactctggagaattccaaccagctacaagcacactttccttaaggaaaaaacaaaaactgggttataattcattaaacttggctccttgaggtctgatgagatgagcacagggaacctgctctcttagcacaatcactactaactgacaatgtagtcgagaacagggtctgtttccataatactctcttaagctgtttgctcccaatactcttttaataataatgaaataaactaccttctcaatttttcatttcagtgctaaaagttacttatatagttttctaaggaagttcaccatgagcattgagtttcagaggcatgttgaactttcttaggacatctcatgagctttttacttttgttttttcacttgatgcataaaacccctaacagatacagaatatattcttctttaaacatttctaagggccctcttcccatctcctatgtagtgacagggcaaaaacactgagtcctagatgctcatggcccctgattaagacctgtggttgggaattcatgggaccctatttaaaccacctgctttgatggctcattgaaatcagaaggagatttttactctctcactgacactgtataaatgttagttcactacagggaaatggttgagaggggacagacggagaactgtgaagaaattaaaggacctttaatggattaaaaacaaaaagccattctgctctccagggtgcacatttatttagttagattttcttaaaaatattctcaagcctccaagttcaatcgaccagaatgactttaaaaccttttttttttcctgctccattggagagatatgcctttacatgattactttaatgacaattatctatcaggtaattgcaatgtaaagctaatatgtaagtatggcagaacctgtgaattttacaagtctaatgtctccagggtattttaaaaagcactttggctacatttttaaatctaactaaccattccaacagacatgggagttactactcttgggcaacattcaaaagaatgggtaaagttaaaaagagtaattttctgaagtatttttgacagcaattaatttcacaggggatacattcatatcctaaatctccaggaaaaaatttttttcactgtagaacaagatgcactttttgaagagaaattcctttactagagtttatactttataatgacctgaactgtagaagaaatataattaagtggattcattactatttcttttaataaggtaacttaattgcattttccccaaaccgcagaaaatttacagttattgttcaggcctaaaaagaaatacagttaatcaacctatgtgtccatcactggatgaatggataaacaaaatattatatatatatatatatatatatatatatatatatatatatatatatgcatacacacacacaggaatactatgcagccataaaaagaatgaaatcatatattttgcaggaacatggttggaactggaagtctttatgtgaaacaattcagaaacagaaagtcaaatacttcatgttctcacctataagcgaaaggtaaataatgtgtatacatggacataaattgtggaataatagacactggtgactgggaagggtgggatggagggagggcgggagggggtgaacaatgagaacttacttaaatgggtacagtgtacattattcaggtgatggttatactaaaagcccagactccaccactatgcaatatatccctgtaccaaaactgcacttgtgttccttaaattgatacaaataaaaaaaattaacttcaaaagaattacagaaacagagttacagaaacaagttctatacataagcatattatcataatttattgttaaagaattaaaattattgtagacaattgatatttgtggtcttttaaacttgatattaaaaattgagatcaaaatttcagagagactcattgacagcattttatttccatgttggcaatagttctcttctcctaatggtcatttgaggaaacattggtttacctctttccccatctctctgtatacacttaaattcaaagtataaattgtaggattaccttaacattcaatgtatagtcagaaaagaaacataattaagaaatataaaagcttatcatcttgaaaaattagttcctaaatgccaacttggagattttaaactaattttaaggcaaaacaatgtaatacaaataaataacaaaagctgatattcttcagtatagaaatgccttcatgttcatagtccaatcctctttaggccttcagacacaatgccattgtgttttctcccttttttaaattcatgtgataatattgttttcttgctgacatgtgatctctttttataaggaaataattctttaagttcaataatgaagcaattaataacagtctgaaataatttagatggcattggtcctttcttctggaaaaacaaaccaattcattggaattctcttattcaaagttaaaaggctgaaattactatttatgtaataaaataatgagaaattaacaagcaataccttcacgatgacagaattattattactattgctgctactactgtaattctcaaaatttttccttagaaacaatttggaagaaaatgacacagttaaggtatcctgacttaaaagtaagtcaaaaaaataaaaaaaaaagatgactattaaagttttaatcactctgaggagagagaatggaaaaaaccacatagaagaatcaagctgaagatacaagttaaatcaaattttaaagaacattgatatgaagctgtgaccagttttagaggtttaattagtaaggtaattacatatagagctactgatgacacacagcctagaggttctatattaatgaaaattaactttaattatttaatttgtctaattaaaaggtagttatgtcactagattttgaattacattaagccaagtacaacacattacatccttgtgtccaccaaaacccaacacattcttagccctgttattaactcaacataagtgagttgatttgaaatttctagttaattgacaatttaaggcattaaagttgaaagactcaactaattaaatacatcattcatttattgaataaacagttgctgagcatctgctcagggctaaataccatgacaagtttggggaatgcaaaagttaataagacacttaaatgctttttggcttttaaaataacttattagaaactgtcatttctacattctaggtactcaataataatattgtaattggattctccagaattatcataattttgccaataggtaaataacattttctactcagagaaatctgtgttggcatatcaaatatgtgaaatttggagacaaataatataaaaatacattactctccaaattcctaaattatcaaatttcctagtataattattattcatttattataaaaccaaataaccataggtttaatcttttaaacttcacttacccaagcttaaatttctaccatagttcccacattgagtaaaatttagtcaatcattgagtcttcttttaagaggtgggtgctcgttatgttgtccaggctggtctctaactcctaagctcaagggatccccccgcctcagccttctgagtagctgggactaaaggcatgcaccaacacacatggcagtcaggtcttattttgtacccagacattctcaatggcttcctatgtagtcctaattacagctctgcatttgcaacttactattcttttgcataaatcttccagtttaagtttttcttgactctgtctccagaaattactttcctatcaccacacttttgagcttgtaacccatgtgttgccctattatcttcttcctttgcctccaatgatctaaatgttgcctggattcttggaaacattttcccctttcctggacttccaaaaagaagctcctcaccaccctttcaatttttcactcatcacatcccttttgcaggatgtcgtttgcaaaagaccatatgcaatctctatttagcatatacaatttatcatcaatatctcaagctctctgtggttaggacctatgtcttggacttctgcacaacatcctcagaagttactactctgctataaataaaatctcaatatatttcattgaataagttaacaatagtttttgaggtgctgtgggattttaaagtacattctgaacatatgtgcattgtaaaagtgttaatcacattttattgaaaaattaaaattatttgaaagtttcatttatcagtagcatataggataaatctttgttaatcagaaaagtctattaatcagatctagcattttgaattgttccgaaacaataaaaaatagagatctacggaatttatctgaagtttttgctcagtttattttcagtttatctttactgcaatcctaagcaagaatgctctcctattctctattatctttataatttatcaatttattatttaaaatgtcctattcctgtatgacattttacaaagctaaatgttttttctaaaaagccctatattctccactaattagctgacaattatatgatttatcatttttaatatggctttctttcaatttattcagataagcaggatctaacatgggcttataaggtgaacaaacgtagaaagttctaaaatattatgatctcccttcaagcaggactttataaatgtgtacaataaattatgctaagtaaatgagataattattcattcaatttaagagaaatatacaggcacaggccacattgttagatctagatatgtttaaggacatctctgctgctatattgtttctaatttcaaatgtatttaaattgacccttttttggtggagagtgttgggagaaaggagaaactcaaaacatgccgaggggtcactaaaagcatattaaggagcttcaaaattttcaagatgaatggtatagaaggatttctaagtttagaaaaattcacttagtttaagcagagatgtcacattcaatttcctcattcatccattggtctaaatatattaaacactcactacattccacatattaaaatttagagtattttaaagcccttggtatataatgttcctgttcagtgaagaactccattttcatttctaacaggtctaggatatgcttatgtattttaatgtaataaaactacttcattttccctgtagagaatttgaaatatttagagaaagtgtaagaaaaaaaattctcataacaaaccctactactcagagacaactacctttaactctttcacatatttcgccctccattctttttcccctttatgtgtgtgtatgcatgtgacataagttagttactcttttatatatttttcatatttcttctttatatataatgtgagtcatttcacagccactatcttcacggaacttacgattttgtgggagagagagatgtgagaccaaaagatgaactaaaatgtaatgtgtaataatggtgattgtacacagtataacccatgcctacacaagggcccatccatcagtctggtggagtgcagatatacgttgttgagctgagggttgaggagtgtggagtacttgcaggagctaggtgatggggatgttgaatggggagcgagtagtgatattgggtatttagggtctaaggcataccttggaggtggtagaaaactcgcagtagaatagcagagtaatgtttgggtataggagacaaagtagaggttgacggggctaccattttatgctaaatagtcaggtctttcctttaggccagggctcaagaaaataagaataaaataaaaataaaataaaataaaataatcactctcactggtttgttacacctgaaaatctcaggcctgatgcagtggctcactcttgtaatcccagcactttgggaggcaaaggtgcgaggaccacttgtggccagaagtttaagagcactctgggcaacaaaacaagatcttgtctctacaaaagaataaaaaataaaataaaaattaattagctgggtgtggtggtgcattcctgtagtcctagctacatgtagtgaagaatttacacggtcaacaatcaaaacttgagattgaagcaggaggatcatttgagttcaggagtagaggctgcagtgagctatgattgtaccactatactccaacctaggtggcaaagcaagaccctgtctctaaaaaagaaaatataatttcccactcccccatatgatgtctaaaagttagatcacagacactggaaccaaattactgacttagaattctagttccaccattcagtagctattgggtcatgagcacattaacctatctgtgcctcagtttctttataatgaagtaaccataatatctagcccttgaggctgttataaggatcaaatgagataacatttataaagccgtaagaatggtgactggcatataataacactatataaacggttgttaaataaaagcaatacccctgtaatatcaaaacaaacaaatcttgatagccaaaattcctgctacagaatagaattcatgtgctttggggtaattgctaatgcactgtatagttacttctaaagaatttcatgattataacattctataatgaatcaatataataatagcatttctatggattaatttaaaagattaagcatccaagctgattataattgagctcatttccagtctggttaattctggcagttttggagcagcagagtacttaggttctgagttatttttcattttgggcggggtggtttatgctctgaattaaccatgagctccactttagagaacttgaaaaaattgactttttagaatatttttggcagaatatacaaattgcttgataaactgcaaaagattgagtaatttttcaaaacacccagactgcacctgttagatcattattatttcagaaattccatattgtacattgaaaataacctcacaagtatattttctgtatttatggccaagagctggtcattggagatttatgatgctctgcaaaaaacaatgctgacctggcaagtgcctccagggaaggagttgctcagaaaccagtgaatgaaataaattgctattaattatggtactaagtcttaactccagcccaccccattggtttgtgacccaaatgtttttaaataccttaattcaatttataataatgctgcccaagggcaaccaatttgcctcatatggttttctaggacacaacgtagtattttggcacactgcacatgcttaaaaattatttgttaaattagttaaaaataaatcaaaccaaagtcatcaacaaagtctgtttcctattgagccatgaagtgttttgcaaagaatgactctcttgtcttagttcagatgccatcttgatttaggattttcacttatccaacttttcttacaaggaatagttaattccagttattatttccctagcaccgttatctcagatagtgtaaactgaatatcaacacatacatatatcatactatcaattctttgtcaggtacttgatacactttagatttaatcctgacaaccacactgttttaaaatgggcatttttccatctcttttttttatagatgaaaaacctgaggcaccaataggggtactggtcacacaaggagaaaggggagacttcaggattcttttcttctaaattaactttgaaatcgttttactgttagcatcacgttttgagaataatttttgataaatgtggtatgcttttatcctaaaaagtgtattttcatctccaaatgaaatagtagtaataaaagtaataaaactttttatttcatttttttctagcaagagatggtcttacttttacttccaacaggagaattcttagtcaaagaaaaataatctttaacacaattaacagaaaaaagttgaatctcatttcatttcctgtggggccctcccaggcctaccattaatactcattgctaccattttgcttttctttggtccattaagtaggctgacagtccttcatatttttatatactacgttgagaaatgggaattcctgtcaaatgtatcttacgaataagcattactataataaaattattaaatgggtagatttagatgctaaaactggtagaaccacaattacaaagtatgtaaaaaagccccatcagttgtccatacacaaaagtggtgttatatgttagtgaatataaaatattttatactagagcattctgctcccaggagttgtttttgttgtgttctactttgttttaaagagaaaattctctagtagtatcagactctcccccaggacaaactttcagtttgtttcttttgttgttttgagagaacatatttacaacttaattttcttaagaggggtacatttttttgacatcactatattacaatttgaatcaaaactaagatgttgaccatataacttcttcactgcatgtaagtatatcaaaacaccatgttgtatatcttaaatataaataaaaacaaataaaacctagtataccaaatatggagatactaagattctactaatgtacactctccaaccatgagacaatccatctaaagatgaaagatgagtaacatatattagttcctcaatatattttagcaattattattattattactattcttattactatatattcaaatctttatcctaaaatccagccatttttctccaatgcttttctttttatggttttcaagcttgctcttgggaaacaagataagatttctacctcatgcctaaccaattacaataggccttaaaagctaagctcctcaattgagattttatttcttttcccaattacattctccccatgggattttcttagaggtaagcagagaccaacagaaccaacagcttgatatccaggcataaaagccccaggaattatgattttgtgttggcagatggtcaaactaagctaatgggtggcagaagcaaataacaccccagttaattttctagctcaatcaattctgatctcatctcaggcttatagcacattgcactgtcagcccaaatttaaaaagacagtacattccctcaccctacagaatgcagcaatagatactacaaccagaggactcaagttctaagcagacagctttgaaagtggaagagaccctgtaattccatgttgtttattagactgactcacataagcctcactcctgacagggattctgtcatgctgggtgcaggagtggaacacacctagcaaggctaactactctttttccagcccctcctggattgtaactattaagacgggcaggcatgatcccaagtaaagatctcaaaattcaaactgttgaaactcagaagtacatcttcctcttgatgaatataaaacccatcctagaggagaaactaagattttttttttctacctaactgaaaatatggcaagggattcttttttgtttggtttcttagaacatttccaaaactctgtgacaccattatcatgatgaaaaattccacttaggaagtcacaaaaaatactgtggtctgatgctggggactattgaaatatttaaaaacacaattatttacaactaaaatgtaattaagtccaacaaattcttttttaatatttactatatatttcccactgtactacacactaggaaagcgaaggtgagtcaagcccagggcctgatgtaaaataaggacattcacctttctggttctctttggattacatgtatattataatgcataatacaatatcagtatttgctcatgagttctccattctttcaacgtcttcttttcacatctcattatggtaagaatctgtaattctaatgagatcaaatatgccagtttatcacagtaactaatatacattccaaaattgccaacaatctccacatttgcctaccgttcggctctttatttttaagcagtaacatggtagaagagacacattacttctttatgttcttgtaagaagataattattcccatctaccccaaaatattggtattatgaatgacttagggggtacatatgggagacaaatttaaaacaaaaaataatctgattcttttattggccaaaggaaatctgtttgcttctgttaaaatcttataatatttttaacagagttcagttacttcttattttcttcctccacatatccacattggtaattgttacacttaatttttattgaactatttaaacttcattttaatgttttactgtctctttcttcctgttaaaactttactaactcatctaaaggatggtgtcctagttcaatgttaatgatgtgcttgatgtaatctcccactcaatacacacacatccccaacacacacatagacacacacatatacacacacacacatatatatacacacatacacacatacatatctacacacagtttgcagtttattttttctattgattattcttaaaaagttaaacaaagatagagaacatcacaaactacttttccgttctagtctcagtgcttcacaggctagttaattctaaggtagaaaagatggtaaggagattagttgcagggactagaaaattctactttagcagctgagactttttctctgcctgctcaaacactgaactttttccactcccagatcaagtccaatcacatcttttctgaatcactgcattaaagtgattccttctttctttgagttctttatgctttagtcatttacaattgaacactaagttatatactttaattgttcttttgttgttttccaaattcatattttgcctcctgctaaatctgaaggtttcttgaaaacaagcaatataatcacttgactatactacattaatagtatttgaatggtaatatgcatgtgaagagttagttaatacatactggtgaactgcttcacaataatattctactcataaaaccatgagtgtaacttgttgcagggttagcaaggagccagaggagcttagcaaagccatgctctgtgggaagagtacaaaaacacaaaaacgttagagaattcttttccttggcatcaactcttctgagatggagccatataggcattccataaatgttaactgattgtgatcaacatattttacttccaagatttcacatccaaccacctgccactcatccacctctaatgttagattccaaagggactgcaagttctgttttccaggtttgcctgcttgctcctctggattctgctttttaaggtaggaggcaagtggctgtgagaaggaacacatactgcttttaaagaaatctgggcaaaacagttcaataagtgcctgaaaacgaggagaattataaagttactgaaaataagaatttaaaagaggaaaaactaatgcattctaaattctacattaccagagcccacttttacttgcttcacagttttcttcagttccaggaacctgcaggaaccctcctgaggctgagtgccattttaaattttccctgtgagtagaaggccctgtgaagtagctttagaagttttggaaggtttactggctttggtattttgtcaggcagttcttttgatcaattgctgagcctgacaccagaaggccctcctcctccacctacaccctacagctctacaacatctgaagtcgcctccagtttctattttgtttttgttttttcctcaaaagaaaccagaaacccatgtgggcatcctgtactggctttttataaactctgtaattctagaaccctggacatcagaaagactaccacctctttaaaagtgactgagctataaggattcaattaaggatgatgaagaagaaattgctcattcctttgtatgtttcccttatgccaaccacagaatacaataaatagcatggctgacgagattgttccacagaacctttcatcagatgtatttggggaaaaagcttataatttaaaaataaaactcttcagaatcacctctgcctggtagagtttttccttccccagggattctctacaaggtaggtttttgcttccccaaagattctcatgtacaaacaagcactttaacagtactattaatacaacattttaacaaaaggtgggagtagtaaagatttgttttttgttttttagagcaccatgatgggtaatttttgttttatgtgccaacttggctatgatgaccagttgtttggtcaaacactggtctagatgttgtaaaggtaccctgtagatgtaactggcatctaaatcagttgactttaagtagagcagatgaccctacatagtgtggctgtacgttatccaatcagttgaaaaccttgagaccgaagacaggtttctcagaaaggagggattctgcttctagactgcaatatagaaattctgcccgagtttccagctttctaagtaaagactgcaactaacccttacctgaatctccagcctgccatttgcccaacacatttctgacttgccaggccctacatgagccactttcttaaaaatcaagcaatctataaatactcatatagattgcttatttgcagttatttctaattattttttctctcttaaattagtgtatattgctagacattagtcaagagagtatcatttcaggagttatgaataaataaaattttctcccaaataaatgttttaatttttcttccatcatgctttaaatgtatgtgttaaaaagtcaaatcccttcatttaataatctgtgagcagatatgatgatgtaataggtagcacattaagatctaaaggaaaagaataggggaggataggagttggggtggtgggggcagcaggtggtacctatttgccaagttcctctttctcagtttcgcctgtggtctagtctgtgaacagatgaataaataattagaattctctctttccacctctgtttttcttgctattctgaagtgcctgaatatgcctataggtaactgtggatccaagtaccggctataggaaaagaatcttgtcatgttgtgttatggtcgtaatgctacagaaagtagcattaaaaggaggtgctgaggcatgcccatggttgagacgtatttgcggcaggctccgagtcctgccacccagtactccacacaaactgagctatggaagaaataagtatacatttttcagcactgaattaaagatgcctcttttcccagtactctatactagcagtagaaatgaattccagggatgtgcaggacaatgacacagacaaatggttctctgctgcatttctgcagtcagatatgggaactgcagaaacatttgctttgaagatacataatatccaataagcaaagaagctgggttttttccctgtgaagttatccccaagagaaaaaaagatcagaattagaatgctttgtaaaagtatttaaaactttatatgttggcacccaagaaatgtagctccactcacccagtatcaggttatctcttttgatttcttttctaaccaactgaaataaggagtatatgtattctgaaaggccaagacaatgttacatttcttgcttgtcaagttaattaaacctcagaaaataaaggtattttgtagaatagtcatatgtgatcacatattacatgtcaatcttcacaatttataagcattagcatataagctctattaaccactgtgtctcccacagatagaacaatgcctatgatactcactcatctttgttttaggagtaatcagtcatttttaaaagacatgacatcatttaattgtcattatggtttctgaggttcttcatattctaaatgaatgtttactccaaatggccaacaatttgcacgaggttaacagaagaatcaggcattttgtgttttgtcttgctttcagaataacagaatttccttcctagacataaataaatggagtttgactgtgaacaccaattatggaacccaggtctatagaaatacactgaaaataatgctgcaaatcactaaagcaagaggataattcacaacaaacatcagtatggggctgtaccaaatggaaccatccaaaggttccctgcctcaggtaacaagctttaagcaatgcttgtaataagccctggggaacaattatgactagagaagacatgagtagagtcaaggtgtctcaacggtgtcaggacacagagaagtcaagagatatagaccagatttggcagctaattttagattattaagtagcatcacattatcaaccatatgaatttattaaagcaactttaaaactttattcagatgaacttacccagacttctctgagacaaagcaaacagaaaatattttcctaaaagatgtgcaatgtaagagtcctcctctctgcttaaaagcataatacgttaaaatatcagactgatatgtgatctcatcttaaatatttcctgtaagcttcatcttcctgttttctttagcaatctattccccttctgtccttagaaagcaaagggtatttgatgctaatgtactttgttgcaatatatacacatttctcccttgttccagctttcctaaagacatgaaaaatagcattgaatcctgtttctggcatggtcaatgttattcggctataaattttctgtgatttagtacatgattttggttgacaatttctacttttactatgcagtataactaattaaacattaagaagctttgttgtcatgctgttgataaaaatggcacttgcaaaaattactaatgactaattctataagaaaggacacacagggttttctttcctacccacaaggacttctgaattatggaaagtgaggtctagacaagatcaaacaaggctggaagagtggaatcaggggctggaccctgatttgagtgaggaggtttaaatctatgtgcttatcaatagatttaaatgttaaccaaataataatgtctctgaaattgtatataattaagaatacatgaaatttacattagagggtaatgccttttaatataaaattattattcaaatgctgtagtaaattcctgaatttactactcctgtcccaggagttaatggagtttgccagctgagaacatactgtttttttaaaaaaatataatacaaacttttttttctataaacgcaaaaatagcaattgaagggggagggagcgaaaattctgtcctatgttcagtgtctggaagcaaaacatatgctcaaatttttgttctttgcaaataactacttttcaataaaacaaccactaaaaggatatattgtcaaaacaaaacactgttttcatgaaaaatgacttaaaaagttaaagtagaatttatgaatttctaaagactgaattaggttacattgcctaacatttcaaaatcaacctcctaacatttaagtagattttcagttacacatatactttaaataaaatgtggtggtattttatcactaacatcacacatggacaaaccacatttaaaaccatcgttacatttgtttttccaacatttcctctggtttaattcaaaaagtatataataacttcatttatgaaattcctactatttttcaggtattttccatgcattatctctcgtttaaaatattgctttcagtattttatttaaagaaaataagtttcaaagaatttgtgtaacagcccaggtgacatagctggtgtacggctgagctagagtttaaaccatgtttatcaggcttcagtgcagttttctccccatgttacccagacagaaccagcaaaccataaaaagttttataagcacctgatctcagataaaaattgagcgccaagttaaagacgaacccacaggtgcccacagtatttttattgtcaccatcagtagtgttctcaattcctgagaaataataattttggggatctggaaacaagaaattgaaattcatagcatttcttagaaattccttcaaccataaattattatgtacctttaataatattttgttttaagataacaatgagtgaccataatcataaattgtgtatcatttttctgtaacagacttatacatacaaaagtgtcagaggcttttctataaaaaagatatacagtttttattattaaaacatattgtgaaaagaaaacatatatatttttataacatcaaaatatgcttacctgacatacatatttggtaacagacaactgtcatagtagcgaatgttaacacaaaataaatgtccataaaattattttttaaattgtaatataacaccacagctatttaatatttaaatgctattattcttaaaatgaaattttgaagcagataaactaactgctctctctgaaagtcttgacctttgttttgtgacgaatattctatttgcaattttcttttcatttttgcattgacattagttgaataattaagagtaaatccgaaatggtcttcatgttaggcattaaggtgtatatactgatccatataagctaattttctctttgaacataatagtttctaggtttatccagagtttggttttgctactgaaattgacattgcttttgttaattgaagtttttaatcattttcagatttcatttcaaagtagttcacaacattcaacatttacatctttttttttttttgcattttaagtatttgtacacaactgtaccctacagcaaatattcaaacactggaaaatatctgtgaatgttattggataacattaaaataatgtaaaatttgaattgctcagcaacactaatactacacagaatcaagtgtagaaattgttaattcaaggatacattttgcctccaaaacttgtttcttgggacactataggacttacataaagtatattatgtgtaaaaacatataaacatattttgtatttacaagtatgattactcactgttagtagcagaataaataaattgtgatttaggtaaacaatagaatactataccacaatggcaatgacaatgacaatttagaaacataatattcaagtctcctgacacagaagcctacaaactgtgatgattccatttttacaaaatacagaatcaggcaaactaatctacttagttaaagtcagaatgttgattactttcaggggtgcagtgtgtaacagccaggaagggagcaccaggatggcatgcttctgggagctagaaatattctgctttttgctaaacacatgtgtgcactgagtttgtgaaaattcatttatctgtattcttagtatgcttcgataaaaagttaagaaggtaaatataaagcacaaaaaaatgttacttcaaaacttttgacgaaagcagcttaccttttgaactagtttctgcagcagacaagaaattagaagtcaaaaagattttttaaaaatttacaggaaaaacactaagaaaaatcactgagactcctatcttatcattagatataaatggacatattgtttggtaaatgttattttctcaacaatgtatcaatcaaagctgtattaattgtattctacttatcttgtcaatttagttttttagcaattcaaattttcttatgcctacacatattaacagtacctaaatgaatacttaaaatgaacttgagaaatgagctttcaaataatgcatttctgtgattcaaaatgtttgtttgtgagcaaagcaactccaacttctactaaaaaataaattatttagttttgaagatctatatgaagagtggaaattagactaaatatcttactagagatcatgtattcatgttttgcggccccagtatccagcattgtagcttcgtaggagataaatatgaaccatgttttccgagagcacattatctttccatgaaagtgtagtaatatctacacttgaaactctatggaaacttgaaactctatgatagtttgaaactcactgctcacaggtacatacaactctgctttaaactaagttgcagtaacatagaaacccataggttttaacagtattgtttaatggagtttaccagctgagaacatactgttttttaaaaaaaaaataaaatacaaacttttttttctataaacgcaaaagtagcaattgaagggggagggagcgaaaattctgtcctatgttcagtgtctggaagcaaaacatatgctcaaatttttgttctttgcaaataacttgtggaagaaaaagaaagattgtgaaaataatgcagaatatcttacaaatgaagttattttcaaataagagacttaagaatataaaatgagactttcgtttcagtatctaatattactaagcaaagtgaaattgccataaagccacattctgtaactatagcaaccttgcaaggtaacacaaaagggctcatctttatgcaacagttttagaatatctatgatcctgaatgtgacagtatgtactatcttttttggtctgctgtgacatcctaatacatagatattatgaactatatccaatggttcattctttatcagtcaagaaagctatatcttagaaacatgtttaaaattaaaatgaaatacgtttaaatttaaaataaaacaggtttaaacagttaaacttgctaaccataaactaccaaaaaaaaaaacccacaagtgatatcactgttgctattttaaacataaataaaaatatcatacttatttgtatgtttatttccaactactattttatacctgaataagaaaatctcatcaaagtgctatgatatccccataatgacaacttccaaaatgaaattttcttggtctcaaagcacacaaaactctgacacaactgaatgaaaatgtaaaaatgaagttgtcccaggagatatgaagtcatacatatttactgaagccagcagagagcatcattaaaaattcccatggtagactcaatgtgaaagataatttattccacttaaatatgcctgatgatgatattagaaaataatctaaattaagaactcttggataagttgataggtgtctttttgctcagaatgtctaaatcgtaaatatttctataaacacacacacacacacacacacacacacacacgtctataccatttaatgtagtccaaagagatttgagttagaagtacattttagttaattgtctctcctcaaataactctctgtgggggagaataaaatacaaaataaaatatctaagggaattcaccccacagactaagtataaagaactctgtaatttggtttgaatgagcttttggttttttggtttaactaatacagagatttttatttgatcattgtatagactagtgaatccatttttgtgctcctttttaagtagtctactggggagtataacaaacatacactgatgacttaatgtgaaaccaaacacaaaggtgtttacccaaacacttttctaactggctagataacatgtactaaaaataaaggcccatagaaatgaggagaatgaaaggaaaagaggtggtagaaaaataaagatagaaatttacttaatatttttcaacatatattgtcaaatttttatctagattgttctttctggaatgcaataaaatgatggtttgaacaaagcagtggaaaaacacgtgatcccaattttggcttgtttgttttatataatattgtggtttctattcaaattaatatttctaattttaaaaaaggaaatttgcattaggacacacaaaattactatgcaaggaataaattagacaatctcataagatttgagatgtagaagattacaaacaaaaaataattataagcatgactttgaaggccaaagggaagttatttgctgcttacaaacaaattctattattaaagtctgtattctatcaatagtcatttgtgtgactgggtgggagtgtttgtgtgaaacagacaatatgtccatctgagaaacagtaagctgactgaacagtcatgagattatttgctcatatactgcctggcaaattttaactgtcctttaaggatacagtttttaattttgttctttttgtgtctaataatagctatattatactttggagagcccaaagtctagaatattcaaagaaataaattagggttattatctcaatcattaattcataaacgtgtttctcatataagcacatcactggccttattcttctttaagaaaaagaactagtcagttaaatttcaaataatttttagaatatattaaatttggatgagaactacaatagaaaataggggtatttaatgtatagttgttagtcttattcatcacttttaagaatatatttttcttgaaaaagcaataaaattatctcagaatgcaagttactagttttattttattcactttatgttttcagtatccaaaatggatttgaccaactacaattacgttagactgttctccatttctaaataaagttctgatgttgaaaaagaaaattttgcatctctcttctacttgatccattagaggagttcggtctacttttctttcttggattgccaaactctacataaaaactaagcagctaaatatttgcaaaaggaatatcagtttcagatacgtactaggctatttaatactgtttcattgagaaagctggccatatttgtaaacagttagaatagcaaagatcttcagaagtattttcctgctctaaaaagatgaaaaactcctggtacatttctcagagtgggaaagaagttggaaacgcaagaagctttgagaaaatggctccaatcattttaatggctcactaaagtctttagtgtttaacatctgtgagtttatctagtctttcgtttactcttttaatgtctatgagtcaaaatgatgaggctgaattgtgttaagtgatatcacatccttgagcttgccatttggaatacatttttcataatagctaataactatcatttatttaatttttctatcgtgtttcattcattaaattcatgttcatggtcagggaaaagatgaaacttagtcaccaatatgagggtgttcagcaacagattcaaggtgctctttagtaatcatgctttttactttaacctcaaattgttttactgaattccaaagttgttgacaccaagactcataccaaattgtaaaatagttatttttttatctttcctttctggaaaataaaacaataaggtaccttttaagtaaaaaaaaaaaaaaagtagaagaggctggataatgtataatcagtggtattttcatttacatggtctgttttctattggtcaccatttctacactgagaaacaatgatatctgtcttaatctttcaagatcagtacagtgtcacagctgactggaagaaatgacagacaattcttaaaaactgggagaatgaagtatagagcttcaagaaaaatgatatcaatactaaccccaaacattaaaacaacaaaccaaccaaaaacacaacgcaaaaacctttggaaattataaaagagaaagaagggattggtcaagatcaaacaattatacaaattggagggaaagaaagtccatgagatttaattggaggcaggtgaaattcagaatttcttccaactgatttcatgtttgcaagggtcttatgccacagccagtactaaagagaaagaacagctcagggctaaggtggaactgaaagcagtgaaagtaggagggaggaccataaaattagccaagtaacctggagagttaaaacagtctagagattttttcttccttctttcctttcttgctccctctgttatcttttcctccctctctctctcactctctgccttactgtcttcattcctctctgcagaaaatcatgaactgcaataactgtaatccaccattagcttcagaaaaaagtataatgttgcttgaattttatgccaaaatatgttttgacaatgataatttctaattgccctgacaatgtattctcaataatcatacaaaatcagaacaataatgcaggtactcaatttgaattctgtggcttaactcttgtttgattttcatatgataattagcacaaatcattacctacattctatctctgattaagaaatggcttcctttaacctgatggatttgataactacctgttcaaagattttgctttcctctttattattttcttatgattgtcacagcatgaaaaatatccttgttgtttggaaatatcagattataatatgtttaattggtattctactttacagatcaaactatcatagcctaaaaagtaaaatctaaccttaacacagacagcatattttcatcatgtttaatcacaacttgatcatttctcagtctttcagcaaaaaagattcggttttgaaacatggagattggcaaagaattttagctttgtaaactatgagtcttcttaactgctcttcatgtatttaaaatcccaccaatacttgaaattggcttatatcaaatgtgccctctttctttctgactttccatcagacgggaagtgttctctgagctcttcaaaatactttgctcctgagttatttgtgtactcttgcatattaatatgttgagttgcttaaagatagtaaccatgttttggtttctttgatgtctcccactctacttgtcaatgatttgtacacagagcaaatgctcaataaacactccgtaagttcatgcaagtaaaagtaatttgtttcccatctaaacaaaggaaaaaccatgtctgatggcagctttctttccgattctatctgtttaacctcaaattcaaaataagaagaggttgtggtataacgtgtacattattttcagaaaaaacatatttttacattcaaatataacttgtaattaagtccaaggttatttatgtagtagagctaaaatccttcttattggtaatagcttttcatttaaatatagaataagactttggttacatgattaatttatgttggaatatcacacttttagtaaactttagaaaatgtaaatactaataaaatgttataaaacaaattttataaagcattcataaacataactgcatacaatatataaccacttttattaaaatatagcatttagactatcataccaggttattccttctaaaacatttaagtatttcctttcagttacttttcagtaactaataaaaatgcttatttttcctaaacatatctttaaaataaatctaatttatcagtatttaaaatatttttaataatgctgcatgttaataacttcctactttctatgtgctcattctgtaacatgagcttcaggttttcctttaatatagaggcttagttttaactcaaacacacaaatatgcactgggcagagttctcaacttgtataatgcttctttgtatttaatatcatgcatcacctacttccaaaattccttttgctatctgttatgtttagcaaaacaaatgtgtcatccagcagtgtcattaattagaattccttgtaaaaggtggtgaagtgagtgaaactctaaccttaaaatatattttggatcactctgcttcacaaaacttagagaagacattaacactgccctttaaaaatcaaccactcagtaaatgtaccatatacattttatctatatcacataatgaaagagtaaaacataattaaaagactgaaactgacttattttatttaatggaggacatttaaggagtgaaaatttatttcaaagttttacttagattttttttaatgtgaatcgttagttttgtcagaccataattgtccttagctactctttaatggtatttaacactcacccatatttcaaagttcagatcaaatatatctgatatttgtcagactacgttaagtatgaatgtgattattgcaggagaactttttattcttcttaaaatagtatcttcagggaaaattttatttccatttatattgaacaattaaaacaaaaaacatgaacagaaacctacactgaaaaattcatttaattatcaccttaccagctcataattacttcattctgaactgagataacgactgtagtgaaacaactgtatttgttttattgtattatgcacaaaacacaaacttctaatgattaggtttattttcagtaatatcattattcttaaattttacttcaacgtaaagaataaaataagtagatatttaatgccttaaccaaataatgcaaaacttaacatattttaatccctatttagtgaaaacaaagcacatgtttatacatggtcaatattttactacttaggggcttagatttttacttctggccaaaggatactccacagcctcctcgaagtcaaaatttcagccaggcaaacagtctgtcagtaactattgattgtttagagaaaatactagtgatttattgaaagatctatgcttctgtctttcaatagtaaatgaagaagtaggccaagtgaaccatgatatgatgacatggagaaaagaatatctccaaaattgctgctgcagatgcagaagaaatagaaaagtggcaagttgaaatcaatactcattttagacttagtgatggaatgcttcatagttaccagactgaccataaagcacaggactccaggtcagctgcaaaggccataaccttctttcctttttcactttatagtagacataaatggaattgttctgtttatacttaaatatacacgagtattttattatacaatctgatataagaccatgtgaaagtctcattgaccttgctgaggattatgctgtttgaaagattctcaactgctcaagaggtagacttctataaaaattaatcattacttgaaaaatgactgattaaaacagattactgctttaataaaatcacatgccaaggctagagaaacatcctttcttgttaacatatcttgatatacaaagtatactaccagaaaaaacttacttttcctcagatgatgatacagtttctcttggaatgggaatgtaccataagcctggatcagggtaaactcttgtttttatacagacacaattatatttttgaaacatgagtagcgggcaaagacttctcaacatattcacttgtttcttcattcatcacccatccattcattaattcactgaattgatattttctgagtgcctactacatatgccatgcactgttgtaggttctgggggtacagccacatagaaaacagacaaaaatccctgtacttaaggtatccaatattatcaggatacacaaacttacagctgtataatatattgccacatatgaacaactattattttagggaaagaaaggaaagaggatagttctgaagcctttatttcagatcagatggagacagacttctttgagaaggtgacatttgaacagggattacaataaagcagggaaacttgtattgccaatacctgagggaagaatatgcaggaaaaaacaataggtgaaaatgtcctgacagagaacatggcatttattaagtctgcttcattaaatgaagttttgagaatggaaataaaatactgagaataattgtagatggaagttgtgatgcttcctttatcaaacagttattactcagctattgggaattgagagatcaatatctcctaaggctgggttatgattaggttctttatattatgtagcacaattcattaagccctcccagtataatatgtttttccattcaaaaaataatatacactggtgtagtatttaattggtcatcttacagaggcagtaatactcagacttagagaaagagccaccaaatagtctgaaattcacatacagctctagcttgatagttgcaattgtccaatcctttgaaactaccttgacatggaattcttaaaccattgataaaaacctgcaaacatttaaagttctattgagtctgagataccttggccaataatataaacattctttactttaaacatacatggcatattgtgtacatacatatatttattcataacatatgtatgtaaacacatattatatattggagcagccattaacatgtgccagttgccatatgtcactcaatgtttatttcaacaacttactgttcatctttaaggagtgcagttaattgacaactcccaacaaataatacttgcaagatctgctgaggccatgctctctgggtttgcccctagccaatgactaaccatggcgtggtcaagggagggcaggaagattgggacctggccattttcacccaaacaagaactcctctgatgggcagtcttcactccagagctttccagagaggtggctgagagcctatcagatctgtactgtggcttgaggcctgtcacccctttctatctggattctttcctcttttatcactcataattgctacctcccaacaactttttgtaccctaagtgcatctgagcatttgtcccctggagcacccagctgtcacatgtgtttatagatgtacatgcaaatatctattattttagggtaggtaatacattattaaaactcttttcacttacttatagtatatgactaatgccacaaaaggacagacaattattttgtagttaaatatatcctacttaaatgttaaagggggctttcatataatgaaacatttgacatttgtgaataatttttaatgagaacgtcaatatataaggcagcctcaataaagcattttcctgtagggtttaatataggatttggtttggttgtcatatctaaattgtttattaaaggaccaaaagattcttcttagaagctattctgatatttgagatgtccccatgtcatataactcaagtgtcggtgcaggacaaatctttactatgtgatatttatttttattgaatccagaagttctctgattatgcagggatgtattataattatagtaatgtacagtcagcatatacattcacaattataatgtgatttttgataaacaaaagtattttcgtttattagtaagactttctatttctggtactatagttatccttcaggattttttcaacaatttattaaaaacttgactcattgttcaatttccacctatgagtgagaatatgcggtgtttggttttttgttcttgtgatagtttactgagaatgatgatttccaatttcatccatgtccctacaaaggacatgaactcaacatttttcatggctgcatagtattccatggtgtatatgtgccacattttcttaatccagtctatcactgttggacatttgggttggttccaagtctttgctattgtgaataatgccacacaggaaggggaacatcacactctggggactgttgtgggttggggggagggggaagggatagcattgggagatatacctaatgctagatgacgagttagtgggtgcagcgcaccagcatggcacatgtatacatatgtaactaacctgcacattgtgcacatgtaccctaaaacttaaagtataataataataaataaataaataaataaataaataaataaaataacaggaaaagcaaaataaatgtgacatgtctaaaacagtaaaataaaaccaaaaaaaaaaacctgactcattctcagaataaaattaatacaactgaggaaactgtcaattaattgttcttcactttcagcaaaaatgattaaagtcaactgcacgaacaattcaagatttgtcctgattattcatttgaaacttcctattttccccatgtttttccataaacgcagaacacttaattaatatattctatacacaaagaaatagttgaaattatatgggcagcactttattgtataaattttctttatagtgtctaagatctactgaacatgaaaaacatttaacacctcagtccatgagattaacataaaaattagtgctaatataatggtgagccatgtggttatataatttatatgtaaattatctcaaactaaaaaataaaatcaacaaaaagtatatgttatattactgaatccagtggcagaggatatcatttgaggaatgctgtttctacatttttaaattaattagaagaaaatttagcaatgggagttttgtttaaaaatataaattataccacgatgtaatctaacatttgtttgactaggcaacaaaaatttcctggccttctcccaagattatgttattcctagaaatataaaataatattactccttcatgttattccatatctcatgcttacatcaaatgcaattactactgcttttcaagaaacaaccatgacaagccaataaataaagtattttgactttgagttgggttcccactacaaatgaattgccacaagaataaatgacaaattattcatttgctattccctcccccaagtttaacagaagccttagaaccttcagtacatctcaaacgctgtaagagtaatttatgatcctgaaagagaacataccctattggggcctaaatgaccacaaacaatgagccattttatgagtgttaagtaaggaatccaataaaaaggtgatttaaaaagcagacatgacatctttgaattaatctttgctctaactgacaagtaaatgcctctacatattggatatttttccccttacagcaaaaaaggcagtaactagtcatttcattatagataagttgctttaccacttgagcctgttttctcttccgtaacataaagaggctgtatcagaggtggtctagttaactatattcaggggtcaggcactgaaatgagtgggtcactataaattaagacaaaatactgctttgagctattttgttttttttggttgttttttttgtttgtttgtcttttttttttgagatggaactttgcttttgttgtccaggctggagtgaaatggcacaatcttggctgactgcaacctttgcctcccaggtccaagtaatggtcctgcctcagcctcccaagtagctgggattacaggagtgcgccaccacgcctggctaattttgtatttttagtaaagatggggtttcaccatgtcagccaggcttgtcccaaactcctgatctcaagtaatccaccctcatcagcctcccaaagtgctgggattacaggcatgagacaccgtgcctggcctatgcaagaaattttatgtaagggcattgacattccaaacgattattaaaacccatgtgaaatatattcgctccacaaccctccaaagctcccaaatttcaaattttggaccaaattatctcgaaattctctcaagcctcttcaatctctaagaagcaatctaaaaaagccctgataatgtgaaccattaaaatcaatataacacaggcacaagatagtagaggggattaatgcagaaaattatttcttactatttactgagtcctgttagagaattgcatatcaatgtttctattctttcatctggtctctaaatcacccaagtatcactcaacgctacatcttccaagaaaaaaaaataactcagatattatgggaagagagccaaaaacatcccagctcatagcctaatacacacatttattgggaacctactatgtgtaagatactgtcccaggcatttgggataaatcagataacagcactgacaaagattcctgcccttgtggggcttatactctgcagagacaaacaaggaaacaatcattaaactttaagtaattcgtgtatatattagaaaatggtgtgtgctatggttttctaaaaaataaacaagtaaaagggattgggagggtgggagacaagtggcagaaggttgaagtatctaatagaaaggttcagaattggccaggcgcagtggctcacacctgtaatcccagcactttgggaggctgaggcaggtggatcacttaaaatcaggagttcaagatcagactggccaacatggcgaaacgctgtctctactaaaaatacaaaattagctgggtgtggtggggcatgcccatagtcccagctactcaggaggctgggggcaggagaatcgcttgagcccgggaggtggaggttgcagtgagccaggattgtgccactgcaccccagcctgggcgacagagcaagattctgtctcaaaaaaaaaaaaaaattcagaatagactcagtgaggtccaatttgagcaatgatttgaaagatgtaagggatttaagcatctgaaagaggcactacagccagcgccctgagatggcaggaagtgtcctgagcaaaactgcaagaggtcagtgtgagagaaggagacaataaaaggtctgaaaattctcctagaaaccattaacactgtgcattttagctactatatggattttcattctaagtaactgttgaaatgaggtatcatggctaacagcaactgctttggtgttaagcagctctactgtttatcagcttcagtgtcaagttgcttaatctctgtgcttcacctaacaaataagtataattgcagtataagtaccacgtaggactggttatgaggataaatgagattaatgccaaacgtcgtactgtgactggcatagagaaaccgctcaataaattgttttctctgaacttgctactttcaacacaaaatttttctcaaacaatgagtatcagtgataccaggaccattctaaaacttatctccaacatctatgctcagaatgatgaatcaattaaccaacaaacctctactatgtgcaagggattattttaggtgctgaagggatacaaagaatttaaaatgcattccttgatattaataagaacatgatttaagtgaagaaataaaacatacacataaaaacataatttaatattcctatcaataaaaaggaataaagtactgcatctgcacaaacacatttggatgactcttaaactcactgtgcagaaatgaagaagccacacacaagagcacatacttggtgattccaattaaacaaaatgaagactattctatggtgacaaaaggaagatcagtggttgcccagatccaagggaaggtgtgagaatggtttataaaggagtataaagaatcttcacaatctttggaaatgttctgtatcttggttgcagcattgtttcacaagtgtaaacaattgtcaaaattcatcaaagtgtgcactttaaatgggttctatttactgtattcctccataaaattgatgatagcaaaaacaaaacataatagtcataattgatcagaatggattgaataatcactacagtatatcttccactatagtttgaactagaaaattacaggacaagtttagtttagatatgccaggtcacacaataatttccagatatttcttgaattgcattaggtctagaaattttgttaagcttgaagataaagttctcctattaagttgtcattagttgtggctctattcagtcaatgtctgaataactttatgtcactgtttctttgtttctatatgaagaatcctttcatcttcaaactttttcctcaaaaattttctttttttatacagttcattccctcttaggactgtcccttgcagagatttccaacactttcttactgctttcaatgtaactatcaaagattttaactgcagttttattttttaaatatgggccattctggcttctatctgtagcccttttccaaagatgtataagagaggaagtggcatgtctaacatgtctaatcttaaaaaggacacacttttcaaagagttttattttcaaagttatcctactattggttaccaataattataacacatttttatgaaatgtcaaataaaagacatgcatatatccgtagggaggtagaaaatgaaacgggatattgtgctcttcctaggattcaactttgctgtaatattctatgaggttatcattcaattgttctacaatctaaattcccacatttcaaaaatttaattttcctatgaaattaattgcttaatataaaaagcacatttataatttattcttcagaaatgaatgctttgaaaatacatttaaataagtgttgatggacatcattaacagtgaaatataattaaaagagtaaattatttagttgggtttttttaaccagaataaaagatttctatggaagctttctgttcagaatattaaatgcctaagaagtcatactagattttgaatgtagtacctattctggaaagcaaattcaggattcttgccgacagattaaaaattatttcctaatatagatgactcaaagaaatacctgtcaaacagagagttaagacttctgaatgcagacacagcttgaaaaagaagatgatgtattttccatggagcatttgccgaagaactattcagcagagacataaataattaaaattaaactacagtcgctaaaataaatgaacgatattctgaagcaataggttgacttttaatcctgattttcacttacttccaagctcacaaaatttaaccatctgcagcaaatcgccacatcaataatttgaattagccggattccaccgtaatttctgaagtgcacctcactccaatttccaatgcagtacaattgaaaacgttatcagataaaactggttgcagaaggcttggaacattaaatgctttgacaatgacaaatagaataaggtgagatgtgtcttaaaaggagggtcttcccactacactgtgtttattcaattttagggacaccctctgccacattagaggccttttcattttcttctctccagacaaggattagtagatgtgggccctgcttcccccaggtttatattactgtataagggtaaccctgtgaagtaacaagattaccagagagaaaattttttaaaaaatttaaaaaagggggtagattatgtcaaagccttccttgaagagagagttaatttgtttttttctaatattttgcaggatgtattaaagaaagtctgtagaaagacaagcagggaaatgtgacaacagactatacaaagaatttataggttcttatgacattatttttctttgatgtaaccccatgttggtgatgttatagaacttttgatatctggcagaattatgtcaaatacatgaactgcagtttaagaagcataaacgtcaggttgttgaaatcttccacatcaaactaattagaaagaatttttgaatgtgaattacagcagtttattagacgtcatgggagatacagaagatgtactgatattaggcacacagaggtattttaaaatatgtaataactgaagagacaagacatgaaatataccaaaagggatttttttgtgtgtaaattaagcatctaaccataaaataatcagagaattaatcaatctagagtaacatgaatattatcaagagaaggctgagcaatacaaataaaagaaataatatctccccatggctactcacaagaaattaaaccttgctgaatgtcagtttcccctttgtgacagggatcagcctaaaggcctagtgtccacaacatgttggacaatgtgggatttttaagtgcataatagatcccaatcctttaaatctccaaacctcaccatatcctatatcacattacacttcaactctccagtggaagggtaagtatctgggagttcaccctttaaggacagtagttctagaacccgtagtatgtacttgggatcagcctctagttgaggttattaggtctaagtcagttttactttctattataagcatatttgtcagtatcaattaaacaaaccctctcacttgggtaaaatatttagaaaacggaaggcatttcaggtgggaaggcgggtacaagtaagaaaatagaattggaaacaagtatggcttactcaagatagcatgaacagacctacttgtcagagtgaggattaaaagtaaaattattaaataaatagggctcttcaatagtaggaaaataatgtggaggagcctgtaattgatatgacaggtaataagggaacatttgcacatttctgagcaacggcattccgtgatgttgtacaagccagagagagtgaaacctaactaagagaaaccagctaaagcagctggcaggaatgatgtaatgcaagaacgaggtgatgagcgctacctggattagactgagctcactggaggtagaaaggaagagatggttctcctaagaatcaagaaaactgaactcatattgaattacctcttcaattctctcaaatgtcatgctgccagtgaaggccttacctgacaacctcatgtaaaaattaaacctccttttctcatcggtacactcctgtgtcccattcactgatttttttctctatagaaggtatcactatctgacacactatttatctggcttttgttgtttttgttaatgcttgtttcataccattaaaatgtgagtaccatgatccatgattttcatctgttcatttccctgttcccctgagcccacaagaggggattcaataaatttgaactgagtgaacagaatgaattaatatccaataaagaaaacaaagatgaggctgggcacggtggctcacacctgtaatcccagcactttgggaggctgaggcgggcggatcacaaggtcaggagatcgagaccatcctggctaacatggtgaaaaccagtctctactaaaaatacaaaaaaaattagccaggcatggtgggaggcacctgtagtcccagctactcaggaggctgaggcaggagaatgacgtcaacctaggaggtagaacttgcagtgagccgagattgcgccactgcactccagcctgggtgacagagcgagactccgtccccgcaaaaaaagaaagaaaataaagatgagaaaacattaattatgctttcaaagttccccacctggcgttctggtacaaagttatatacaagcaagaacttcattaaaggatctcaaataaatcttacaatcttaaaaggaaagttcaacaatagttcgatatcacgtgacactaagaaaaaaatgtgatttgaccagtaggtaatcaaaaacagactaaacaacaatccaaagaaactgccaatagtccacaagttcttcagtaaatgtgaattatagcaataatgtgctaatttgtattcactaaataggttttcaagctttcaaaatgtttaaaaatgttttcatttatcattgcaacacgcatggcgaatggaagatggagacactaaggagttaaataacctcccatatgctgtccttccatattaatgaatagaacattacttgcttctataccaaactagaatttggtgggaaagtcatgaagttctccaaagcaaagttagagccattagattaagaaagtgagtgtaataatgtactatttttttcctttagaaaagcgtaacctcaattggccattgagaaggatggctttattagatgatgaggagtctgaaatatcattaattcactcatcagcatctagaaatattctttaaccagggcaagacaaagaaaatgcatttattctcagcaatattcattataccaaaacatttattcattttgcttagaatcactgaagtaaaaacagacacaaattagaaaaaaaataaagcaaatgttgaatcacattctgagtttagaatagaagaagaacaaaaacaagttttctcgggaactgaaaaaaaaaagaggtcataaatattaatgtactagatctacataaaaaaattctaaatgcaggattttcataactctaaaccagaaatcattttagcttatcttggaaaacactaccagtgaaacaacttaatatcagttaattttgttttctaattcaatttgtgagacagcactggatgtattgagaaacagtacatctcctgatcttctaagataccatgtaacttgggagtgctgagaatatattacagcaccctggtaaaaacccatgcatggtgtagtttgaccttagtggggagctttagctttcaccatcaggttctgacttgctatttccttactgtgtaatgtgaaaaagtttttatcttggttattttttcttatctgaaaaaaggaagtcaaatgtcattgtccctttatctcagatagttattataacagataagaaaatgctttttacaagtcaaaaatgaattaatagattaatttaatgtattattctataagtttacctaaatcagaactactactactgttacaattagaaaatgataaggaagggaagaggaagtacatttagaaaactgcttttacaaaccaaaaacaagtatttatgaataaaagatgaagctgctgagaaaagtagaaaattacaataatatcactttattcaagaagatattgggcatgtattcccaaccagcaccaatatattatttttcagagataatgttaccaggaagaataaagctatgtttatttagacagggccagaactttttttaaaagataaactaaaataagtaagatactggaattgatttgaggaccctttgcaatctctttatgttctctgctttctaggtattcactaccagacctcgccaacctaaattttaactctctctttagtcttgttgaccaaaatgacttttcttcaatctaaaccatactgaagctgaattcaatctaactataggaagacattaacatggttcaaataaagctttgcataataactgtttctattatgttgatggtcttggaggtaactaactgttaattcatctttaactgaagaattattatagaagtattctgggggaggtgtttttttgttttggtttttgttttttgtagtgacatgtgctctcagtgtaccacaatatcatagccccacccccacaacataccttatgggccttgtgcataagcattctgtaaattataacacaggataaaatggggcttacttgtatcttctcctaatggaaagcctctcctttagttgtgaaaacttgaaattatttcctctcaatacgtccttaggcaaagggagctgtgttggcaaaagccagagagagatgatgcttggctcagagctgaatggctcaaaggtactttcaggataaaattgaacttctgtgatttactcatttgaaataatgagatttggagtgttctaatataatccacaaatacaagacagtaagatctgaaacgccggctgtagccctgagattaataacctctagcagtagttatcaaatattttaaaataagagacccttcctttatagacaatcatgggagaaagcccaatgttaaaacagagaaaagactatgtctctgctggaatcagggcaagggctccaagtcctgctctttccgcactcttaagccccagcagtggtcctcaggtccctccccagaacccttaggctcagtaaggcatgacctgaaatccattagccttacataattctgtgaaatttagaactgaagaatccagtttgttccataacagcaatttgactgaaatacatgagacaagttagagtggccaggccagaatactagaaattaaagtataataataattttaaaaaatgacataaaataaagctggtagctttcaccctaggcttccttgcagccccactctctttctactaggtcttgaaatttagaaaaggtatcttgaaatccctaagtattaaatagtccatacgtgaattttacaaatgtatccaagttcatatttgggaacataaacgatggtaaaatggttctcttctaagtagggaatgggaccgtgtggaaacttgtgaggggatgtcagaggtagtgcagtaaactgctgatgcaatacaaggaatgtccttttctgtgctagagctaactctcccatttaccagttgattaactttacgcaaaacacttgttattcagtttctccatccatgaaacaacctgtctgcattaaatgatcagacctttctttttaaaaagattactaatctgtattttatctagatacataatatttttgctgagttgaaataaactttcttaattttcatattcccttttcattataatctctatcctgagaaccatattcatattttcatcactgctgaatgttgtctccctggatgtcttcttagaacttgatctaagatgaatgttattctcccacaggcactttcagaagcataatccttctgggtacttatatccaggctcttcaagtcgccttcagttctttcctttcacttctcacatccaattcaactactccaatgtcttcattcattcattttttttattatctactttgtgatttgtcccactgaaagaacaagacccaggccatgtcctaatgaaattgtaaatctagtttctcatgtttggtcctttccttcttttcctcatattatcatcacagttcagcccacttttatcttaacgttttaaacaacctcttagcttattcaccttcctctaatgatcccacctttcctcagcactgtaatttggaattcactctgccattaagatgtctttttaaagtgggactctgataatggcagcatccatccccaaccctctgacacacactgtgtgttgactgcaaaataagtttataaatccagggttataaatgcagctatttaaggaacctggtaagacacataaatgtgtgagtctggttagggcacacagtagggagtaagagagcctagggaaaatttggagaggctatgtgctgcccagtgactttcaaattcaattaaaaataactacatctatgaaccagaaagctaccaattctttcattccaaacctcccttgcagccacatttgtgttgcagccacacaacatccctcactataatcatgctttgcttgaagctgttccaatatttctaatgacactgttctttctttcaggtgtcctctttcccagtgaatctatcctcatttctcatctcttccctgtcagctaccacttatccaagcactttttttccagtaagaattcatctcttgctctcctatatggtcattatattttatattttacatatttataaacatgacatatgtatttatgttccacaaagggctttgaatagaatttacacatagagttccctgggttgatgtgtttatcaaaatggaagataaagtgaattaattacttaaatatttaacactattgaatagaaataacttccccaatattgcttcatgatttagacagtctattaaatgtttaagcaaggcactagactaagtttattaagacaaattttggaatatgtgcagaaatatgacctggctaatagtacagagtcaaagctggttgaatggtgttatatagtggattcagattgatgtggcagtggtggttacactaggggcactaaggttatccctactggcactctgaggactctattctctaccacacttttttccattaaaaataccaagtagattaatatcatatttgtagataacacagggatagaattacatacgaggagaaaatatagcttacttatatccatgtactaaaatggaaatcagaagcatttctcttcctttgactcctcatctctactttctcttcagtaatccatactataaatgacatcaccattcacctagagtcttctcatgaaaatctgggaagcagtcttgactccagtcgtgcccacatctttgtaactaatcaaccaacaaacccatagaccctaactccttagcacatatcaaatctattacttatttttcacctctgatgttaggaaaatagtgtaagcttctggtatctttcttgactaaataattgttgctatgctgttttcttatctttggttctgcattttttaaatctgttctcttgccagaataatcttttgaaacaaccaatctgatcctgttccttaagtctttccatcatcttgacctttatctgtttctccagtttcatcctttaggttcccttgttgcattaatactcaattgcttgcaacctgcatttctcttacatacttacattatgcttctgcctgaaatgtgtctacctatgctagacaaatataatggcaccacaatgatgtataaatcttaatctccagaacctgtgaataggttggattacatgtggattacatgtgttgcggctcagaacataccccaaagtatggcaccctggcatgctgagtacttggaactgaaggaaattggaaaagcctcagaaacaaggtctctgaccttttcctgccctcctctctcacacccctctttctccccagaagcaagtcatagcaaccagaattgcatttctccaaggtctgtctagaaactaaaagtcttctcccctaaagtaagccataaaatgtagaaaggtcactctctcccttttcccttgaagactctcattgccctatactctggagggaaaaatgctacaaagagaagaatctgaaaaaaaccaaaaaaccaaaaaaaaaaacaaaaaaataaaccaacctttctggatttcccccctcagtctattaccattagattatactcttttgtccaatcacatttctacatggcggttcattcttcactgaaactcagtataaaaagtacacagttttccctgggtatttgggtcttcaactctgaaagtgcctgtgttacatgaaactttgattaactaagtttgttatacttttctcttgttaatctgtccttcattacagcagtgttggctgtgacctttacgaagggtgagaaaaagatgcccttattctttttgcccttaaagatagcaaaggcaattaaggttgaagatgttaattacgtttgctaatcagctgacctaactatagggtaagaaccctggacccaatgttgtcacaagctccttacaagtggaagaaaacagcagaagaggagtcagaggaaaatgtgactacagaagaatggtctgagagatgcaaggttactggctttgaagatgaaagaaaggagtcaccagccaaggaatataggcagcctcaaaaaagatagaaaaggaagaaagcagattctttgcaagtgcttctaacagaaatgcaccattgatgacaaatcaaatttaccccagtgggatccatgccagacttctgacctacagaagagtgagataatacattcacgttgtttaagctattacatttgtagtaatttgttatggcatcaatagaaaactaatacactacaatgtcactctagccaacactcatcactcaacaagactcagctaatgaagaatgttggtttctgtaaataacttatattacagggcttttaactattgatgagacttccatgtaaaaatgtattcacctactgagctataaatccctctagaacaaataccaagccttatttatgtttgtattcacagcatcttgcataggacccttagtagataatttactacttttaatgattgaaggtagaattgaatagtaatgtttcatgttttaaagtgggctgacaacatcaactcttgagtagagtacagaaaggctgacttatgagcagttcatgtggaaaaacttagagatttcaactgactaaaagttcagtatgaattgataaaacagtaacactgacaaaaatacatacacacattcacacatacacacacacacacacacacacaaccacacccctacctttgattttagatggcattaacagaagtattatttccaaaaccacagaatgcttccattttactatgccttgctcagatacccagggatagtataattaattttagacttggctttaagaggtatcctgacaattagagcatgccaagattaggagaaggagacaaccagcaaagagatggtaaggtcttcagcactgtgaaggatggtttgaaagaaccaaaaaataaaatatggaagagaaaaaatctgaatttgggtataggagttgctatggtttgaatgtgttccccaaattttgtgtgttgaaaacttaatcctcaaattaatacgctgactggaagtgggtcctttaggaggtaattaggattagataaggtcatcagtatggagcccccttcatgggacaggtggctttaagaagaggaagagagacctgagctggcagggactctcttaccctctcaccatgtgatgccctccacatgttatgatgcagcaagaaggccctcactggttgctagtgccatgctcttcgacttcccagcctgcagaactataagaaataaacttattttctttataacttacacatttatggtattttcttatagcaacaaaaaataaagatggggtggagaaatatatttatagaaagtatttttttaagtaaatgagaaattagacataatgtttttaactctagagaaattgaaaacagagcacagcacatcggataaattcaataactatcttaagaatcagcaaaacaacatgcagatggctgattggcaatagtttcagtaggcagattttgattaaaataaagaaaaactttttaataattaaacctctccttaaaacattatgactttatgaggtaacaaggtaacaagtacagccttctgaaagcataaacagcgtttacatcatcacccattacttaactagcagaggagtttgtttgaataggcatttggactaggagacttctaaagattttgtcaaatttgtgacttcattatttgttaattaagtccctctccattctaaagcaatttctgtgatttttctgattgtggtagacttcacaattatactgatttaaaacacattaccatgtactttctggctcctagtaaattgctattcacttaagtgttatctctgagtcctaaagtgttaacagacctaccaaattatgtgaggaatctcgccttcccccacaccccaacaagcttaattttctcttgaatatttatctcactctctcataactttcatataatttcaaactctccaaaacacacccaaaaagggagctgaaggacaggaagggattatatattttttccatggtatattctcttctaatgcagaaaggcaattaggcaaaacaagttaaaagcaagctaagctttttcttcttgagcagtgtagaacaaaaggctttatctgatttatgctaaaactagttcattgcaagcaggatcttaataccctaatcaaagaaatttaaaaataaattaaagaaaacatctcacctttgttacttagaggcaaaaattacgacaaaattatttcctggtcagcattcttagactagcctcagctattttttttttcttgaattaagaataatgaaaatcaccataaaatgaaacaaaaaaaatgtatcacaaaaatattttgcaattctctttctgcccccttccattttacttcctttctcaacatttgggatttaatgagctttaaaaatatgtatacaaaggataactgtctttgacttttttgatctttcctccatgtagtttgtgatttaaaaagttagttgtttcctttgaaaattaattttatttgactcatcattagacacccaatactctgccacatgttccactattgtgcattcactattcactagaaatacattacacactttaccgatattcatatacttcatccccatagctaaaagagatttttagattttactatctgtgctttacaaatgagacaaatgagtttcaaagaggccagataactttcccaaagccacacagcagatacatcatgaatctagggtctaaatgtgggtctacttaactccagtctccatgatccttggctatgcttgtgcaacaagatttcctcagcatctttcatgtaccaagctctacccttaattcaaaactgaaaatatcaaagcccctgccttcaggggtatcacattctaacaacagtgactgaccaataataaatgcaatccagctaaagaactttataatagaggtaaatattaggtataatggtgttcctaaaaaaagaataatccacctttcctagtttggggtaggagtgccagtgtgcgcaatgactgaatatatactgctaacagctaatctttgaccaaaaaagtaagattcagtctatcattggattctgcttcctctataactccaggaatcagccatgccaaatgtgctaagggcttccaactctgcacagatctcactggggctaactcaagggctggacaatgccatctgacaagttccactgacattaaaaaatacttgtctggtgtcccctatcatcaaatccctccttaagaacagatacatcagttaaaattatgtggcactttcaaatactatcatcatgatttattgcaacagatgggaccactgagagatttatctttggcaaggggataatttttggatccccctcaaatcacatgcaatatgtaaccatctatgaatagagcttccctagaccctaaagttgccctctcaggctgctgtcattactctttcacatctatttctacttggagaaatgagtaacaccttgctcttgcagtgacaacattacaatctcgtgttcttgtccccataggagcttgaccttatcaccctcatcactctctccctgctttttcttgtattcacactaatctttcaaccacttcctttatagttttttttttaaatcttaccatacatttccatataatttctatacctgagtctgtcatttctgaatgtctaataagaatactgtctattatttttcagtagaatccatggaccaaatttctaccccaataaagcctgaattttgtacatacaacatattcttgttttatttaatggttctttctccacaatttccagaaaaaagggtcattatcatcatccttttccattgcatcaagatatatttgtgccagattttaaacgtgagctcagtatttgctgtttagcttttccttgtctggatcctttttccattgtacattattgagaatgatcctaaaacatattacaaagtgtccataggtgggcattacatacaaagtttaaaagttgccacatattcaatttgatttttgttttgtctttttgtaaagcacatggtctgaactctacacaatgaaaattttaatgacctttacaacaagatttgaaagagctcagtgacatctttactaatgtgaaaactgacaatttagtttcagggatgaagggtagatctaatagaataactacattttttttcagtcctttcataatggagcaacttcttttaaagcaagttaataattattctttttattatcaaaaaaagtctttcaatgcagaagcattatgaggtgagttatcaagttgtacatgtcactgcaaggaaaaaacaaaaatcctcaccatgaagattaagtcctcagcttttggaggtcaaaggtcaaatcaatgagttgatagcactagtcacaaagtgactgggcattagatcttctgggggaaggagtgatctcttttaaagtacaggatgccaatctgccataacctagtgaataaaatcctctgttaagttccttgaaaaatctctattttagaaaatgcatcccaggtgattgtgggagttcctcaacttcagaatttagggaagctctatacatagagggttacatattgcatgtgatttaagatggtaccaaaaattatccccttgccaaagataaatctctcagtggtcctgtcctgttgcaataaatcaagatgatagtatttgaaagtgccacatatttttaactgatttatctgttcttacacagggaattgatgacatgggacactagacaagtatgttttaatgtgagtgaaacatgtgagtaactgctctgggctgtccctctgagaactactaggtagaacaatagtaatgatctcaaggtttgcactgatgtttgagcaactgttcagatgttctgacagggaagtgagctacttgaacatgtttgattaaagaatggttctcctatgggctttctctctattcagggaataacatgcttaaagtagttaaacaaaaaaaaaaaagaaaaaaaaaagaaataaactggaacctagcctaataactggcattcgttctataaataatgaggacaaatgccaaaccaaagagtcctcacattcatcagtctaggtgttggctttctttgggatcaatcagcttctctcttcttccacctcattggtcagtgcaaatccaactgctctttaagactcttaacttcagccagtcctctggaaaagaatgccactggtcactgaaagtaccgatgggtcagtgtaaatccaaccacactgctgagaaaacaattcaaaacgcatttctgctgactgccagacaaggtattgttttatttaaacaataaacacctgaaagacagctgttaaaagccatcacatcattcttttaggtcagtatagcatcaaacattatctgttcactgagtttagaggaagatttctggcagattttgctactagcaatctatgaaatcctatggctaacttgtgaactagggtttccctgtgaaatggaatcacaattggacaatttagggatttccatccctctagcagcagtttagcccaatctaaatttgattgtttccttaaatggagtaatttaattttctccaaatgtctacagactttataatgccaagtccagaaaatgaaagggaaaactgggtcagtttcccaggtaactcaagccaaagaataaaatattgctttgaaattccttataaagcataagttgttttaattttctgaattatcttattcattgtctcagtagtgtaattgtatagtctatacctgggttatgcaataaaatagtattttaaacatgaaagaaaatattagtctcagttcatagttctttgaatatccctgcattttacctgtttgaaagttaacacgaataattaatagagagtacttcagctgctcctattgtgaatggactatcatggggtcgtaggtacatggcaaacaagccaaacagaaagggagaactgcagttttgtgcaataggcatttatataagtaggtataatatgaatgcaaaagaatacatcccgaaaatggtagctattattatacatgtggctacatttcttaatataaaccgtgaaaacaaccattctgaaaagctgtgcctttacaccacatgtaacagtcccacataaagcagaatctccttggtgattacagtaataatgactacgattgaatgaaaccctttagctctcactctcttttcgaaaggacaagtaataggacatacattttaagcaaaatatggcctcaggcactgtagtactgttgatgctttttaattcgaagatttcctaccattgtagttcttcagcacaggttctatggcttaggacagccggctgtggacctggacgcactgataagtcatctacttggacatacaataatgtatctgtgtgctgagaaagaaaaatcaaaggcttttgggtgtttatgcctacttgatgatctcggaagaatgaatcaatttatatttattttagtgaaagataagctacatgaccataaaatataagatctacttcattttttgaaactttccatcacaaattgccaaaagatccttcctgaaaacgtcgcaatgaatcatgctattcagaagccaaacttccaggatcctcttcctgttacttgtatagacacagagacatgcaaagattaattactgtccctttcttaaagaaatattcatttaagactgagataattagaaaaatgtgaaaagaaacctttgaccatcagtggttgtgaaagtggtttttaaatcttttccaaaatttctagaggcttcttgcattggacagggaatgagaaagataaaaagtgtcaaatctgaggccacttgacccacaatacgatacaaaaacttttttgttttcgttgactttgtttattcttcatagaaagatttaccttggagcaaaaaggaaaaagaaatttaaaaattagtgtactatgagaaagaaaaaatatccaaagtaaaacccaaaggaaacttgacaaacttgtttagctaaccaaccagttgatcattaaacaagaatttattgagtatctatttgtgccagtcactgctctagggacccttgagacacatcagggcagggtagagatttctgccttcaccagattccttcctctggtgaaaggaagacaaataaacaaaataaatgagaatttttttaaagtatgttaaaagatagtaatttctatgaagagaaactagatcatggtatggaagttcaggagacggccaaattgcagtattaagcagggtggtcggttttagtctccttaacatttttagcaaaatcttgaagtatgtgagaatactagccaattatttaactatttcaagataattatatgttatttttccaatatagacacctcagaaatatatctacttagcttttccttgaaaatgtggtattcagataactaggtgtcagcagtctcaactatatatcattctgtgaagtcattagtatggcaaaacattaatttacaaaaaaagtttcatctcattggtacctccagtccatgaaaaaatgtctatctccctgcctccttcaaccaataaatttgcatctgaaaaccagcattttaccaatgatttcctagggttgctcaaagtggaggcaagcctatttcatcctcattattgtatgtaagataaatgttaaagtgtaaagagtaacagatatctaaataattttgattgaggataatcaatctttaatacttttttgtacaaatgttctctgtagtacggatcatcaggacatgggtgtctagttagtttcaaccaaagacaatgccagaatcataaataatagggtattaatatgatggaaagaagatattaagataatgatactgtttttgttaaacctttggcagattacagatcaatcgttttaaaatcatttaatccaaatgcacacggtatcttttccttattgtcaccattaataaaaagcctcctctatgcacttttgcaatttgtcatgtaacattagcctcagtaattgagtatttttattaatccatattacagatcataaggttttgatatttgaggctaaattatttactcaaggtcagtaaggaacaaatctggaatatgaacccagctcttatgacttcaggactattacccatcagttacaaggtggagttttactccctcaaatgaaaatcttgataatgagagacaccggcattctagataaaaatctgtgaatggtttcctttatactaccactaaatttattgactaagaataagaagatgaaactctgtttcatgattattagtgtttaactgaagaaaaatctttgaagtctccttaaggttggctattctatattatgatagttattttggttcaaaattgtacaaagttttgcctatcataataagcagcgtcacctttcatgccttgtaacacaaagagggacaatattatattattatatttttagaagatctctaatattcttctctgctccaaaatgttatgattctaattaaagatccaaatttatctagtttaagagctaaagactatagaaaattacattgttttttaacctctgaccagcacaatttaggaaatagcctcctatcaagcctaaaagtgttgatggttgttaaaaatctagattaaaaaagtacatttgcaaatgtataaataacataaagtcattattttggagaagaaataatcagtttaacctccattatgtcataatttgaaagttttgctatttgcaacatatttcagtaaaacgcatctaagtttctattcataccacctcattttttaaactattaaagtacagagagtcctttctgtgctcctctctgaggataagttagtctacaacaagtttagtaaaagtcttgtttagatgatcagtttttcaatgttatcattgtttaaggaatgtataatgacacagaaaactttgcttcacagagccaggattacagaaatacattcaagctgggacttttattagtaatacatgtaacaagattggttaaatcacagcaagagataatacataagcatatactcttcaattagtttttcttggttctactcagaactaatgaacatgtaagctaaagatgaactagtaaacaaacattgaattctaaatagtcacatagccttctatgtgtactgtatagataaaagtagatatttaatgtctgatattataaggtgaaactccggtcttcccacggtctgcggctgtgagttaaggggatccagtattgcaagagtagaggtaacacagtagaaaatttaaacaaatattcttacttcttagtttgtatatgcaccaaacacaggcatttcaacagtaagggtctgtcaacattcacaaacttttctgaacaaacagatgacttattattatgaaactaaatgaggaaatacaatttaagaatttatacagaagaagatacatatcatattttaataaccaaattaggtctatatcagaaatcacagcaaaatatattttaaaaagcataaaacaaatatgcattaggattttagtaactggaagttgtgcacttcacagacaaattcgctatatagcaacacaggacttgaaaatggtataaaaataaaaatcatggaaactgtgtgatctgaatgttgtatctttccaaaattgataaactgaaatccgaacccacaaaatgacggattaggagagggggattttgggatttgattaggtcctgagggcagagcctttatgaatgggattgctgtccttataaaagacactccagagagctctctttctccctttcaagtgaggacacaaagagaaggtagtgatctatgaaccaggaagcaaaatctcactggacaccgactgtgtcagcccttggtcttggacttcccagcctccagacgtttgagaaataagtttctgttacttacaagctacccagtttatggtatttttatatagaagcccaaatggactaagacaaagacaaaagaaaatgtattaaaaaaacaccaaatgctttattcttttctaagtattaataatatcaaatctattataagagtaagtttaatgaaatattattgtggtatgacagtatagataaaaatttaaagcacatggtaatattagatattactcatcaattagttcaggtggaagagttgtatccaggtcttaacaattacaattagctttaacaattagttttgagaaaaatctatctttattacttttataaattatactaatttaagatctactcttcacaaagagaataaggcttatgcactttcagaatgtgtaactatattcttttcagttctacttgtaatattttgctcttctagtaacatgagaagcctggataattaaacagtaaatgtccatttgactctttaaaatggacagttgaaaccaccgcccccaaacaaatacatttaagtcatgaaaatcgcaaattcaagatacaataagaaaaatgttctggaaatacaatggtcaaagagaaagacaagctttctgccctcatagagcttacactctactaggaaaagttagcattaagtataatcacaaatacaaatatgtaattacaattatgatgacttatgaaggaaaagtacaagcctccaatcaaagtgccaacattcgctgataattattaacttgtgctcctgagctattaaccagctattatggcttgattttcatgtataacatattttgacttttttgtaatttaaatagtcattcatttctgataagccattaaagtaaaatataaataaacaatcaaagcaattattggaatgaagtgaccagttacacatacataggaaaagaaacaagaacaaaagagaaaagacatacttcattcaaggcaaacagataaacctaaattctaaatagaaaggagaataaaattagcattatcaatgatcctaacaacaacatcattgacaaatttcaagccccaaaaaaatgtgatccaaatttcatgaagactatttgaatccatctacccacaaccagcaaaagtaaggttggctttgaataacagatcttcagctgccccaaagaaaactataattcattcaaagtttattcttaaccatatccagttaaaggtgacatatctttgtttaggaatgtaaaaaacacaagtaacagactgactctaaagtttgaaacaggatgactaattaaaaataggaggcactatggcctatgagaagaatgagtaaactcgtgtttaattcattgtgattctgccagcccacagcagtggtctctaacatgtctccagctgacttcgccatttttgtcatgtacacatgataagggattttgcagtttccaaaccctgagttgttatggagcacagaaggatcaacatcaactctgtaaggacacatcacaaagtgagaccagtgcttacctcgagagaaaggacttgagaggaggatgaagaaggttatcaaaaggcatgttctttttacatgtgttaattattttttaatgaaatatattcatctatcactggacatttaaacagttagaaaatatttaagaattcataaagaagaaatcaaaataatgaagatgttcttgaatttatttttttatagtctttttttcataaagaaagacattaatccacaaaacttcattccagatcccctgaattcactactcacacaagagaaaagtggggaaattgagaaaattgctccatgattatattgagatataaaaatttaggaaacataagtttacactgtaaatcagttatataaactgtccagacttaaccccgattttatgcacaactaggatttaactccacataggaaattgcaatgtaaagttcctaaattattttttccagatttttttttaattcctccaacagatggcacaaggtggggatattcacataagacagacttggattgatgttatgctttcctttttctgaattcctacttcactttgtaccagtctcacagcacttccattctgtcattcattctaacttgcccaaatgttttcatttccttgttatatgaacactctgtggatgccatgtcatagtcatgattgtatttctgctctagaatatagatttgttgaattaatctgcaattagagaagacttacaatcacctttctcatttctctacatctaattaaacaatatgaaatgggtaccaatgtgatttgcaaaatactcaagtccatctaaaaatcttctctctccatttaacagcaaaaagcttactcgtcccaataatagaagaagaatgcaatgaaaaaaacaaattcctgtcctctgtgtctttgtgctgattgaggaacaaaatctgatgaaaactggtgaagttaaaaaataatgtttgacacacatgccaacagaaaacatttaagactgacatagaaaaactaaataaagttaagtgacacttgacattaagtacaccaaaacaaatatcagctgagtataaacatgaactattccatatgtagaaaatggttgtataattaaaaaattattttaagagttactttttcacaaaataacaaatatacgagtgtatatacttagaaattgtgtatttatacatgcatccatacaaatacacatatgcatacatacaaacacatatacatatactttactcagccagtaagataaagtatattcttccctctatgccatccctaagtccacaaactaaagaacatgatgagaaatgcccacttaagagaacgcagtggatgagattttggcctcaagtaaaaatgtttagaaagcactcaaaatggtacacaaaacctctaaaataattgatacatactgtcatttgcatagttgctagaggcttaatatgagattaaattatactattgaaaatagctgccaaaaccaaaactgtgataacctatgttgttggatcaaagtattcaaacagcatttgtttctaaagctctattttacacatttaaaattgatatcatttcttacatattgcctggctcatgttcagatgctttttcaagcagaaaagttttcctgctagatgacacaaacataaaggtgcagaactgtgaactgtggtcccaattcaccagattaacactgagaacacaggaaagaataaagatattcctgcatttaaactaataataataattaaaaaacagaaactaaatagaaacattcactaacacacagttaaaaatggttgatttaaagactattctatatgtttgccacagctgcataccacttacttccttttaatgacaacattaaacacaatgaggatggttttaaatggcaaattacacatgcttctggatttcgtaccaacatcatcaaagagtacacatgcctgacttaccaagcaatgcgggaatgcatagctagttgataatgcccttaaaacaaagttagtatgcataaaaagaaatgtcttgctcctctgtttgtctctttcttaatactgcctttttaggttactacagtgttcatgtgcataaatgacacctagcagacaacaagatgatgcacccacagcagtaccatttcagtggtgcacatgcttagacttatgtctcaatacagaatggctagggcaggtgtgctccagagctgaatatttgaagatcacatatttacagttcctacacttatttaagtaccattaaatgatactgcagaaactgacaccgaaacttgtagctaatttctaaatatattaattatgtgagcacctgacatgaaaaagatcactctaaagagaaaaaaaagggtgggggcgaaaatggaaacatattgatggatttttcttatcttaaatttataaaatatttattaacacatatacctacctcccagtgcccattaccaatgccaaaaggtctaaatacatttatgtaactcagacacactgtaattcatacagatgatattaagaagaaataaaataatgtaatacctttacttttacctatggatttgatgaaatgggtccatgaagaaagggtttccagacaaagaggataaagaggagaaaaacaacaataagtattatgaacatatgtaaagccactactctctgaaaattaaacaagacatgaaagtataaacaaggttttgaagacaaatggagatgcaatcaggacatgttgggaattctgccttttttgaaggcaagtacatgcaaaaaactgaaaggcccatgctcagttttaaaagatcacacaaaagagagacatacaataaatctacgtagagaaagtattgattctgtggaacactatactcagcattctacaagccagaagccaaagatgtctgcatgttcccaaactgtcatgcatggatgaaaaatggacttattttttggatacagtggtttaaactgaggatcttctttcagacagcaacttctgatggttctcggtttttctttaccataaccaccctttactgcatatgctgataagtatatagaaactttcaatcacaatttcttatgtctcatttatttgcaaatattataatgcaagaaatgaaggaaaataaaagccacaggaacaaaccaaaatcaaacgaacaaagaaatggaagaaaaacacatgaaaaaatgtgaacaaaagatatgtatttaatttgcagccatataatttgcaagcatttgcccatcctttgcagtgatggtttgaaagcagctacagaacaagaaaacactgaaagcagagtggaaaaggaacagagcccataccttggtcgcccatcatcaggtgcgccagaccttgaagggaaacaagagcacagtcagcaataaacaagggagcatgggaaggcagggttgtcacggtgacaaaaatgttcagtgacagacatctcttttcctatgagacatgtctgtatcacagaggcaaatcaaaaagcattctttcaacccctggttggaatgctttggggcaaagtgttctagaactgcgttttaaacactggcatatgctgcactgtgtatttcttccatgcatcagttggaacaaccaagagcacaagagcatgacttaaaatccaaccaaacccctcaatattacatctgccctctgtgccctttaatgagactgttttgcatattgcccccacagggcttgtaattcttcagtgatgaaattacatttttttaaaacccaatggaatacatgaaacatgggctgggtctgatctttttcccctcatcaaaaaatgagcattttataattaaatgaagaaaaaaaaattgtagtcacattgaaatgataatgcagaaatgtctccttgtctgacacatgtagcggctgactaggcttgttcaaatacaaaatgatcattagacatgcagttgtaaagctagaatttactacaaaaaagggtttttaagaaacaatgggtcagctgcaaatacactaaagcaattttcctcagagaacaaaattatttgagatttcacctaaatatttcttaaatgctgaactctaagttagtgtaaagatacatattacagatgtaatttcatcaaggaattctttaaaggacattgaaattcctttatttaatttatttattatttcctgcttgacaattcacttcaaactgaagagcacttctcttctaaataatactactaacatgctttcaaaaattcttttgctattcaagaagttactttttactgaaaggcataattcctagctttttattttaaattcagaaataaagctatttctctatccatgtatatgtctacaatacgggaaaatgttagagaaatacacatttatcagttttaataaacttgtattttcaatttccagtgctatttcagatatatttgaaactttatttgagctatataacattacacattggtttcatcagtatttaaattatctgtgttgttttcttaaaattttaggggtattcaaacatctctgtaggctagatataattacaaataatcatctaatcacaatataacatgaaagttattaaacacagtagtgtgatgcctctgaactgtagcctctctgtattttctgagtgattttaacaaaaagttcacacaggcagattcaacagcttatgatctattgataattcatagtgttttatatgctgatagtggcttatttgtccaggttacatattttttcatttaatttcacttttaaaactactacagatatttccaagtaacattttataagttttatggactaaatgaggaaattgtcttgaagatctaccttttagaaaatatattaggtacttccaacggttttgatgctacatcaataaggatggaaattcactaatccccaaagaattcacattcttcctgctagactttctacctatactgtaaaggtcatattatagatagaaatattaaaattatgattgaacagactttattacaatagcttatgggcctatattctaaaaataaatcttaccatgggatgagtgtgtgtgaaaagagagaagcattcatgctaattaggctgattttaaagcctcttgggatgcaataggattttaagagaaaagaaaagcatttcacaggatggataaggaaatgcaaaagaagttgaaaagatacctctaaaaaataacttttaaactcagttgacatgcacaatataaatgagactgacttcaaaagatattaggcctgcagggtaatatatcatttttatcaagtatatactcacatgcaattaaaattatagtatacaaaaacagaagccatatatggatacaacacttagaaaatagtaatttatgatttcttttaaagttttaatctattttatttaaataacaaaacagaaatgttcagcagctaagcaattataatattatccatgtacgaatcacaaatataatgtttacccctgctactggtcaactctgtattatcatgaagtgttctttcttagatacatgaagtcttggtaaccttaatggctatttatctgtaacctgggatagggagtctttttctaagaaatccttcattctatggaaatgtacatttacagaatgactatatttcaaaatatggtagtaaaataaaatatactaaatgctgtcttcccatatacaaatattagtaaattagtaaatctttatgtaggaactgttaatgctgtgaatatataagttgatagaacatatataatttgataaaaccttccctttcaccattcttttgttatgccttgttctttttgcatgttaacactttgaagatttgtttgtagcacactgactaatgcatttaagttcttaaaaaatgagaataaggaaatatgttttaatttgctggattctacaggaaaatatataagctatataacttcttcaaaattccttgacagagataattttttataaaagactgaataaaatatttagcaggcaaaaaatattacaaatatacttaccaggaatcatatcgaaatgctgtatgctttcatgtccactggccaatggcttattttttaatctaaatttatgtctcttacttatactcagtactttattgcattctttttatacatccaatcattttaaacaaaccaatgggcttgaaatgagataatgctaaattttgccagaatagaataagtcattttgataaaaaatggaaaaaggatcatgcactgtcttatgaaactacaaagaaatattttgtcttttaaagtaaaaaaagcagaattgttatcatttttctcatacagaacactgtaataactattctaagcttcatatgggatgctgaggtctaacaagggttggagttaagcttgaaaaagtttcatatacttgggatggcagggttgagaatgtatgtgttctgtatgaaaagtgatacacaatccagaaaccaacaaatgttcagaaagaagttcaacttaccatctaacttcaagatgtaccctattagtactaagaaataaaggacaaatgagagttggaaaaataaggtagaaagcacccaccttccacattgttgtcttctgaaagcacatgacaaggagggagagaaaaggaaaaacattcattaagcagcatgcagactggaccttgcctttgcatgtcttcctcatgcaaggcaccaaacacatcatgcaagtgctccatcactatcattcaagggggaaaacaaaatcacagggaagcaggttccctcccattggcagcattgataggaagtgagacaaactttcataatactgccatgccctgtgcaaagagtttttaaaaaaatctttcaactacccagtataaagcaaacattattgttattacatgttgctggtgtggtctttctaggcaattatttttaaaagcttttttgttttctttttaacaattctaaaaggttctatttccacatactgatttggccttagattttaagaagtctattggaaagagctatgaaatttcacttaaagatattccagttctaccaaatatattatccatatgccattactgccttttagtatttctaatacctcaattgctttccttaaagaaaaacaacgtaactatatggaactaaaatctgcaatttatttggttaatttatagcatattaatattgtattgcaaatgagaatagtttattggaatttataaaaatgctaacttttaaaaatgttaggtaggaaagtgatcactggaagagaagtccactgggaactgtccataaggcaatttggtttgtcgtgatttaaaaactttgtacttctgttgaggatgtgaatatgaatttgtttgagacaatgaaaatatttagctcaatttctcttatatttctatatatctataaaatacctacatgttttcatatattttgttagtcatatttccatgtgtgtacctatgtatatatgtataaacatatatatccaagcagatttgtatttcccaagataatcaatataaatatataaggtttaaagtattattagtacctagtggaaaattcaagttctatttgagactcggggcctgcaatcccggcaagaaatggaagggaaagctgtcttaggggactagggcaagagcaaggtttcagtagttatcaaaaatgttctaatagtaaactctacccatgttgacattctagtctcatccttattttttgtttaattaattgtactttataaactcatcatctgatcagaggtgtttataaacatggcaacatgcaagtatagaaacttgaaagcaaaaacaactaagaatgtaccatttgattaggttcacctaaaaccttcttaattggataaagttactagtgaattaaaaatcaacaattttgtttaaaacatttcagctgaaaattgaagtatcaacacaggcacatctactgatgtggtgttagcatgtaatagaaaatggctggtggctaaatgtgggtaataacatctttacacaatacttggttttccagagtttatttttaaagaaacaacaaaaaaaactttcaaatatttggtctgtgatattgacttctagtttgtttttgtttgttttttggactgccaatttattaaacaaggaattaggctgaatttgttacttttcagtggtgactttgatgttacacaaacacaaatattaaagttttgttttactgcattatattggacataatacaaagatataaattattgtaatgtttaagatatacttttcctgtatattaactttgaaattgtatcttctgtttaagatgcttacttaacaagattatttaatatgtattgtaaaataataaaatcagggaatttagaggagagtcatgtgccaagacagtatgtcaattgctacagcattatttaatttctgtaaagacgggcaaatatggttgtgaggagcagtgcttcggtagaaattttggtaaagtgtggcctaaaactacaattaaaaaaaaaggaaagaaaagcaaaccaacaaaatgaaacaggcccaggcctgacaccaactttaggaatgcactaagtagggcattataaaaggagttcaaggtcactgattcagtcctgacggcaagttctcctttcatgaccatagatacaagcctaggttttgccatggatcctactctaccatctagcatttttttctgaattcttattcataatgagaacaagcttaataatgggaattcctttaaacgatccaagtcatgtttaatgtgtaaacaaattctgactcgactaaatccagaaaagtggtctgtctcagaaaatttagatttagaaaaaaaaaatcaaagtactagaataaatgggtgatatattaaccactgtttaaaaaaaagatggtgatgatgatgaagacaactggcttggagcagactttccttgagtttccatatactttcagattcaatctcagaataaaaatcctctttcctcttccattctattctattctggtatccatttgctaactttacataatttaaaacttgttaacctaaagaaaatccctacattatttcagaatttggacgtgattataactggtggtagctccagcatttacaaccattctccaggtatttttttcccttctctttcctttccattttatttctgtactaaataataaatgtcgagtcaaaaaagaatagtttatctcctcataacaattttttctttatctttgtaaattcttatacacacaaatgctactttgcttttgagcagcaacaaagacaggtgctgaattttggcatgccacggtgtacaggtaaagcagcatattttggtttagtgtaaggtagaaagcagtccatccggccttacctgtggacactgtcaagttagggaaaatctcttggtttgcagaaaaccctggcttcttaattctgctgacctaatccttgctgagtaaatgaagtgcgtctcttaatcattaactttactacgatgaccacgccacctataaagatcacactcttgctttcttttcattggaaaaataatgaatatagagctgtgaaaaagatactttacattttatttttctttcagataggatgggcttctctcacaaagatgggaattaggcaccagaatatcaatcatgctatgaataatggctgtgtgctgacaagaaggcaagcaacagcctgttttaaaatcactgtaaaagagcatcttcacaaaatttttatcttcggcccccagcttataagaatgcaaggacagtaactttagtttatcattccagtgttctttgcacatactcttaagtatacggttctaggaaaacaaatgaatacaaaaacaaatgtgcttgtttcaatataaagaaaatcatgaccagtaaaaaattaaaatttggaataaaatatcacaaaaatctcctttctgtataatcagtgctaaagtttggcaatatgtaagtctttctctaaatgtacagacagtggtccatttagtgctacaacttacattaaaaaatgaccaaaagaagcttcctgatatcacttgggcattcctttacttctttaatttttggtttccttccttctctgctagatgcctgtgactggctcccctcattttccttgattccctctctcctccatcaaaactgccactactgcgagtagcttctgtcccagataccagcactccaaggtatggcatattacagcaaaactggtggtggtaacaggcagtggaaagacagatgaagaataagattctatttccttcctccatacagggagtgtgctaacttctatccacgtctctctcgcccatcacattacttctcaagcctgtactcctcattttggagatcaaatgccagtacagcagagcttagttcccatggtggcacaggatggagctttgttttttcttttggtattagcagtgaaagcctttaaaaaacctcaatagtctgggaatgcttcaagcactgggaaatggaggaaatcattgagactgtggattaaagcagcagtcagctgaaggaatagaaatgcggcccagaaccaagacgatgttcaaagagaaaatgaagcataaaggtccattatggagacttagggaaggaaagaaatggtcctggacaggaattgggctaatttcaaacatgctttttaacagaggacatcacctcctttttcaatcccagctaaataatattgcaggacactcccacccagcctgcttggagtactcatcctaggaaatatatggagtcaactacaacaaccagtttttctccttcttcactgctcgggaataaaaaatgtatctctaaaccggatgcagcaacacagatgttcctggcatcacactagaaacacttaaaacaatttccccccaaaatattttgttacaaagacatttgtggtatttaattcaaaatgttctatcttgttaatgacaattaaaagaaagaagagaaaaagagaaagggggcaggaggaaggaaaagcaagaaagcctaaagttattgcgatttatagtgattaagctatttgatgaacctgatgaaatttaataactgttagtcaacatattataatataaatcgaatgactcacataagctataatgaattcaatttcaaattttcatgaggaactactacaaggattttcaaatttgttttgctttgataatctcagttcttccccaagtctaaatcttgagagttaacatttcaacattcatttcaatagttggacttaggaaggaacactgaatttaacagtgactgtaaacatggtgacaagcacagtctacagtatgtgtgctcacaccacctatttttattttttattgctgagaaatgaatgcttcctgatacggaattgacagacaacactgagcagagtgcttatcacataccctcccaaccaagcttaatcactgttaaacaactctcctaagaaaggtggctcaggtgagcagtgctttcctttctaagagtttgacgtcatcatattttaggatacagagcaagaaagctcttggactgaggttaagagagtgaacttaaatacaccctacctactttcccaacttaccaacccttctagtggttatgtggttttgacttctttgttaacagatggacaggagacatcctttggcctgtgtattaccatcagagaatattctgcaatgtgttctaggtttgctatcattaagatgaaaagtaggtgaactcccactaataagactaatggtcttcatttgaaagagctgtcaaatgtctactggtatataaatttttttcaccattttttttcatcttactacagatgtttttcaactaaatattaaaatactcttaactttattattctatacctgggttcttagacatgtccaaaacaaatctatttaatttatctaagaaaaggcaaaaatactttgtgatgaaattaaaaatatgactaaaccacattgtaaaaaggagtcttaagtttgatgcttaaaaattacatttacatgcagtgtacagaaaataaaattatttatatgatatgaccgacctgacaattatacattctttttatatcaaagaaaaaatgaaattttatatcaaattaaaaatattttatattgttatcttcacttcaataggaccctcacatatgtaacaaacagcttggaaggaagctattccttggaaggaaaaatgcacagcatattaaaaggatttgatttttcatttcttcagagctcttagtttttcattttatatggtgttaaaaattcactgtatttacatgtgtcagtttatgactaaattaatttcaaagttttatgaaaatcactgaaaattattttaaaaggaataggccattcttagctaaataaattagatcatacattgaaattttccaggaggctctcgggattgattaaaatattattttttttttctggagatggagtctcactctgttgccaagactggagtgcagtgtcaccgtgttggctcactgcagcctctgtctcctgggttcaagcaattctcctgcctcagcctcccacgtagctgggattacaggcacccaccaccatgctctgctaatttttgcatttttttagtagacacaggatttcaccatgttggccaggtgcctggccaaaaaatattacttataatcaggctgagcacggtggttcacacctgtaatcccagtactttgggaggctgaggaaagtggatcacttggtgtcaggagttcgagactagcctggctaacatggtaaaaccccatctctactacaaagacaaaaattggctgggcatggtggcacatgcctgtaatcccagctactcaggaggctgaggaaggagaatcatccttccttcctgctcacttttggtttccatttacatggaatatctttttccacctctttacattaagtttatgtgagtccctatgtattaggtcaatctcttgaagacagcaaatacttggttggtagattgttacccattttgccattctgtatcttttaagtggagcatttaggccattgacatcaatgttaatatcatatgttcccacttacaagtgggaactaagctatgaggacacaaaggcaaacataatagactctggggactcaagggaaagggcaggagaggagtaagggatacaagatacacattaggtacagtgtacactgctcgggtgatgggtgcaccaacgtctcagaaatcgccactaaagaacttatccatgcaaccaaacacaacctgttcccaaaaatctattgaaataatttaaaaaaataatgtgctagaaaaacacacacacaaaatataactactggtatcacttttttttcttaacagcaatagaataaatgagtaagaagactgtgagaagactgaatgatttcatagatcctgctgcaagaaggcagaaaaacctcagagaaaaatactattttcttaattgcatttatttgttgattctataaagtctaagaaactttaatactgcttaatttcctttattaaagaaaaaaaaaggctcccagtcctcttctctagattgttacaataaattgcttcctcaagaaaaaacaaaacaaaacaaaacaaaaaaacacgcatttagaaaatattttgtcctactttaagagcaaaattaggtccaggtttataaatgtgtttacccatgggcattctaaccactagaaatcaaagaaagaattattccataaatttcttgctgtctttaaaatttaaagaaaagcactcgtttcatacccatcacataaattgtgccttccttttaaaacatctgaaacaaaatgacacttttgttcaaagccaaatattttggtaggtgagacaatatattatgaatttgccacataaaatatatttgctctttcatttgagttataaaatgcaaatttggtaaaaaatattactttcattccccttacatactcgctgtgtagtaaatctcctgggaactgagcagcaaattataattcttttgcaggaagaaaaactaaatactatacaaactgcaattctcttttggaaaaaaagtgttttgtgttacagagttataggaaaatagtttgttcataggtacaaccaattctatacttttgaagatattatatatgtagttatttgagttaatgtctagtgactaaactaaacccatatgaatattggtcatgtggaagagagagccatgatcttgattaatccattttatatctgttgatttactgatccataaaatcaaatcaacacaaatacaaatttctaggtaccctaatgattcctttttaatgttttcctgaaatgggcattcactacttaagaaaacatgctgaacagaaagagaaatttccttttgtaaccctaatatagcttcttaaaatattaattccataattcagagaagttcactttactttttaaaaatgtataataagaagacggtatacttaattacttcttcaaatttgtttaaactgctttctatgactaccggcaagtctgcatttctaccaaaacaatttcaagaaaatttaattttaaaaataatctcatcaagccacacctcattatatgttgctttaaaatgtgtggcaatacaatgataccattacttcaaaagctcctccctaaacatcagtaccagcatgtgtgtatctctctaacacatatgtgtatacatatacacacccaattggtatttcatttcataaacaaatccaaactgtgatatttttctcaataaaaatattttttctacaaaagttaacgtgaatagaagaaaaacatttataataaataatttgataagatcatcaataataacacaactactacatgaccacttttcctataaacattttaccttactaataataggcattaaataaattataaacttctcttttcctctttgtatctgttatttcaattttgtttgtacgtattagaaaaacagagtgttttctaactgcatgattgaatatgtaaccacagagacatatggcatatttctaagtaaaattaaaatttcagttccttagccatgttccacatgctcaatagccacatgtagccactggctaccaggctggacagcacaaattgtgaagctttcagtcattacaataagttctattgagcggtattaactacagcttctctgacaatatcttttaatatcaagctattcatataatgtacatattatttgttctttattcaaaaaaggaaataattaaaatgcatgatggttttaaaagcaaacatctatttagagcagggttattacatttgtgcaatatggagaactttgtaatatttccacttaaccttaaaataataacaattaggaaataaacctgataaaaattttattgtattcatttaaaaatgtgtttgaataattcaaactctggacaattattactcttttcatcataagtcttttcctttagacctcatagatgagaaaacgctgaacctattttgatttttaagtaaactaaactagtaatctaatatcgtcttactcttaagcccctcattctcgcagtatgcccaattagatcatttatcattactgtctttaagtctatgaccatttttcaatgtaagagtttaataagcttttaacagagtagttttaaaattaatttaaaaagcgcctttcatcctactatcttatataatgtattctcttataggtcaaagactttccttcctataacatgggcctctttttgaatattacaccatagaaaaataaaccaaatgagcaaataaaatagtcaacatttctgtaagacttaaatacagcagagataaggcaattggataaatggagcagttcacacctctagttaattctagaaaagtccaagatcctattaaggaactactacatagaaataaatgaaccaatgagaaggcaaataaaaactgagtagggagaatagaaaaataatccttaggctgggcgcagtggctcaggcctattataatctcagcacttcgggaggccaaggcaggcagatcacttgaggtcagcagttccaacaccagtctggtgaaattgcatgtctcttaaaaatacaaaaattagccaggcatggtggcaggcacctgtaattccagctactcaggaggctgaggccggataatcacttgaatctgggaggcggaggttgcagtgagcagagatcacaccactgcactccagcctaggtaacagggcaagactgtctcaaaaacaaaaaagtaacccgaatatggaatggtagaaaagcaaaagaaaaaaaaaagtggcaaaattatctatgggatgaaatgatgaaataaaaagtttcatgtcaagaatgagtaagatgtataataaaaatttataatagactttgccaagtctattttagtatttaaagtattttccaagtctattttcagtgttgaaagaatgctggcctgctccaaagattaaatatctttaatgattatagaaaactgacctttttatgttagattagtgacatcaaatctctattgatacatagtgaatgaaataaggcaatgcatttatacctcaatttcctaatgaataacatttaatctaacatttaatccatatgtcccaagcatatgagctgttgtttggaaaataaactaagtattgagaaggaaagatgatttccaaaagatactgaggtcatctgatattttatcagcaccatgctctaaccaactgagctaaccggccgactggtcatctgacattttagcccaaccctggtattagaacaacttgaaagagattacacaacataatgagatgcttattaatatttataatgaagaaaatatgtgttggaaagccagaatcagcatcctgactcagtactatcttatatcttgtactactagagaaaacacacttttacataaaataataaatgacagaaaaccttaatacatttctgacagtattgcaataactaagaaaaaaactagttgtgcaacatgtacagtaagtatgtgaaatggctaatagctgctagtaaatgtagcttgtggcagtacctagtagcttagacaatgtatatcttgcagctatctaaagtaaactatgctcaaaatgtgtaatattgaaaataatacttaacacatggggaaagcacagtggaaagagagtagaaaagtcactgctttctgaaatactgaatagaaagtgtcatcgtttttttaattaatatggctcagagcaatatgaaaactattctggactgagattgagaaaatagacttgataactttaaataggcctaataatagactatgagaattaaatcaatcacttgaaagtttgtaaacatgtatgaaaacgtgggtagtgtgataatttttaaaaaatgaataaattgtcaggaacaaaaaatacactaagaaactacgaatcattggagaatctaggcatttcttaccaatacttcaatgttttatctattcatcttgaagaagaaattggagagagcaaggtgcctctcgttacgagacttctagggtctgttatcacaaataagataaatctaatatactttttctaatatttaaaaatgtttctcaatgctaaatatttaacttgctccacagagcctggcacacagcaaaagaatgtaagaccccttattcaataatgccagattataaagcatcttatttatggctaatacgtatttaatgatgttagccattatattattataattaatgcttccttatacaaatcacaggctgcttaagagcaatgccttttccattccccttcttttgttcagcttctagcacagtatgtatatgtagaatttgcttaataaatatgtgttataaagaataattagtttcctacctcaatttcctgcttggcttctatgaaactatcagtagcatgggaatgagtatgtttcttttagttggcaggatttacttgccgcagtgagctttcttaagttgtattctcacaccagatgtaaggaactcaatcaactggacatgtcatttggggcaaaataaactgaaggagtttagtattagttgccatccaaatttcaggcagtcccagatttattagttaggcatttccaaactttctccatcgattgttgtttatgaagtagatgatgatgatgatgaagatgatgacaatgatgatgatgcagaatacaactgtctcttaaactcaaaaattatttccacttgtgtaatctcattcaattattataaagacatggccatgattagttgagagaaaattaactattaaagatccaattgggtgctaataaagtcatgcatgcctcagaaatggggatacgtttcaagaaatgcattgttaggtgatttcatccttgtgcaagcataatagggtgtacttgaacaaacctggatggtatggcctactacacacctaggctatctggtatagcttattgcttctaggctatcaacccatgtagcatgttactgtactaaatgctgtagacaactgtcatacaaggtaggtatttgtgcatttaaacataggaaaggtaaagtaaaaatatgattttttttttaatggtacacctgtgcagggcacttaccatgaatggagcttgcaggactgaaagttactctgggcaagtcagacagtagatagtgagtaaatgtgaaagcctaggacattactatacactattgtaaactttataaacatggtacatttaagctacactaaatttataaaaaatgaaaattaaggtatgtgtgctcgatggctattatgtcactaggcatttttcaggtccattacaatcttgtggaaccatcatcatatatggagtacattgttgactaaaacgctgttatgccacacctgacttcattgtcaatatcactatcagtatttttgtcagaaccattcaacaagactctaggaagttccaaactttcccatatcttcctgtcttcttctgagccctccaaactattccgatttctgcccgttacccagttccaaagtttcttccacatttttgggtatctttatagcagtaccccactcctgatatcaattttctgtattagtctgtttcacactgctataaagaactacctaagactgggtaattcataaagagtttaaattgactcacagttctgcatggctgaggatgtctcaagaaacttaaaatttcatttttagcaaaatgcctgacacatagcaaaaagtcaataaacatgaggaattaaatgaagaatgaatgacccaatggtaaaatcaggcctgactccaaattctatgttcattcctctgtattagggagttttagcaaacttttaattagtcacaggtaccctacaggcttagcagtatatttataggaagtaaataattgtagatttttaaaaaattaaatgtaggggctgagcgcggtggctcatgcctataatccctgcactttgggaggccaaggcaggaggatcacgaggtcaggagatcgagaccatcctggttaacatggtgaaaccctgtctctactaaaaatactaaaaattagctgggagtggtggtggacacctgtagtcccagctacctgggaggctgaggcaggagaatggcatgaacctgggaggcagagcttgcagtgagctgagatcacaccactgcactctagcctgggcaacagagcgagactccatctcaaaaaaaaaaaaaaaaaaaaaaaaaaattaaatgtaggtagccccattaaaataatgacttacaaagcttcatttagaaatcatattttttggaaaactagcattgtttcctgaatacaaactattgtttcatgatatatttagtaagttaacaatgaaaacatttttagtaaattaaataattttgtttacaatctaaaaatcaactttatttttcagaattttaatagatttatgatttattatttataataaaatatgtcaaacttaaacctatttttattggataggatgcaaatattgaacacaattagattactgacattttaggatgatctcaagcaacttttcttttctctaacaatttgccttgataaacttcaagaataagcaaggtatttaagatggcattctcaggattttggtccaaataattaattttaggtttcacttaaactagtcaccatggtacctaacacgtaaatactaaactaaaataaagctccctctaattaaaacaattcaaaataaccacatcaattatgcacaacagaaaaatacaattttaaatactgttttcagggatactaatctggtaaacatgacatacatgttctgattccagtgcggatgtacatttagaaaattcatccatatagtagttaactgagacatgcagaaacaacagaaccacccactgcatttagaattatatagctgtcaattaaatttttaagaaccacccattgcatttagaattataaagccatcaattaaatttttaaatgactttcttatgaagggattataatactagtcctgactttaaatagaacagacctacgaaatagaattatttcctatttattatttaattctatttatggctcccgaaattgtggctaaacttaagtttttcaatccatgaacttagagtgcagtttaagagatttaatattatcttatttaaaagataagaaaaccagggcaggcgtagtggctcacatctgtaatcccagcactttgggaggccaaggcggaggatcatgaggttaagagatcgagaccatcctggccaacatggtgaaaccccatctctaccaaaaatacaaaaattagctgggcatggtggtgcatgcctgcagtcccagctacatgggaggcttaggcaggagaactgcttgaacccgggaggtggaggttgcagtgaaccaatatcgtgccactgtactccaacctggtgacagagcaagactccatctcaaaaaaaaaaaaaaaagaaaagaaaagaaaaccaaaggccacattgtatgacacaacataaccttgtgctctctgggtcacaagtttgaatacaacttcaaaagaaatagtgtcaataactaaactacttaagaagcagacttcagataacaaacaagatgaaagttgcatactccttacttaaggatagtaagtacaacttggctaaagtttttgttttttgtttttcacattaattttagatgagaaactggaattctaaggtttggttttgttttgttttgctaatagactcctgtattaaaatacaaggggaaaaataatcaaaagtagccaattaaccaataacccctgtccccaaaagggcatctgaaactatgtatatcagaatttgcaaattacaaaaaagaaaatcaacaaacaagttttgccggcctgagatagagatgtattgctatggtttggctctgtttctccacccaaatctcatctagaattgtaatcctaacgtgttgggagattggcctgatgggaggtgattgaatcacaggtgcaaacttcccccttgctgttctcatgatagaattcttatgggatctggttgttggataagtgtatggctcttccccttcctgctctctctctcttctgccatcatgcaagatatgccttgctttcccttcactttccactatgattttaagtttcttgagacctcctcagccatgtagaactctgagtcaatttaaactctttatgaattaccgagtctcgggtagttctttatagcagtgtgaaacagactaatacagaaaattggtaccaggagtggggtactgctataaaggtacccgaaaatgtagaagcaactttggaactgggtaacgggcagaaattggaatagtttggaagactcagaagaagacaggaagatatgggaaagtttggaacttcctagagtcttgttgaatggtcctgaccaaaatactgatagtgatattaacaatgaagtccaggctgaggtggtctcagatgaagatgaagaacctcttgggaactggagtaaaggtcactcttgctatgctttagcaaaggagactggtggcatttttctcctgccctagagatctgtggaactttgaatttaaaagagatgacttaacatgtctggcagaagaaatttctaagcaacaaagcattcaatatgtgacctggctttttccgaaagtgtacagtcacatacgttcacaaacagattacctgatattggaacttatgtttaaaagggaaacagagcataaaagttttgaaaatttgcaactggaccatgtggtagaagacaaaaactcattttctggggagaaattaaagctagctgcagaaatttgcataactaaagagaagtcaaatgttaatagccaagacaataaggaaaatatctccaggacatttagtatatctttgggtagcccctcccatcagaggccttgaggcctgggagggaaaaaatggttgcatgggctagtcacatggcccagctgctctgttatgccttgagatatggcaccctgcatcccagtcactccagttccagtcatggctaaaaggggagaaggcacagcacaggccatggcttcaaaggatgcaagccccaagccttggcagcttccacatggtgttgggcctgcaggtgcatagaagacaagagttgagctttggagccactgcctagagatttcagaggatgtatggaaacacctggatgtccaggcagaaatctactgtgggaatggagcccacatggagaacctctactagggcaatgcagagaggaaatatggggttggagcccccacaaagagttgccactgaggcactgcctagtggagttgtgagaaggcagctactccagaccccagaatggtagatccaccgacagcttgcaccatgaacctggaaaggctgcaggcacttaacaccagcctgtgaaagcagccacaggatccataccctacagagccatggaggtagagctgcccaaggccttgggagccccactcttgcatctgcatgtcttggatatgagacatgaagccaggggagattattttggagctttaagatttaataactgccctgtttggttttagattttcatggggcctgtagcccctttgtttgggccaattcctcccatttggaaagggaacatttacccaatgcctaaacttccattgtatcttgaaagtaactaacatgtttttgattttacaggctcacaggaggaagaaccttgccttgtctcagatgagactttggacttggacttttgagttaatgctgaaatgagttaaggtcttgggggactgttgggaaggcatgattggttttgaaatgtgaaagagacatgagatttggtaggcgccagggatggaataacatggtttggctctgtgtcccacccaaaccttatcacaaattgtaatccccatgtgttggagttaggggagtggcctgtgggtggtgactgaatcatggagcagacatcccccttgctcttctggtgatagaattcttaggagatctggttgtttgataagtatgtggctcttctcctttgtgctctctctctctctcttctgccatcatgtaaggcatgccctacttcccctgcaccttctgccatgattgaaagtctcctgaggcctcccagccatgaggaactgtaagtcaattaaacctcttttctttataaattaccaagtctcaagcagctccttacagcagtgtaaaaataaactaatacgcggacttcacatgttaggctagtacaaaagtaatggtggtttttgcaattacttttactggcaaaaactgcaattacttttgcaccaacctaatataatcatattttcattttatagattagaaagctatggtccagagtggttaagctgctaataagtgtcactggcaacaagacatactttctaagaacatttctatttctctttttagaccagtgctatctaatagcaccttctataatgatggaaatgttctatgaaacttaggaatgaattatcaccctaagcaagactaattctctatatgtaactgttcacatctagaactgtgccctgggaaatatcccacaggccttgtagatcttgatgagaagcaatcatcccaataagaattcctgtttgtgaggacttctgtgtagctctggtaaaaataaaagaaggctcatgatcacctagcccagatcagtcttccacacaaaggtaaagaaaaatgtaatgtgaaataacttttttctgaaaataatatatgttgcagagacagtcagacatgttagaaaacagtagagagagaaaataatttactataattgtatttcctcatcctaagcaactccttacaacatttacttaagaagcaaatattatttttggaagaccctggcatacgatttctgacaaatgatggaaggaattggaatggagaaacgaaaaaccatcttgcatctctgataaaatcaaaattggcttcagcactcaaaatatgcagggcttggttgtttttgtttagacagaattaaaaaggaacttgtagatcttattttagaattgttttttcacttggctaaaacagtaagcagtataatctggtactataaaagcaggactatgtatttagtttgccaattgttgtgcaaaaataaaagcaaatcttggaaaaaaagttgagaagggctgatccattttaggcactggttacacaaattataaagaatgggtataactctcctggtgaagaaattcacagctaagcaggaaactcggggtctccaacacaaactactctctaatgtgacactgggaaggtctttccacattgtgagcctcagtcaccctatctttaaaatggagataatagaatctacttcataggattattttaaggacaaattagtaaaaatcacatatattatgtaacacatagctaatgaataatagacacccaaatactttcctacttccgtttattcattttgtataagaaaacaggataaaaataacttaaatgaaaccaaacttttaaatcttaacatatttaccaacaattttcttatcctatacttctatctggcaaaaggaaattgtatactgagtaacagcaagaatctgaatgccaattgatttccaaaatggtgcagtataattaggaaattcatgagtcaaattcctgtttatgcctgtactgcaaaggctaatcatttgtttgttttctataagaaggacttgattaaagcctctagcagcaataattaaccctgtgcttgaaggatgcagactcaactagcactgtgtgtgctaaaatctgtaattaatgcataggaatgcatgtaaattaacagatgagtgtcatttacactgatggtacaaatgcaggtttctttttttgggaattacttcagtgttttctgctaaccattacatactataaactcagactgatgtaaacagcattctaacatctacaaagagtctctacttcagaccatgatctagatgaggggttggcaaacttttctacaaagggccagatagtaaatattttaggatttcccgaccttaaagcctctattgcagctactcaactctgttattgcaatgggaaagcagttacaaataatacataaacaaacatataggctgagctcattggctcatgcctgtaattccagcaatttgggaggccaaggcaggaggatcacttgagccccaagttctagaccagcctgggcaatatggtaaaaccacatctctacaaaaattagctggtgtgctggtgcacatctttgatctcagctactgaagaggctgaggcaggaggattgcttgagcccaagaggtggaggatgcaataagctgagatcgtgccagtgatttccagcctgggtgacagagtgagacactgtctcaaaaaataataactagatatataaatatatagctccctctctctctctctcttactatatatatatatatatatggctatgttgcaataaaactttatcaaaaaataggtaatgagccagatttggcctatacaccatagtttgtttaaccctgagccatagtttgctcatccctgacctagattctaattattaggtaatacagcatactgtataatcttagaaaatcaatatttatagattagatacgggcactgaaatataaacctgatgtgaaaacctgacaagtttctgaacttaagttagtctccctcctcacataaaatttagataaaacatgacagactgaatttaccacgactttatcgtaagaaacaagtgactccaaaatatgaaagtacttcagaaaaacagatatatatatatatatatatatacacacacacacacacacacacatctttacttgtaaagtattattattattattattattattaattggtcatcttttcagctctatgttttaaggcacctagaggactcacttactctggaatgaccatagaggatacaaactacacaaaacatactcagagctgatccagtaatgctagaatttaagaaacacctggcagacttaggatcccatggggctgccatgttaaggaagcaatttctaaagtcagacccaaggtacactagtcatgagagatgtccgtcaagaagtccttcaccagtaagtttggaaatgctgcatacgacgctatgaacatgagcttaattacactatgagcattagtactaaagagatatttgtcaaaaagttcttgacaaataagtgtggaacacttacacctatttcagaggctcacagtgaattattataaacttaagatgctaagatgtcctgcataaactgtgcacctttgtccaatttcccaaatgtgtatctattgagattctttatcttgtgggtgaagccaattaacagagctccccaaaactaactttgaggaaagctttcatatagattattctgaacagttacattctttcactctgggtgtgagaaaactgccctactaaacttacatttttaaccacataagagcaaaaacactcatttaggtatttacttacatttaatttgtctgtcattataatggaacttttacttataaacaattttatggaacccaaccaaatttataaaattatttaaagcagtataaaaattacactcacctcaatatactttaaaaaaacgcaagacttattccaaacatgaaatatttctgatttaaactttaaaaaatcacagacaggtatctactggagcactatcaagacacagtgacttaaataactttgtgctgaaggcactaaaagctattaaatccaaacatttgttgcttttgctgaatattgcttaaactgtccatcaggaaagaaggttgaaaaataactgcatagttcatgactttcctatatatgtggctttctgattattgggtttcttctggtggctttttcacaaactatttaatcaagaaaggcaatcctattcttactgggcagggaatagctaagtaatgatttctcttaattccaaatgtttctttcatttgcaaccagaaatttcttacatgacaaagacaaacatttttgtccagtcatgtattttgatatagaagttgaatctccctttggagctaaacataaaaattaaccaaaatcaactcatatcaaaatcaacatgataccctttttctagcatttagcagtctagcataatccctgacatgtactacgcattcaataaatgtttggtgaatgaataaatgaagaaatgaatcagacatttgtcaaatactgtagttcaaatatacaaatactattattttaaaataatttatattgaataatttaaaaatatattcttagtccaaatatccaataattcaaaagatctgaaacagtgataatatgttattacagttattcatttcaatatcataaccattcttttcccatgcacggcaatggagaactaagaaattttattctagacaagataatatacccattcatgatacacagacactagatacataaaacttaattatagagcttagattatattctaaccagtgaatatgcttcttgtgatttttggaccctagaatccatcaattaaaattcaatatcataatattcccttacagaggaatagggcactcctgccttgaatgcttaggcaaaggtacgtatccaaataaaaccaatcatgttaaagctacgaagggtttccctcatttccagtgaaatagacatgtataatatctacttaacagtacacttgcaaattttttcacattagtgaaaagggaaaaacttgttttctcatcacgctgagtatcaatttgataagtttacataagccacaaaatattggtttcatttattcagacagataatatggttcctaccatattccattgccatttatgaaacatttgcttatctcaaaatacattaaaaaatccttcccacataatcctggcaagttatttattttattttaaaatatattaatatttcagaacacacttcccaggacatccttacaacgcatatggcacagacaccacatttcttcaataaaaaataaaagccatttgtctctaaatacacttgaaaagatttcttgaggtaatttttgttttctttactctcaatgaacagaattattaacatctgaatattgacaactttttaatcatcaaacgtccattatatattatggcaaaattaataaactgtaacatggcaatttagatagatccaaaatttcacaaatgatataagatattgttctaagtatttatacacataaatcattgctaatccctggatgccttttataagtaaaatagccagataacaaaagaagcaataaaaaacacacttaaaatatactgtgcaaggaaagtacaattgaatgcttttaaaaatatcagtactctgggcaggttaatatttgccaaaatcgtttgctcctttgaggtttgctggttgatctgaatttattggagttcatttcattgctttagaactcattagcattagaattctgatgattgagggagcagctaatacatactgccccatttaatcttagagtaggcttctaaaataatagtaagaattaaccactttggaacctcagagtagccatatcacaggcaaatgtctctttcaggcagtcactaattgagcccagttactttttatttgtccttcaagataccacactgcatagagcttatttggaagtctaattttttgtgagaactactaggttatttacaagtagggacaatgaaacagacacactttcccttggagactttccagaatactgtgagtttcctgaataggtatttccatgaattcaatatggcttatccaccaattttggatctggtggaatacaccaaaataaaaaggcttactacaaaagctgacaaccagggagcagaaaactgctagatctgttctataaacccaaggaaatatatataattaattagtccagcatttgttaataagaagactgttcttaggactgtcctattaaaagttgagtgagaggaacctgaaaatacctttgtcactattttgtccaattcacttaaattatatacataaattttattacatattcttatctccataataacatgtggggctcaaaagaaagggaaaacattcactatattcaaccatataatactgagttgaaatagggatttagttaaacaaaaaggatgaaagtgttgctggttttaaatgtgtctaatttagttacttacctttcatatcaattctgatgtttccaagagtcagataatggcatcaagaaatagacttggctgaacagtctacacatactcatactgaaacatactctttaaaaatattattaataaagttaataaaatcaaaatgaggaatacaagggacagagaaggccacaattctgatacaataattctgcttcatctctagaatgaaaaaatcattctcactctcattcttcctagtgcaatccagacatcctgcaaagttttcccatggtaccacgtttctgagcataatacatggtgtggtttcattcctactcaggccttcattctcccaggagcttcttattgtttttataataaaagtatcttctgacttcttggaaaaactaggaggtcaaaataaaaacttttcccagaaagcttttaccggcacagccagaacttgctataaactaatatttgctacctttgtatttcatgggttagatattcccacagatgagtggttccagagccacacacagccttttcttggtattatatgtctcatctatttctgttgaaagtgtgtatgtacaaggaagatttggggaaaactacaatttgactggagtttgtaccatcccctgggtatcatgctaacttacataactgtgaaggcaggaggagattaattgaagtaagaatatgtgtgcaagtgctagctatttgctaagcagaataacaacactggaactatctcctggcctgatgtttagagcaacatataaatgctctcaaagcttttccacttgtttctttttttccatagtaatctgggaaagtggttgcattatttcctttttttctggattctacaaatcttttaaaacatgtgtcaaggtattagcttcataaatacttcaagtaggaaaactatacagaagggaaaatagaaatgtgtggactttggagattgcaataaaaaagaaaagataaaaacatacatgtcaaattatatatctagttattttttaaaatcaatttatcagaatacccatttgacaatttaggctggctttcactggagaagcacattaactcagttaagtgtctgaatttcttccgttaaagagaaaaagaaggcaaagtcagaaaatcacatattaacaatgaattgaagactgtactggggcgtgcatgtatcacggtttctcacctttgttgctattaacattttgtatcggataagtctttcttggaagggactattctgtgcattttagaatgttaagtagaatccctggcactaaatgctactagtgtgccccgcccaaattcacccccaattctaagctgaaaagcaataatttttgtaacattatttcggtaacaacatttaacagcattttggtaataataagcagtcacacagaatgtgagtgtaagcgctagggtccatgctaataactttttacaaagataccttgtttattaaccacagaaacaatagctttagttctaattatcatctccattttacagaaaagaaaacagagtctcagaaatattaaataacctgagagttctagtctgtaatcagtggtcagtgaaattatgtcatggctgtttggaaagctaatataacaagacatttctttcatggaaaatggcagtggactgaaatttaatcagggcctctgttctgacctcagccaaaaaatgtgaggtccctgtatgtcagtagtaatatactgggaattaatgtattagattgtattcaattgctcaaggacagctgtttgaaacaatgtattagaaagaataggttacagctcaggataattccttggagatgtgccttgggggcaacctgagggacaaaaggggatgagatgagaggagatgagatgagaggagtactatatctgaggcacaaagcctgtaaatctgtgaatgcatatgcatatatggatttcacaggatcagagaatgtgctgacctttagtgggtaggggttggggtactaaacgtcccataatgcaaaggacagtacagtatgctcattgagctttcaaatgtcccgccagatacccaactggatgaataacttgtgtataattatctgagcctagaacctagctttaagtaaattgaacaccaagtatttttggcacacctttatatagttcactaattttttttcagaatacaacaactatgcaaacctggaggagtttaaaatatatttggtttggaaatttaccaagaattcctcactatttcaaaaaaaaatgtcaccaactgtaacatctctcatagtatgagtcaccgatgtaacacagctccattagtgtgcaaatgtagcttcatattcatgcttcttttaggtaaaagcagctgcctacctcactatgtcttctattaccctcatgcctgaacatctgcatattgagatacacagaattttataaaaatatgtttcctcatatttttccttcatattaccattatggaattatagtgattttaaaaataatatatgttatataatctatgttatctatctcatataactggattatctatgaatttcatttttagagtagcaaaactgtacatgaataaatatatatatatatatatatatttttttttttttttttttttgagacggagtctcgctctgtcgcccaggctggagtgcagtggcgggatctcggctcactgcaagctccgcctcccgggttcatgccattctcctgcctcagcctcccaagtagctgggactataggcgcctgccactacgcccagctaattttttgtatttttagtagagacggggtttcaccgttttagccgggatggtctcgatctcctgacctcgtgatccgcccgcctcggcctcccaaagtgctgggattacaggcgtgagccacgaataaatatattttataaaaagaatatactgaatatgagaccctgtcaaaaattctatcttttctcacacatacaaatacaagacaattataaacttaataaacattatttatagaattggaccagataatttaaagaaaagagaattctacaatgtaaaaccctttaatataagctgttttaataattggaaaacagaatgaataatgtttttgtttgtcatgcccaattatttcaacaagtttttattaataacttgctacatggtaggcacagctgtaggtgttggagatatagaggtaaacaagtctgacatgatctatgctaccacggagttcttattttcaaagtggaaggtagaaaataaataaaaatgaactagaagagcaaagtgcctctgatgagcatgcagaagcatgtttcaaaatgtctgtggtgggataaatagatcagcaacacaccaggccatgcaatttggcagcaaatcacttctgcagtctagctgctgttttttctactctgaatcatactccccctttcgtcatctatgccagattccactgagcttcaaccctaccctcccattttacatacgttgccattttaattaattaagtggaaaagttttgacccatcaaccagagctcaagctgctagaagaagtgaatcgtttcttatgcttctttgtgctccattgtgtccccagtaaagtggtgtacacaggaggtaatccataatgatcaatatatatggaggagaaaatactaagagagaggaacactgtcaccctggcaagaaagggcaggtgaatgggagactgaatgggagatttaagaagtagactctgactctcccttaataacttatttccacttcctgatggaattgcacaataggatgagtatagacccattatgaatagcacatccattgaacaaagttgaaattctgatttagccatttattattgtaaccttaggcaaatacctcaatgtctctgagtcacactttcctaacagagaacaatgaaaacctaatgaggttgttacaacataatgcttcagaagcccataacaaattgtctggaatatagtagttaagtcaataagtatagttcattttcagttcactattttaagagttgtgctttcataactggcaacaaatggtataagcattttacgtcatcaggacatatcaaacacatcatacatcatgtgaactccctaaaaattgaaattgaagaaaaaagctacaacaagaaaaagtagtattacagtatttctatgttcaagtgacaattttttttttttttttttgagatgaagtctcgctttgtcacccaggctggagtgccatcgcatgatctcggctcactgcaacatctgccgctgcctcccaggttcaagcgattctcctgcctcggcctcccaatagctgtgattataagtacccgccaccatgcctggctaatttttgtattttagtagagacgaaatttcaccatgttggccagattggtcttgaactcctgacctcaggtgatccacctgcctcggtctcccaaagtgttgagattaaaggcatgagccaccacgcccattctcaactgacaaatatgagtcacaccaattgtcattacatggtatattgtagataggttaaaagtaaaatcaaagggacaaaatatagagaccaattgaataaaaaacttttcatagctgaatcaatactttctaagcattcaaggtaggaactccttagcccccaccctcctaaataaatgcacataaaagcacacaccctttttaatggtactaaaagacctagagtatacattttaatgaagttaatcactacttcctctctctgagtagaaataatacatatcacatataggaattatatatatcaaatctcactccttattttcattatatcttgtttctctcaggatgttttctttcttcaaatgaaagtcaaacagtatgatattacattactgctcaacttcagctttaatacaattattttaaagctattcaaccagttcttttgaagggatggcgttatgtggaccaccttgtataaacttcaattctcaagctctctacatattgctgtcaacattcagttcattgcagagcttaaagagtatacttcactgatgtaaatgctactcacacagagtccaacccagagcgggttcagccatttatggggcagaacagggacatgcaggaattagggcatagacagactcacttgaagggagtaagcaatcaagaaagttccagcagagctgggaaagaaacctgaatgggtagataggtagtccaggcagtatgctggtacgcagtaggcacagttcaaagaaagaagagaagcaggcagggaagctggaggaataaccttggacaaaagaggtttggtcagagggcctggcatgcaaagcttacttccagttctttataaactgtgaatcaaggcagagttggagtttctatgaattaggtactcaacaggagcttcttcacagacgtccttattactaaaaccagaattcactgtcagaactggaatggcaacatgagagacttgatggtatcaccaactgggtcaggatgcaggatggttccaggacctggagagattggtgtacagcatttttgctataggagataaacagatttagccaagaagaccaactcaactggcacttacacatggggtgcagcaggtgaggaagacagctgggaagataaaaaaagggaaagaagcaggtgcagggtgtatttccttcatttctactcatctctctctctctatctctcacacacacacgcacacacaaactcttacataattgtctggttagggaagtaacattttaattcacagctgacatgggtcactattcatacaataaaacatataaagtggaggctgcaaataattatgtaccagagattctgtgagcaggatgaaaaccatagttcacaaaactgttagtaaataaaaaacaggagagggacggctggccctgactgtcaccagctgtgtatagtcacagctcttcagtggagttcaaagagtaattacagaggagtgagttaaattctgtaactgctggttacacagcatttaatgcaatgatccatttagccatcatgctccttctttaagaggaaaattttaaagcaggctttttaaaaagtgacattgaaaatatggcagcttaaaagtaaattttattagtaaaccacatatgaaagctttgaaatgttcccttaagctatgtcaaaggatcataaataagtataactgtcaacagcagaacagtgccatttttatatatgagtagaaagcacagagaggttaggcaactcatttatgccagacagttagataacagcaagttgagattgaaagcaattctcttggatggatacagtgaagctgcctttcttttttacatttcccaagaacatatttagagaaaatgcaacacttcattctcaatcataacttagcacagaaactgccaaatagaaagtgtttgataattactgaggggggaatgattgaatttataaatgaataaattatacagcctctccaacaagttctgtagctacagactggggaggacagtccgttttcccagagtctgccgggcagcagctgggttagcaaaacacatgaaacatgtttgtgagaaaacagcattggaaaactagtgcctggctctaccctaaaaactcagatcctcttgaggtatgattcttttttaaatgtccagttagttcttccagggaagcaaggctaatacggttgtctcccttatccacattttcactttccaaagtggctgttaccagaggtacacaacagtaacatattttgagagagagagatcacattcacataatttttattaaaatatattgttataattggtctgttttataagttattgctgttaacctcttactgtgcctattttataaatgaaattttgttataaatatgtatggatagggaataacatagtacacaggttttagtactatctgcaatttcaagcatccactggggggccttggaacatattcccctcatgtaaggggagtaatcgctatacataatactagctacttactcactaacgtgatgggcttaaaacaaatacactttaaaagtaagatttagctgggtgtggtggctcatgcctgtaatcccaacactttgggaggccaaggtgggcaaactgcttgagccccagagttcaaaaccagcctggccaatgtggcaaaaccctgtctatactaaaaatacaaaaattagctgggtgtggtagtgcatgcctatagtgccagcgactcaggaggctgaggcaggagaatcacttgaactcaggaagcgaaggttgcagtgggcgacagagtgagactatctcaaaaaatatataataataataataataaatttaatttaaaaaataaaaagcaagatttaacatttatagagcttaatcattatttcgtttactggcctaaatgccttacagatgacattcatcctaacaaactcaatgaggaggtaatatggtcagccccagtttacatacacggaagctcaaggatgggaagatcaggtcttttccccagaatgaaggagcagagggagtttgaaaccagagctgacacttttaccacacacaatagtatccattaatatgaagcaataaggatgccatgaaagatggaattgggagtatgtggggttagaataagttagctaaaatgttctctatgcttggaatgtcacggtagtgactaccaaggcttctttgtacaatactcttttctcaagatttgtgcccttgggtaaatccctattccatgattaaaaataaaaattcagtaaaagaacctgttggtcaagatgatgcaagcagacatcaagataaacctggtttcaaattttggcgctgacacttattagctatgtgtccttgagcaagttatttaatctctctcagcttcattttcaggatataaaaggggaatcataataacttacataaattttttatgaggttataaagttctgaaccaggagccattacgccccataaggcatttttggttatcataactgggagtggatattaccggcatttactgagtagaggccaaggatgcagctaaatatcctgcaatgcacacaatagccctacaacaaaaatttacccagcacagaatgccaataaagccagtaagctgacaaatccttaaagaaatacatttgtgatatccctggcataatattagtaatcaataaatgattctgcggctttatcatatgtatgaaatttgtgaagtaatttaggccaaagttttaaatactaaacactaaaggattcttattccttctttaatccagaagagaaaaagtgatttattcttaattacttttgtcatgtttgatttcttgtaaaatattgttttttctgattcttccccacattaaatgaaattataatacatttcaaatgacatttaaaacaattcataagttaagctatcattctggcccagaagtcttggtggcttataaatgatttatagtatccactgagaacagtggagaatattttagaaatgaaaataaaaaacaagggatcattcaagagttagctttttttgtagtggaatcattccacccctctctattgtctaaggaagtaagttgcagcacatctttaagaaaatgctacagatcagaatcctctgtttatttgtcttgcgcaattgtctcagtgcctttctgggccaaagttttgtttcgctttgtttctgaaagcatcagtcctggaaatgggaccattttcctggaatatttggaaagattttaatcagaaagtgtggtcaagggaacgagagattcctatgttcaacagagaagacagctgcaaaataaaactccttgctttggagctcaacattaataagctttctgtgtacccagtagaattctagatacaagtataagcaccagaaactctcaaacgacactggcttttgtaaaataggatctcaaagccttcatttcagctctcaaaagttaacatatatactatttacaaattagtaatttgcattcttcttttacctaggaacatgtctttacaaaactactattggtgaatgcttttgtaataagcttgttttttttaattcatttatggagtatttattgatatttttatagaaagtcaactggtttttgtgaattgatcttgtattttgcaaccatgctgaactaatcagttccactttccttagccttttctgtatgcaagataatgccatttgtaagtagaggtagttgtatttcttcctttctagtctggatacctcttagtttcttttccttacctaagtgccctggctagaatctccaagacaattctgaatggaagcagcaagagtgagcattcttgtcttgtttctgatttaacgggaatgcagtcagcaatcattcagcagctgtgtgatctcagcagctgtgtgaatttcataaattttctttattaagttgaggaactgtccttctatttctagtttgccattacaacgatttgtttccaaacattaaactaacattgcattctacatcctacttaattatgatgtggtatcatttttagattttgtcgtagtgtctttgctaaatttttcttcagaatttttgtgtctacattcatgagatatgatctatagttttttaagttattttgtctaactttgatgtcagtataatttttaaaacagacaataacaagtgtcggtgaaaatgtggaaaaattgctgatttttcttatcatacactgctgataaaaatgtaaatgatgcaacccctttggaaagcagtctggtaggttcttaaaatgttaaatatacagttaccacatgacccagtgattccactgtcatatacatactcaagagaacggaaaatatatgttcacataaaaacttgcttataaatgttcaaagtgttattcataacaggtaaaatatggaaacaacccaaatatccatcaactgatgaatgaatgaataaaatatgctatattcacaaagtcaaatattattcagccataaaaagaaatgaagtactaatacatattacaatattaggacattatgctaagtaaaagaagagagtcccaaaatgccacatcttatatgatttcatttgcatgaaatgtcctgaacaggtaggtctatagagctataagtagatgaatagatgccaggaactggggacagtgaagaatgggaaggactataaatggttgtgggtttctttttggataatgaaaatattctggaattagcatgacagctgcacaatcttcggaatatgctaaaatccactgaattgtacactttaattttatggcatgagaatgatatatcaagttacatgttatgcacacatacacacatatgcacacacatctattgctgatctcagtttcaagaaacatggaaattaaaactagaaataacatttcttgatagctcatgtaaacatgctgttttaacaaatgaaaacttgagatacagagaagttaaatgacttgtccaaaattgcaaagttatttatataaaatttcaaaaaattacttatagtcctggactgcttctataaccattttcttatacacaaaaattctccgatgttgaaatcattaaaacaaaaacaaagtactactttgactcttccactgttctcaaaagaattttttttttcatgtcatgttgctttctcttaagttgtatgaaatgtcctgggactcctcttatctaacagatgaaaaaataaacattaaagatcaggtatttatctccataaaaaggttagcgagaaagagaacaacagatctgcctccataaggcattaattttccatatcagatggagacagaagctcttcaaaggacttaacaactttttcccagctttctttctctcctcatccctccctccctccctcccttcttccctccttccctcctttccttcctttcctacctagcaatgtaacttttcttaagtagtcctctcttcttagggtaaatgtactccgcattttaaatgatttgaaacctaccaaggtctgttttgacctaaataatggaggcttaaaaaagaattattacagaaaataagcactgtggtaaaccccaagctggtgaagttggtgcacaacaagagagacatattatcacctacatggaggaagtatatatgacacccatggaaggaccacacaaatctatgaatttctagaccttgcttcctctcaggatttacctttagcttctcaggcgtgaacttgcagaagctctctgccagaaatgagtgctcagagtattatttacactctgcctctgggcctatatcaggggactgcaagggctcttctaccctgtatgttagcagacaagatgtaaacgtttaaccaaagcaataaaaacaaaaaaaagcaaacatacatcaaaaccaaaattgtgtatttccaagaaaattactattctctactgagttctcacaaattaacttgtaacttcatagtcaaaatatgatataaagctaacataatttaagcaactgtctctgttaatccttacattggtctcattaccaccattttcgggtgagtagtatataagtttttgtaaaaattaggtaacatttggaacaaatgaacacgtgacttttttgcctactctctatttacaaatatgctgatacagagataagactttaaagattatatgtccattgacagagaaataattatttattcccatccactatgatatttgtttctctcgataatcctgtgaattgactcaagcatatatgatagaggcccatttacacataagtacatgataacatgtattcaaattactgggaaatcttgttaaaatgtagattatttttcattaggtatggacctaagattctgcatttctagcaagctctcaggtgatgctgatgcttctaattctcatatcacactgtaagaaataaacacactctaaccactagaaaaaaaagggttatatatgagatggatccatcatttgttttaaataattgtactatactgaccaaggctatagatgttgatctaatcatatggtttattgtcttccacaacaacaacaacaaaaaacccaaccagatgctaggaaaaaaacacggacttttatagacagagtaatggggaatacttaaatctaggaagttaaattgaaaaagaaaggctataatatgattcatttgaattaagctaagctatttggagaaaaatcattgtaatatcatcaatcagatcagatattttaaccaatgattctagtccctccaagagtactctctgcttctggcccaaaatgaccccaaatggcaatccagacacagcatttgtgatgttgaatcagggtcaacaaggagggattttgttaattcctttcctcataatattatcatttgtatatagatacatacaaccatattctccacaaaatgggttagtataccatctgttatcttagaaaatctagacgcttttctattagctattacaactgagaataatttctggactaggcctgctagttaaaaaaaaaagaagaagaaaaatttaaataaaaaactaaaggcaatataagaaatctcaagcatttgcagaataaaattgcattttaccttaaaataacttttgcaccaatgaatgattctgagactgctgctgactattttccaaattaacagaatactctcaccttcatttgtattgagagtttcccatacttgcataaataacaaacggcatgccaatgtattctacatctgtctgttccacaattgagatgttcctgcagttaatattaacaaaaggcgcctctcccttcggtctgtaattctgtcactgttcttcctatctactttccagttaaaattctgattatcttcctgagtatcccttgaggcctcttgtttcttttttagtagttgctaggcaagttctatgagaatgctttaaaacatcagaacaatccaatgataggtatcctcttatagaatgcttcatggaaatttaaacctggcctccacacattacagcttccacattaatggtattctctatatattcacagagccaagtgcttggtttgtttgtttgtttgtttgtttgtttgtttaatttcccaaagtaactatgttcaaggccctgagacccagtctacaagcttatgggatctcattgtcttatgtcagctttcttatgttgatggtgacttaactattagttttgcctctgaagttatgattttgctataaattgcctttagttttttgagttttcatgaatgttgattataaaaacaaattaagcttcaccaagaaatcaagttgaccagttctgtgttcaattaaattttcgctcccaaatgatctcaattttccagaccacaggtgaatgcttcctaagatttcattcattatcagtcaaccagcaagtactgaatatgttccacatgtttagcattaaagaaagcattctgaaaaatacagccaagatcatcagaattgtgcaaaaatggcttagtcctgttgtctagggattaaggaatgtctctctgaagtaggttataggaatagttactttacaacagatttttcccaaggaaaagaaactctatttccttcacattaaaagtacacaagtgttgtcttaattgtacacaaagttgagaaaagcatgtgttgcaagtgaataatttccctttttgttctttaatctgactaggaattgcctcattaatctgcccatttttacttcaccacaacacttaccaggatgctgctgcctattaagattgttctgatgttaaaaaacaaacaacaacaacaaaagaaaaacactgactcagacatggcctttctaaagtgggacagctgtctaccttctctccttcccttttccctccttatttccttccttctttctccctttcactttcctcctttcattccctgaaaacattctatactggtcaaatggacaacgaggaaaactatatgtagcagtttctttaatgtatctttgtatatgccaaagtacttccaccttactatctttcctccaaatgctttatttttaattttccccaattgacaaatttattttgcaagtatataggtttgaactatgtgtttacacacaagtgacacagagaattcttcagcagtcattattcatggagatgttgccagtttacctgaatgaggaagacaccagcattgacatacatgtttaagcaagatacggtgatttttcccttgaatatataaaatagcagagtgactaactgatagtggtgttacctttaagcagattcctctattctgttcatgaagaatgtatatcttcctaaggaaagttgtgtttgaataaatgcctttcttctgtgtattgaataacttagaaagtgcttctttcaatttagcatacacaatgttctgaaaatagccaactcaataaatatttgtttaatgaattatggtatccttgcactaggcatcagtccagtttaatttgagctcaaataatacaaacatatgtcattgtccttctctttatgaaaaatagagcaacatgctaatcagcatttaattttttgcctactatgcagaagaatatgaaatgaaggtattaagatccagttatgctatttagtgtatgttatttcgacaacgattacaaaatctttgtcatctcaactattgatacatttgaaattgtccagtgagtagaaggtttagactatgcaaaggaaaaacctttatgctgttaatcatctcaaactttctgccattctaagtcgcatgtttagagtaaaagtcaagtagtattttattcttggcaatgggaaaactatgaccgttttcaaaatgaattcctatgtgtcaggtgaccactaaagcaataatttagtccccagtgttagttttgttcatatactgtagcatagaaaatctgcattctgtaccttctattccttgaagatggtgaacacgaaaattaaaagatgtaactatttaaaggatgtaactttttcatttaaaagatgtaaacattgcctttccctcaaacgtgtcctattatgaaaatctaacttacagatattcagatgtttaaaataactgtgaccactttgtctccaaaaggattttgcattttgtaaaagaaagcactacaaatttcttttgagaaacacgcttcagtacaattcattacacatgaatttgacaacttttcatttagacccaattttctatagagattatcatgtggcagatattcataaatgctttatttcaggtggaattttaccttgagatacagctccacataaaaacattgttaaataaccaggtattaaatatagtccgattccaacttccattaagtcatttaagaaaacaattcccattgatgcttgtctgagtgctcaatattctttttaaatcaggggagtgaaatatgaaagtaggcaacatactctggaatttttgttgagcctaagtaacttcatttaaagataaaactgaaataataaacatataatttccagttttaaattttaagagccaagaacacattaggtgcacttctcattaaacaaatgagataaggatctatttcagtagcaattaggagaaagaagaaatatgagtgtcgcaaccattctattcttccctcaaatactatgaaacttataacatcacaattgattatatatacacacatatgtatatagatatacgatatattgtgtcatatgtatttacagatgcaatacataactatttgattgcagctatttttatctcaaggagatttcaagctcttggacactaacatttttatctcatggagagacattacaatgctctatgaatggggagtattagctcattaatatttagaaaaataacagattgtcataaagtagatactatcctgttgaccaaatatttgtatctctcctttcaagcatggaggaaaaaaaaattagggggaacattttgcaaaataaccgtttgatttttaaaaaaaataataattttcaaactgatgcttttaatttaataacaaaataatgttattaaaacttaaatacttaacatgtaatttagaataattatctaatggcccagcttacatttacttttacttgaatggtttttaaaagttttgctttttctataatttcatggagctaaaatattttatggatattttgatgccatgcttatatttggctaggtaaaactcacggttttaatgctgacaagaaattagcaggtcctaacaacttttattcacaaatgaatgcattaataatcaaaagaaataaagaaaacattatactattttaaaggaaacgcttaaaattttaagaatgtgattttctagttaaaattgaccctagtgttcattattttttaggctttttacataaacttacaagattttagttttatgtatttatattaaactttttacatgagaccagtaaatagcttactactactttttcatgttatgttgccttctctcaccatagatttttgtcttccaattccttaaagttgcaccttagtagtaaaaagtgtgtacagcattatcagcttttcatattattttactaattgcaataaaaaataaagctcacctatttttaaaatgttatttaattaacctagttattttgaacactttgtatccaatattttttgaaaagtaagacgactttccaaattcatttatctctaaagtacttagtatcttacatggaagataatgacatgtctgtatgatcttcagctgttataaaatgtcaggtgctggaaattcttaacagagctgcccataagtcaattaaatcatggcgccacatcagcttttcccccaatcccaaaagagttaaaaaaaaaaaaaactctaataacatctacaattaatagcattcctgtagcctgtaggtctggcctgttactttagtcttccgctgacaataacggagggccttattatttttccccctgagcatttattaggcatgatgaggaaaaggttacatctctggaaaagagcacaatcttcaactctcttcaggttagatgctttaatgggcattacattagaaaggcattctacactacctattatattacttctcccaattagaaattccattttaatgtgattgccaaaaatttagtgcctgcccatttgataaaattgagagtggcatttgctaaacatcaattaacagaaaatgtgaggcaaatgttgtatgggtagattggctgccagtggggagaaatgaatgggtagtaatggaaattaatggataagggaaatctactttaatttccttgaaaaatgtgctataacagctatctgcattaataaatcaaacttattgtttaaaaagtgaacaacaagatattttgatttaacaagacagcaatccttccaaaatcatagaactcactatcaggtatcattctcttggatatattcaaactgcaggctttgctttggcaaataatctttcactatccttagctctaaataagatcaaactgtcaataaccaggaaataagttgttaaaatgtcattctccaatttatcattttaaataataaaagttgttttaagtaaacacgtttctttccatgtctattttttaaatttctcctccataatatcttccattttaatcccacaataggctgtggccttttgttaatgctacttcagatacataaatttctgataactgaatggagacataaaaagacataaaacacttacatttgaacttaaaagacaatatagatttatatgaattcttttatcattttataactacatttatctaagactcatttaaagtgatttcaatctgtatttgtttcctctaacatttttctttataacaaatttagttaattccatcatctcatctgaattctatgatcacacaaagccacctaaattaaatccatacctgaacagtctgggtaaattccccatataatatttcttatttaaaactttagtattaactaagtcttttaaggaagtatgggcactgattatgttctggaaaactggaagaatatcattaatcattaagagcccaaaatatggaacagggcatgtacatttatagagatgtaatgatttttagcacagaaattatttaccttaaactaagtactaaatgggaagagagggcaaaaggctgtaaatggagaattcttcttccagttttgcaattaacagtgttaatgtcgaataagtaagtagcttttacctctgtgcattttgcacttttacctcctctgggccagaggaggcaacctgcaccatttctaaggtcttttctagaagtttgatgagtctgtgttatttctgttagtttttctgcttatttcacagtaggctaaaattatgaatgaaaatatgtaaaaataaacttagcatggcaattttggcatagcatagagctcatggataatgattacacttctcaataaaacagttaagaatctctctcggggctaactttttattttaggatatgggataatgctaacgaaaggactagattagaaatttatgattaaaataaaataagactaatactgttaataataaatacttctgataggtagactggtgattctggaaagaatgatggcaaaacttttcagaaagtttggtcctacccattctctttgactgtctcctgcacaaaggcttctgtgcctcttcttttcattttggtacatgatccaatcaagagaatatgatccacatctcaaagttttatataatgcttgcaacaattctctactaatatgcctattgatgatactgtatatttgtattcatcttttccatcttctcagatctcctacaccctgtgtactaacttaatatcagccattaataactgagtaaatggaagtgaccaaaatgaactctattttctgaccaccaattccaccagtccacctctatctgtacccatgctctctccatataatgttcttctcccatcagatgtcaaggttaactcttctggtggtaatctggatcctggatccacttcctgtttctgactcaataattttgtttctgaaactaaatcactcttacaaatcacaaattatctcgttactagatcattcacatcagcattcagaaatgctgtattatattttcacatttaataaaagaaaaataaatatcaaattcccctagtgttgccccgtttatttgctcctcttcaaacaaaattttctcaatttcctctttcccattttcctctcaacacataatagttgagttttgtccctattatgtcactaatccttctgtttaaagacaccagtaatctccattttgtcaattccactggtcacttcttcgttccatgtcgactcatatcactcttctgcttagagcttgccgataaatttctatctggtttagaaaaatgtctgaacaccttagtctggcctatttgtctacttctactgaaacttcatcttcttttccaccctcaccttctgcgccaggtaagtcccagtaacactccaagcctcttcacaatttagtgcccttgtacttagcaaattggccagtgaagtgttctccctgaactccacacagctatgcccttcctgcctttcacttctcttgtcctcagagataccttgccggatgacgcaactgaaagtcagacatgctctttatactgtttttattttctgcggagcactaatcattaattaatatattaattcactgattttttcctcaataatatgagacttataagaaatcttacttttcttttgcttcttcatttccagtctagaacactgcctggcacaaagaaggcactcaaaaaatattgcttaattttctcatctttgtatctcaaatgtcattacacatagtaaatgattaataaatgctggttggtattaaatgattataaactctcttgatgaatttacctacactattattttatgatggtaatttatcagtggcttttaataggtattaatatctttcaggaaagatttgtactggaaatagaaagtataaatcaggaagtaggaactatttgatctctcaaaactatttactatttaagcagttgtttcataaatgttaggaaatgtttgggaaataaaaagagttttaaaatcagtacatatatctaaatttaggacaattgaggcaactctttaatctattaattctatgactatatctagatcaaagctttggttttagggcaaagtactgtagaggccaaggagaacctcagaaggtttgctgaaaaaaatcaaattgcaaagttgattaattggagaaaagacaaacacatttatttaatatgtatatatgggagccttcggaatgaagacccaaagataaagaggaaattgtccacttttatgcttatgttcaacaaagtatgtacagcagtgcagaaaaaagggtaagaactaatgctgatatactgagtggggaaacccaggaaggtctatctgtctagactcttcctggcctctttaagcctgcattccttccttctgggtatagaacatgaccccttctggaatgggagttttagtacctacagtcaaacaaggtatatcagataatttctttatgggtcagtttttacacagaaaggtggagagaaaaagtaatatttgtaggtttttatggctggctttggagaaaaagggttctagtttctgtgacctgccttggggaagagggattataggttctatggctagccttaaggagaatggaactgagagaaaagagggcaggaggtcagagaaaaactttagcttctgaggctgctgctgaggccttcatttggtgatattgttttctgaaccccaacagtacccaaaagcccacaaccgtatattttgtattatcaggacattcttcactcaaatcaaagcatctggcatcccacatttcacctagattactttggagttccaaggtacagcaaaacacattaaaaccaattaataaagaagaataaatttatattaaggtgagcagtaagatggaaacaccagaataaccaaacactcaaaggaccttacaaaaaattattcttgattccaactttgaatgttaatcacattttagagaaaaaataattaagatcagttgaaggaaagcaaataatgaaatctttaaagttcactactcttacagattttgaaaaagttaaacagagggtcgttatgtttaaaatacgttgtgggactctattattgaataacagccttttaatctttgcggtttttgctactagatacaacagtgctcttttaatgatctaaatctttccattagtctaaaaagaacaacttgaccacattatccattatctttgtttccagaaatttactcttgaaattctttaaactttgcttttatatctcttatattttcttctaacacaagcaaaaatatttgaaaatcacaatattttttaggacttttttctttatcctgcaagaaaaggtgactttaaaattgttgccctaatcaagatttgtgttgacttaaaagggtctatctacaaacttcaattttatattggcctaacatgtttgaaaatataattttcttttgtttgaagaaagttcctcaaaataggaccaattgtttcatatttcaatattcacctcccaaattagtgcatagtagacagctaataaacatctgcagaattagtaacataaacataatgcttgttagtgtcaagtggctgaaattcgatgattccaatttctgtgtttaaaacaataacaggccgggcgtggtggctcacacctgtaatcccagcactttgggaggccacagtgggcggatcacaaggtcaggagtttgagaccagcctggccaacatggtgaaaccccgtctctactaaaaatacaaaaattagcctggtgtgctggcaggcacttgtaatcccagctactcaggaggctgaggcaggagaatcacttgaacccaggaggaggaggttgcggtgagccgagattgtgtcattgcactccagcctgggtgacaagagcaagactcgatctcaaaaaaattaataaaataaaaaataaataaaataaattttaaaaataaatatttcaggaaatacttaagttttccttgaaaaacactccattcatcctctttatatttttacacaccttcaaattctttttatgacatttacacctttctgatcccacttgtaaacactctgtaaacattacacagtcagtgtttaaaaatttttttcattaaaaattctttctcaacataatacaaacacagatttacgcatttacaggacaattattcctctctcatttacctttaaatagcagtgtccctgcccattgcttactctaccagtttgatataatggatcctttggtggcaactacatgcattttattttcccaaagagaatcttaatatacatcacttccttcacaaagaatttcagtaagagggaagaagagatatcctggagactcaaaatatcattattaattgcaaccagctaaatctctgataatttattttattcacaaaaaaaaaaaattatttgctgtgaaacaaagaattcttattaggaattattaataaggtattatgaacaacctaaacttgaaggttaaatgtgtgtatatttttatatgcccatttggaaaggttcatacttaaaaaaaactctcaatactcatgttgctaaataataaagaggccatgaaattaaataaatacatgttaatattaatgctttatgttggcctgaaacttgctttattgtggctttgatctacttttacccagggctgccaccaatctatatgccactttgtgggaagtggaatatgagtcacctccacatagagacacagtgacttagagcagcgatcccaaacctttttggcaccaggaactggttttgtggaggaaaatccatagactggggaggggggtggtttcaggatgattcaaacacatttattttgcactttatttctattattattacattgtaatatcgaattaaacaactatacaactcaccataatatagaatcagtgggagacttagcttgttttcctgcaactagatggtctcatctaggggtgatgggagacagtgacagatcatcaggtatcagattctcataagaagctcacattgtagatccctcacatgcacaggtcatcacagggtttgcgctcttatgacaatctaatgctgccactgatctgacaggaggtggagctcaggcagtaatgtgagcaatggggagcggctgtaaatacctggttctctgggggttgggaacccctgacttacaggcaagacttgataaactgatcactagcagaaaatcaactgccatctgccttcttagctaaatgcccctgtgcaaggcacaaagtttgtaaattaactcagtggccctgtcctttggatctaggactaagaattcattccacatggcaatctgtactgggtatctttgtcatggtgtcttccgtgtctgttttcctttatcaattaaaaaaataactatgatctcctattcagagatcctttgcacagagttagctatagaatgtattataccaggagcaatgacttaatccaaatgcattgcaactagaggctgacttgaaactttaaagtggccagggatgcaatcatctgtcccaaatgcagaaccattagctaaacaaatcagaccgactctctcaaagacactggcaaacactggtcacagaaaatgctcagagaggtgcagagacatacatgaactattcctgcagaattcttactagggaagccaattgttcaagggctaatgattttctaattacggtatctatatatggttctcatttgtcttaaagatatctcagattaatcctctatttctgcaacaggaaaggaatgcctactaagtacacagtccttcttgctcttaaaaagagttatctgattcgggagtcattctttaagtccaacatttcatctttcttcattaattaattatatgtaacaaaagagttacatatagagtatatgtatatagagtatagaattgacactcaagcgacaaataaaaacaatggtgctatctttggtgatttataggctttaaaaattatcagacatccttggggcaatataagaaaattatatgtattcattcctagtaggtagaaaatttgtgttaaaccaaatctgtatcacagaagttaatttttataattgtagcttcatattttttatttatctcagtcattattagtggatttaaagaataaacatcatggttatagatttctggcttttgtagtgactgattcaattaacattattaattgagccctgcatattaaaaactatggcatgtaatgtgagagtacagaaagaataaaatatgcagtccttgcactcatgagataatacatctgatgtaaaaaaaaatactaaaaatcatgaaattatttgcacattacagagcagcctgagaagtgcgttctactctaagtgatccaagtttcccaaacagagatcaatgagggtgactcgttcaaagctccctaactaaaattaactcaattattcaaactgccattttttctcatgatgtgaatacagttttactatttcaataaaagttatagtgattattgataaagacttttggtacaaaatgccagaccagggatcagaaatgagcttctattccatgttattctcattttggccacaattaacttacatctataggacaaacacccaacagatctttaggcctgaaaggcagaaagaaaccagtacctggggattgtgccttttcaagcttacacagcaggatatgaagaaaagaggtcatgatttgtgctaaagtaactccaaagaataacatatttatcagaatacaaaacacagatatacttgaggaaaggctgacctaaaattgctgaccatcttgtctggtagtggagctttttcttcactctaaacagtcagatttttagtctcatcatagatacccaagatttcctgttctgaacaagtcagctctttatatttgtggcattatcttactaaggccctcaatgtaattcctgggtagcttttatccctatctgttttttttcccatctaaaatctaatcttcataccaatatgaaataaatctagcgtaattgcaatttgagaatgtaaatttcaagctcttaaaaactacagtgcctaataatttgcattgtaactaaatacatgtgctcacatacccacacactcccacgactcataattaaatttcatttaaaatttgttcccttactatataaaatgtacttgtattttccattcccttccattgtatttcatttcatttcattccactccataaatgccaaccatgagccactgaattaattttatgatcctctaaaatagtggttcccaaaatgtggttccagggccccctggaacacccaagactcttccagggaatccacaaggttcttttcataaaactactaagatgtcatttgtctcattcactctcaacatcttgcaaatgtatactagtgttttccagaagctacatgatttgatgatgtcatcactctgagagataatggaaagtattcttgtatattcttttctttaaataattttctcaactttaatttctaatacagtaaatatttataaacataaccatataaacaaaaactctttgggtctctcagtaatatttaagaacttaaagagatcaagagtccaaaaagtttgagaactgctaatctaaagcaagcttccatttgaaaaacagtgacttaaatggaatcattgcatacatacacacatacaagtctctttccatacttttctattctctgcaaggcaaaatgcaaactggcaccaaatgtcttacaacaaattagctgtgattctactatttcctactattctctgctctttactaggaaactccatctaagtcccctaaatatataatgttcacctctgcctttgagtctcattttatagtatactcttgaaatatatttaacactattttctgctaacataagtcctatctaactatgtggacatctgcaatttctttgcttgccctgcgtcctttcttttttggaactgacccttccggattccttgaattcacacgggaatgcgaattatgtggccctaacctttcataggcctgaggattcataccagtcaatcaaactaccccatacctttggtactagtgtgcagattacatgggaagggctaacccaagagcagtcgagggagatatatcaatgttaggggaagaagaaattgtgttttgttctctaagattgctcactgttaggaaggcaaggagaaggccagccttattaagcaatggcttagggacactgtggcacaattctttttacatatatattttttatattttgtcccagtgtccccttgactagacatctgcatatgtctgtcctttggcattgctcccaataatgcctgtgtgccctgtagactccctattttctgatgaggacttgtactgttttcaaatgcctctctattccctttaagacactctattaatttactttgcaatcaattattttatgttattctttttttttttttttcttagaaactcactaggtgcacaaaggaacaattctgtctctgcaactaagtggggattctttcttgtatttcctaaaactctaaaagaactctaatttttaatatatttttggaacctatttgcttgaattttttcccttgaaaatgattgacaaattgaatgctgtgttatcttaacagtttccttacatcttctttaattgctgtgtcatgcacagtttttcttcacttatgttttgaagagaatatgttatccttcccccaccctaaatgttatccctttttgatttgaaaaggcacacaacttaaacacatgaaatgaagataatttccatgctatttaatgtaaatttggaatcttctaaagtaaaaatattaggggaccaagtagttaatgtctatattaataaaggaaaagtgaatacaccacctctgtaatgttagaagacagaagtactcgggaactgtaaccatgtgtacatttcagtaagatgaaaattgagcataccacaaacagaagacagaagtactcgggaactgtaaccctgtgtacatttcagtaagatcaaaattgagcataccaaaaaaatcatcgattaaataacattccaaatgtcctcagcaagtagactttgttatgcatgcttgggattcatattaagatatagccaaaagaattcatgattccgttacctccttcagaaattgaaaacaatgatcatcaaaggtcaaagatgccttcttatgctaaattttattatcaacaggtcatttgaaattttgaaggcatagcttaatgttcttagaattagcacttcttaattaaccaaacagcataacagaattatagagagggagaaaaaccctcagttaaaatgacataaatagtaatttgtgaagttcaatacctcttggtctgctaattattatatgatgcttcattaccatttaaaataccacatataaaaagaaaaggaaagagaaagaaaatttagagcacattcattatataattttgatttattttacaaatgcaattataatcatatttgggggtcagagataataattttgctcaatatttcataaggaaagaaaatctaatttttcatatgtagtcacattttaatatgagcatattttatatgtgatacataatattatatacataattttacatatgactggcagaatttctgcattatatatactttttatgaatcacttaagttggtttttaaaaacacaactacatataccaagaccacatatgcctcagtaagaagaagtatgaaattatttaaactctcattcaggaaacactacaagtttaaatgaagtaacagaaagttactgcagaataatctctctattcaacaaaaatattacacagtttgaaagtaatgtaagtgggtccaccacattaaacacactcctaccctctactgacctattttctagactctaagtcagagtatggaatttatctaagttacttcaatcctcttatctttctaaaaaccaaaggcagtatgcatttataatgcttccttaactcacatcacttcataaatctgttttcttaaaaaaagtcatatcataaatgagcatgcaaagcacatactgcctcattcaaaaaatgtttaatcattagaaatagggcattgcatctattatcatttttaaagtgttaatgtgatagcaatctgaaacaacaaataaaacatctaagaaaggaaagctatacaccttttcttcttaggattattctcagtattgcagcatgttgatggctttactaaacttaccaggctattttctcacctaaaagttggacatcagtgggcaaaatattgccctactgatactacagtgatctatacattttaaatattctttaactgttccaaaatatatatattcattttaaacaaaataggaaaaagaaacagatatgaaaaagacattacctgtaagtccactgcccagaggaaaatgccattaaaacttattcttatacatattcttccagagaccatactctgaatatggatattatacatatatatatatatatatatatatatatatatataaaatatatatattatagatagatttgtttttaaatggaattataattttccatagtaagctttattcaattcttaataacaacaaatatattttcaggtcaacaatatgtatttgtataatctgcatcaatgttgttaatggctgcacaatatattttcaattaccataccataattcagttaaaaatctcttaccagatatctaatccctttccttccaacttctgatactgtaaacaaaatgttggaataaatatccgattactataatgtgtgcatctttcttagtgttttgcatacaatgcttggctaatgcagggtatcaatgaaagtttgttgcattaatgattggatggatgaataaagtaacaaatgtgggtttttaaaatatcatttaaaggagcacgtctatttgatattcagattttgagtcaaatcacttcacacttctttgtgcttttccccatgaattatgataacgagaaaacatgcataatgattaaatgactttcatccccggatgcttccttaatatgtgtgaacttgtaggactataagtaatgctctgtgtgagataacatactcaacaaatgttctaatagagaagaaaaaacgtaattgttgtttttaaatgtagtataaacttcataggatgctgtaattttccatttatttttcttgcataaaatacatagaattacataggaaaaataatttcagcataactcatatgtcccaactctcctctaggattttctaaatttgatttaacaagcagctaatgagcatttatgtctgacattaagctaatcacaatagagaatatttaaaaccttgatatagctaaaacacataacttacatggtcatcgtatgtaatttaattacagaaagtaagcgatttcctctgtgatatgagaaaagactaagattctccagctaagataaacagatgcaatatttacatcagctggaaggaagagagaacttcctcacccatggacaatgtgacagcaattccatccctattctcagcacagtatcctccttgtttaacaaataccttggaaacttgccagttttcaggtatttccatcttgggatactagccagttattcaggacatgaaaccaggacaagaagccagatgtgcaacatataagagtaataattattttccttttgattcccttatcatgacaatggaggatataacctatattttcaattataaattatttcatagactgacagaatttataaaagttcacctgaatttttaaaaatgatatgcctactatgcacaaaatcacataccagaccatgcagggcttgctctgtgtctcagttaaatctggcaacgaaccttggtcaacctgtaaaaccccatggattctcactgaacacactgtactttctcagaagaaaaggattctacgtatgccatcagaggctactcagtaagcaaccaacaccattcaatatattcatttatatttccctaagtttcttcactgtcaacctttaatatctattttcctgaaagagagctgaagcacacataatggtttcaaacatctgtttgttctaattttaacaaaagttgtcccatgattagaagccaactatttggagtaatatcacgtttgttctctataaataatataattaaattgctacaactaacaggaaaaataggaggtagccaacaatataaataaaccacaaaccgtgtttaacctagatttgcatatcgttctcttagttttgctatggttggaatggttttactagagttaaatttctttaaatcaggagatgtctgattaaaattttgaaatgttgctttctaaattctgctttttcttagctcactgcaacctccacctcctgggttcaagcaattctctgcctcaaactcttgagttgctgagactacaggtgcaccccactacatgtgcctgaagaaagtaatggcaaaaaccgcaattacttttgaggtaattaatatattaatagtttctacttttgttgtatatattaataatgagctgttcattcaaaagtttttacctaaaaaacagtttgctaaaagaaaagccattgcattacaatattttgacagcttttggcttagaaattagaaaataaaataaccaccaactaatataatctttagaacatttttctttgcttttcatcttttgaataagtgacaaatattaattaggaatagtagtgatagtttatgaaggtaataaccactactgtaacatgttaataatttaattaagctagtttctattatgaagcaaatttagaaaaggggagtaaataaatgtacacaataatgcattttatctcttcaatcaaaaaatccatagatgctaatgtaatttgttaaaatgccacaacgctattgaaaaccaaagttgccatatgataaagtgatatttattaaacctatcattccagagagttttcctgccttttgttataaatgtatttaactgaggccatattttcttcacatttgttccctaggtttgcttccagaaagattatctatggtagaataatctttataataaatctcaatataccctgctgtgccctaacactttaacactttagggcaacaaattgccctaaacacttgttagttcttctaggcacagagagctactatggcattaaaatagatgtatgcagcaccacattacattttaaaaagtaattacagatatctcttctgtgatcacctataatgtaaggtccaagcccttctgttgaggcaggaactatcagaaagataaaaattgattctgaaataaaatgcttatttcccaatattataagaaacataactgtctcggcgtagtggctcacatccgtaatcccagcacttagggaggctgaggtgggtggatcacttgaggccaagagtttgagaccagcctggccaacatggtgaaaccccttctctacaaaaaataacaaaaattagccaggtgtggtgacaggcacctgtaatcctggctactcaggaggctgaggcaggagagttacttgaacgcaggaggcagaggttgcagtcagccaagatcgcaccactgcagtccagcctgggtgacagatagaaactctatctcaaaaaaaaaaaaaaaaaaaaaaaaaagaatgaaaagaaacatagaaacatacccaacttattcattgtggaagattgtctcttcagccatttgtattacgtattaattttttttatattatggtttctacttttgtcatacatctattaatgatgagctgtttattcaaaagtttttaaccaaaagaacagtctgctaaaagaaaatcctttccattacgatatctttgacagcttttggctcagaaattagaaaatgaaatgataaccaccaacaaagggattctgcagctgagtatggatttcctcccagtgacaggcatttttgtaagcacagagcctaataattgtttgaataaacaatgtgtgtgtgtgtgtgtgtgtgtatgtgtgtgtgtgtgtgtgtggtgtgtaatctacacagaaaattgaaaaaaaattttcacaatggttaatggtattaataggaataaatccagatatcttaaaaagagagacagagagagagatagagaaagaggagctctgaaaataattcattaagactctttttatcctgaaatccaaaagaacatctgagcttccatcattcatcttaatagtttatagagtcaactctaatttcaccatggatgaaagaataaacttgaaataacaaataggcaaaaagctatggagaaaaagcttacagatttatcttaaaatttagcctgacaatttccaccttgacagttcggtcatgtttcctaaaaatgattagctaaaaacattactttatagtgattcaattgtaagactttctgaagaacaaatcaagactatttagtaccagatataaattattttaggcaactcttttactcttagttttattaatgaaaggactctcttaaagaatcaagtcaggcattgacactattttgttttttaacttcatcagtagttaatttggacttcacagcagaatgtacactgaatacatgctctgaacgtggcctaagggacaacactaacctgacatcaaaaaggcctgttcatattactaacattaacacagcatattacatatagaaggtgattcgtagatagggagtaatgaacaatgattaaagtttacatgaacttcatctttcagatacaactagaagcatttttaacccaaagttatcaataaggcaccatttggcatagcacctaagtttttccttttatacttcaccttaaaaagcttgctgttgactacaaagatgttgaaaatataaaaatataaaaataataagaaatgtctcaatagtttgcatgtctagttgatcattttaatgtgcacctaatactaattttaaccatacacttaataaaatgatccaaactcataaatgtattattccctttccattccaataactctgtttttaaatagtttgcaaacacctaactgacaaattcctgaagctgcctgagagtcatgaaccacttgtaccccttcccaatttattcacttatttattcatttattcattatttctacttaaaaataaaaaatgtgttggtcaaggagttttatatatatatagttctattaattcaccaaattactaaagccatctttaccaatcaaaagttactctaaatttgttacattagaagttcacatttccaaatcacagaagatttactaattattagtctagatatagtataaatattttggcttccactttttgccatttatttaaatctaattaaatgctcttaattgtatatctctaagtttacctctcaaatcagagaggatggaaagatactctttgcatttaggggtatgaggaatccttatcactttctcctcgatagaaaaatcaatttatttccttttctaaggccactgcgagatgcttttccagctccaggctcaaagagagagtgtttcatccctatttcaatggacaccagaatcaatattttctttaggtacttgctaaaaagtagttacattaagtccccacccagtggtactggccttagtcttttcttactataaaagaacatggctattcctgtttcttcctatactagggatctcttcaaacacaggacagttaacaaattgtcagtaactattggtaaacacatccttccagggaaaggcttcacatttatttgcctacatacacatattagggaacttttcttatttagatataatagtgaaaatgtttgtaaaaggcaaacgtaaaaaaagaaaaaacataaaataaaaatctgttcattttaatgaaatgcattatgtcccctaatctgccaggatggatcttgtctatgtaaacaaatttcatagtgactttcaccttcttcaagatacttactaggaagtatcttaaaggcaatgaatataactcttctacataaaattctgtacatagtagagtggatagacattagctactaacaaatatttgctggcaaaaagctagagcaaacattcaaagcatttttttatttttattttttaattaatctattttttttgagacagagtcttactctattgcccaggctggaaggcagtagcatgatctcgactcactgcaacctccacctcctgggttcaagcaatcctccctcctcagcctcccaagtagctatgactacaggtgctcactgccacgccaggctaattttttttttttttttttttttttttttttagtagagatggggtttcaccatgttggctaggctggtctcaaactcctgacctcaggtgatccacccacgtcggcctcccaaagtgttgggattacaggcatgagccaccagagtgttctctgtattaggctgcccagtcctgtttttgtatgactctctatctaagaattagaaaaaggtttctctttttaataaataaaacaaaaagaagaatatataacgaagagtgtatgcggccagcaaagcctaaaatatttatgtggtccattaccgaaaaagtttgccaatctccattttacagtacagaccctttgcctaatatatgtgcctactatatacagggtattagatttccagagaagggaactaaaaaaagaaataattttgacttttcttcctgagtcctataggctgaaggctatatctgggatagaaagggattaatatttccaaaatacttaaaatgtgttttcctcttcatcaaatctgaatcaaacagtctgtattaaaagtgaaaagtatattgccctgtatctttaatatggataagggcaccagagttgtgcccttttttagccaaaatgtagttatgaagaaagaggcttctttaatagatgttaacaaatcaagtcagtgacaaagggaatgtgaatagagaaaccgcttaaagagtaattagtttgtatttaccccaaattttatttagatctaaaaaaaattatctctgcaaatactttatagatctagaactcttttagttacataacactgtcagttaaatttcaccaaatagttactgggagattggaccaaaattgcagattcaacatttgttagttttcctttctgctctaattccatgaaaagacagaatatatactttttaagatccagaagagtgctagaaaacaaatgacagattttgagggctatcttaaaaatataaaacatacaggaaaaaaaatgtgtgaagtaaatctgtagattaccacagactaaaattcacatggacaaaaatgctgtaggtttggtagtataatagtaaatatcaccaacatccatgataggtattctcaaacaaggttaagcaaaaaactaatgattactatacatttaaaaaggatcaccactttaaaagagctatgccaatttccactaaaagaaaaattttcactgagaacttactgagaaatgggaataaaaattacctatattagaagaaaaaccataacggaatcagacttatcttcaacgtcggttaatagaagagtatggagagatggcttcaagcagaaaattctgaatctagaatgttttactcaagcaatccaacatcaagtagaatgaaaaatacaatgttttaagatctacaagaactcagaaatattaatatcaatgaaaccactctgaaagaattaactgaaatgtactacaataataaggaaaaaaggatccaaggaagaagataatggagaatgagaaatagtcaaataaaaagataaacataaacaaatcaaaaatgttaattgaaaatacaggagaattgagatatgggaggctgtgctaagcaagaaatacagttcaaaggcatgaaggaaaagactgatacatttacccatataaaaaaatgaaatgaaaacaaaacttcaaaatgaggaaagataaaaatgtttaaaaagactatataatggctgataaacatatttgtcccatatatgacttacaaaatgtcaatagctagattatataaaaagattctacaactctcaaagaaaaaatgagcagggatataaacagaaaaacactacagagaaattacagagaaaatgaacaaaagtgaccaataaatatatttaatgacttcccatctccccagtaactctgtattaatagagttaataaagattaatatagattaatataattaaagttaacttaacatacagttaactttcatttccataatggaaattaaaacagcaacataattctctctccatgagactggggcaagcaaaacatagtaatattaagtcgtggtgaggagaattaaaacagaagctttatatactggtaatgcaaatataaattaggagagactcttgtaacgtaaattggcagtagtttgctcttgggaatttcatttttataaataaaaaatattcgtagatgaataaatgtatccatgtgtgagttaaatatggacaaacatatacagaatatccactgcaacattattttttatagtaaaaaacattgaaacaacctaaatatttaccaacaaggaatcagtaaatacatcatcttctatgccagaaaatactgcgcagatttttttttgaaaacactgaatatttcatgtgttgttacattgtgaatactaaacattaacatagtgagaaaaatatctaataaattttaaaaagtttttcatttatattttccatttctccttccactcatatatcgattttgcccttatgcaaactacatatctgtaaaaatatctaggtcttttttaaactttttattagcatataagcttttttataaatataattgccaaatattcatattttttttccaaaaaatcgagatagtgctatcaaatatccaaaacataggaatggaaaaaagcaactcacagaaaaaatgcttattagataattctatttgtttaaaataaacacaattgacatagatatatatgtatatatgcgtaaatgtacagaaagtaaaattgaaaaacagcaccctgaaatcttaatagtgctttactttgtagaggataatgagaaagcagtaggaatggaggactcttttccatttcacaatacatttctatatgctattcatcttttacaataaaaatgcacttatgtgacttctacaactaaaggcattcagttatacaaattaaacaagaggagaaaacttttaaaaaacaaaaactcatttttttcactgtcagtcttaacattcattttatttgtcataatttgaggttttaatagttcttcatatgttgactacttattagtaaataaacaacttactatccaattttaaagattttctatttaagttagtacaataattcaatataaaataaaaaagtattaacaataaaataaagattgcaccccacaaatctggatgatgttgaagccatggtcctcattttcttcttctagatattcactctgctattacatagagtcaggccagattaacatatgatttgggaaatgtatgctctttttcccacattctggaattggaatttgtggtgacatattttgaacaattaatgctcctagaagatcctgttacaaacttagaacaaaataataaatgggttattacatctgtgtgtgtctaaagtttatttaggaaatcagaatcttaccaagaaaaaggcctcaaatcagcgcttcatgaccactaaagtataacaacctcccactctacattcactttgtatgaatacacttaaggcagcttctaataaaggatgcatatgttctgtgttattttggaacatatactgtctgttaggttgaaagagcttgtccatgaatcaataataacttggaatctggacatctctttggagattaatggatagctaagtagagctattcacaccagagaccactaacccccattggtccctgtccagtttgtagcagctgcagaaaaggaacactacgaaacacagaattacttttttggacgttattccaatgatcctcagcaagtgtcttttgcaaaaaatcaaaatggattaattttttaggccaggttcactatattctattcaattcagaaaatccataagtctaaatccggatagctgctattgaaatgttcatacactactcaggtctattcagggaactgggatagttctgatgcaacagtgctttaataagatacagattcttccataagggtcagtgataactccaatgttcagctgacaaaaataagtcaggcctaatttaccacatgagtcttgtcggcgctccttagagtttatcctgccaaatcaatgactattcctgtggcataaaccagatcattttctttttaaggtcttagtcattatttattaactcatctagtaaagtactcaccttgaaataatatagactttagatgcaaaccatttacatttattttttccccaaaaagggacttgtgatgaagtgaacagtatggcttcatggcttttactactatgacaaactagacagttttgtttggacaaataagaatgccaattttgtttggaaaatcaaacgagaatgctgtctaaaggttctaaccaaggagacaatccatccgtaaatgactgtcaaggtgagctagccctagaccaaacaaggaagaggttaacagctctaaatcccctctcctgtttaaattcttattacccttagggtatctaaatcaatgcaaccatgtgttgtactgagatataattccttgagataactgagataaaacaaccgagataactcattgatatagcagagtatttaccctaatgctccatgcagagaacacaggcgttagcagctgctgtacctaagcttcaaatggtttttccccagtttattagctgtatgagggtgcctaaattatgcaccctgcctaaaacttcagttttcctttatgcaaaataggaataacaacagtatctactctactaggtggttggggagatcaagtgagatcacggactcctgcctttacctctgctttatgacaacttctctccttgtctttcaatttatttattttctgcctttcccactttttccccccatattttcccctatttttcttttttaaaaaaaatccaggaacttgcgtcctgagagatatttttcttcttttgctttgattcactgtttttagatattctaaattggcaaatttatcccaattggagggataatcagtgagaaataaacaacatagtaacagaatattttgaaatttatgaaggttttgttttaatgtctccaagaatttactaatgacagtaaaataagcagattttgttcttatataagaatgaaatacatgtgttcatctcattactatgactacattcaatatttgagtgagaatacaattgttaaagttatttatgagatataatttacatacagcaaaaaattacccttataagtgggtaattatatgaatcttgacaaacacttacagtcagataaccaccaatacaatcaaggtataaataatttccaactctgttcacccttgcccctacaacccaggcatttagcaatcagcaattgttttctgtccctgtagttttgtgttttccagaataccataataatagaatgatatagcatgtagacttctgagttggtttcttgcccttagtgaaaaccatatgagattcagccatgttgttgcctgtattcgtattttgttcttcttactgttgaatacataaattgcatggatgtaccccagtctgtctatccactaagcaattgatgggaatttgggtggtttctaaaatttatcaattataaataaaaccactctaaacgttaggtacaggttttgatttctggtatggatgtagagaaaaggacttacgttttcacttgtctttgctaatatgtaggagtagcattgcttggtagtatgttagactttatcagaacctgtcaaatggtttaatggttttcccaaaacaactttatcatttctcattcacaccagcaatgcatgagatttttagttgcttgctctacatacttgccagtacttgatattgtcatttttttaaaaaattagccattctaataaaggtgttgtggtagctcattgtgactttaatttatgtttactaatgactaatgatgttgagcatcttttgccttccatatatcttctgtagggaactgtctgctaaaatattttgatcttttttacattgtgttcattaacttatcattgaattgtaagggtgtttgtgtatttaggataggcatgtattattcaatatcaatttgcaaacattttcttctatctcttgagttttccttttatttctcaaatgcacctttgaagcccagtgctaaaaaaatcaatttttaagaaggtaaaaacttacttaaattactacttcacattatttttccctttataaatgtcaatgaaatattatggtcatatgtttttcaaagcttttagctcattacacttttcttatctactttccaaaagagaagactatgcatagttaacagttcaagcgctcttttgaatttctttgccacatagcttattctctagggaagaaacacttacataaacatgttgctctgaagagtacagaggggaaccttagtgacacagtttttggttctgtcatcaggtgtagacatagactttagtttctcttctctcttctctccattcttaatacttttccagtttgggtttgggcctacattcatcctcgagtcctattaaacaggagtatgatttttgttctcccaactcaacaagacaacgtcttgctgagtttccttttctcccaggagctgtttcccagatccatggctcacatgctggccaaggagctgaagtgtcgtagtgctgcactaaaaaagctttcccaggtggagacctcgccatttctcaaatcttagccttcctctctgggataagtaacaacagacagagcaaagaataaaaggaaaacaagcactttgggagcatccaatagacctgggcctatgttctggatctgacattattcatttgtttatttactctttctttaatgtattcattcattcattcagcaaataactctttcagcatctgctctgtgtgccatgctaggaactaggaatacagtagtaaatgagacagacttagctttttccctcaaataaatggcaggtctgtcatttctttgttgtcctgaataagctgttaagcttttttgtgtttcctttgtctattctgaaatggagaaagcagttcttagctcacacatctaatgaatattataataagacaaaccaaaatatccacattttaaaaaataaggtggatgtgatgttctttgtggtcttccatacccccaattttctgcaaaggtgacctcctaaataaattatacctaaggtggaaaagaaagatccaactgcagtagtacctcatcaaaatggatgcttgtgatgatggagagctggttttagcaagaagcccaagccagccagctttctagtatataatcctgataatctactcaactatggtcctactgcaatagcttctgaataaatgctcaacagttcaggttgcctttccatatattttcactcctatactagtgctttgactagtctctatagttgtcattcacccatctatcctcattgtaagcacactttgcatttgtcaatgaggcctttgcacttgaaggagaaaaacatggaaaatagaaccagaaaatagtctgacatcatgtactaaatttccagaaaacagattatctaatatcttgggaacgcgattcaaggagcacgttcttctgagataaaaaacagcttttacaatacaagctattaaaaggcaacgatgcaatacaagctttttattgttaactccattctcataacttcagtttcaataaaagatcccattagaaatgcttccccatgtggcaactgctctggaatttccgccattattttctaagcattttatctatttatatcataaagctataaaagaaaggtctggatcaacagtgtgtacatatgaatcttttcgtctaaaagcctaagactcaatccgagaggggataatataaaactttagaagccacccagtttctgtccaatctgccatgaaataaattcagagacagaaagagagagagaagaataaacctggctgttttctattcataaaggtctcctccaaaagctagtcagttctaactagctaacagaactagcaataatgagtttatttagtataaattttgcatgtgttctcttttattccttaactagtaaagtagatatgagcattacccacattttatagaagacaaactgaggattatagaagttaaataaccttgtccaaggtcatacaggtagcaaacagcagaaaatatttgaatgtaaatattctaccctcaaaccttttattaaattatgcaagatagaactttgaaaggctaacaccctcatcattagcacacagtaggcatataatagaaattatcagctggtagatcagtgaatttgagggctccaaaataggtttagtgcttataaaaagcacagttctttgtagacagaacactacctattatgacaataagctgttggcaggacctgaaagaaatcagggagggccttttgaggattaagaaggtataatgaaaatcaggaagctggtttaatgagaaagaaatgcaatatactttgcctctccgattccttttgtatttggtgtactcatctaggagcaactccgtttgttttcttactgtcactctttttttcacatggcctggaaacgattcatgtttctttagtgatgcatggggagagaatagtttatgcagacaattataaaaaggatggattattggtagagactgatgggtcaatataacatatggtgttcaatgcaactacatatctttggaagttactgacaagtctataggtacagcaatataaagcagattttaccaagtgcataaatttgcagaatgactatattttttaatcaccaaaagctatggactaagccatctctagtgacttgtgaaataacgtatgcaagaaatctaaatacaaggacatacaaagagtagaataatcacaaatatatcaacagggaattatttgaagcatacatgtattaggagtaagttctattacacgagagaaaggtaaatgattgttataggagaaaacaattatatattgtctatgagagaaggtagtcattcaatatttatattggaagatatcattaatagacgataatctaagtctttcattttacaaaatgagaatggagaccgaaataatttatactgtatgcacatttatatagttagcctagggctagtctcagtgtgccatactgccccaaagatttttcgtgaactgaaaattatagtacttttttatttatcttctgttttaggttccctttgattctcagatatttttcttttatgtttctattaactcagccattcaccctttcccttctttagtcactgcctgacacttggttgcaatctacctttatacaattaattagggtgtaattctccaacttgctatgattctttttaattctcagactatcatccaaattctttgtcagccccactttaaaagttgcgaggacaccaacagctcatgctaaaatatttttcatttctggtaaaatgccatgtaagtggaatgctaataaaattttagattccgtataataaatataatccatatagcaggccatgttgctatccacagaaagcttctccacacactatttacataggattcttcactacaaaaatcacatggagaacatcctttccctattctttatctaagctattccttggtaagaggaaaggttgatgattatgctgaaaaggggaacccagagcactttgcaaatttatgttctttaaccggcatgtattttaaccttcaactactttctattttcctacattgactattctaattcatctttccagaacactcacttccattcccaaaatacacaccgacaaaacctaagattttagattttgtttaccatgttctctgtgccagacatggttctaaatcttccatatttatcattcaccacattctttcaagatagggattgtcattgtctctattcacagatgagaatactgagccttagagaagttaaataatccaatcagtcttatagagttgatcccaggtggtgtgatcttagagtctgtacaattaagtactaagtttcattaataaacaatctcacacacacacactctctctctctctaaatttaataacctccatcaaggctacatttccattatatctcaccttgcatttttcaaggaatacacttattaaaagaaaaaatacagacttaaatagggagataacttatcctcaagttttccaattatacttaatcacctagtcaaaagcattcagctttgcataagtccctatattatcacgacttttgttttgacaagagaagaacatagccagagaggcagaacagaatgtacatgccaaggatctaggtttatatctagtctaaagaaaacctcatcataatcagagaattgatttttaaacttcctcttccataaggagaatttctaatttaaatgcagttcactaccagagaatgcattagttctgtgtaatgcatccagaaaatgttcaataaatattaacagataattactaaagttatagataatataaattacacatgtagtacacacatctgagttttttaaaaagcataaattcaaaataggattttaaattatatacaagaacaacaactgcaaaattaacttcctgaaaggtacagcaagcacaggatacaaaataacctgaaccttacttagtaaacacatacaaacggtgatgcaattacactgtttttttaaaaaaaactattttcttcacaattcattctcaatatgattttcagttttaaatactaaaatcactgacgcttaaagtgtctgttctcagtttaagagaaatatagggtaataacattgaatataaaagatcattttagaaaagaaatacatattaatgtatttacactgaggcctaaattatcaaccaatatgttgcttattattaatttcagagagaactgcattgctttaggggctgagaaggggcctaaactgagacataatgaactgccaagctgaaaaggatgttagaggtcattaagttacgccttatagttttccagatgaggacactgagacacagagagtagttgggacaacccgaggtcaaaccacaaattagtggcagagaaaagacaggaactcagaggaccaaacgcagtggctcacacctgtaatcccagcactttgtgaggccgaggtgggtggatcacctaggtcaggagtttgagaccagcctgtccaacaggacaaaacaatacaaatatatctacacaacaaatacaaaaattatcctggtgtggcagtgcacacctgtagtcccaactactgtggagcctgaggcaggaaaatcgcatgaacctgggaggcagaggttgcagtgagccaagagtgtgccactgtactccagcctgggtgacagagctagactctgtcaaaaaaaaaaaaaaaaaaaagagctcagaggatcctagacctcagggtactgtatttgaagatgggacaatcttggaaggtgtcagtgaactttaaataaatagcaccccatctagtagtttctctttcagtcatggataaatgcaactggagacaagtcttggctttacgccgagcaaggcagctcagagattcacagcaataattcttgtgtgactaagcaaaggcctccactgctttaaatccctgcatgctttaatctccagctgtctttctggtgtactctctcagggtagggagggatcttaaagataataacttttagctttgtaaaaagttcagatgattttaatggctaagtatttacataggttatcattttcaaagtccaaatgttggtcaatgaggatattatggaggggaaaagtcttgcctacgtggaatatctatgactttgataatgaagagtgagcaggttctgcaaggagatatgttggaaaatactgagctcccatgactaaaattaagacaggaaataaatcaatctcagaatttctcaaaagatgttaaatgggcagtttgctggttttgggaagtgagaagggaggtggtaattattttaatccgtatttttgtggcacaatgccacaaaggtgtacgtatcatgcttaaagtatattcgcttgaatgagattatcatctcatatctgcttccaggaatagctcagatagaaactggtgctggggttaaggtaagaaatgatgggtttaccttcccttgtcaaacaagctttatcatttagagtaagcacaaggccagtttaaaccagcttaacttttacatgtatgtatgtatttatattttcatagaactacatatttatttctcacatatttaattagtgtcaaagacagcagtgataatagaaaggagccctggaatgaaacccagaaatcttgagttgacatcccagatctgcatgtacctggcttctgcccttcaccaagtcaataccttcaggattctagagctacaagacgaaaagcttagacttccaccagggaaacctccatattacataaatgggggagataagtaggttagacttattcaaatgcagaaaactagaaaattggctgagctaggactcagtcaacagccactctaacctccttctatatcatcttctactattgtagaagatggaaagttaaaaaccatctttcaccaattccctttacattaggattcttcacatggcgtaggtttcatcaaactcgtgaggggggagtaatcattccacagcccacatgagtgggctcacacagtggtggaatccctctttgttattgtttgacgccataggtttcacgtaaggagaaatatgagtcaatgacaatttttacttttttttcaatggatcctggagtttaaaaaactgcaagaaggcactggaattaaatgattaagtttgggtccaggcacagtggctcatgcctgtgatccaagcactttgggaggctgagctggaggctaccagtgtgtaatcaatccacattatatttaaggaagtgtgtttattatgtcttggccttcagaagtattgctccacttgagcccaggagtttgagaccagcctgggcaacacggcaaaaccccatctctacaaaaaatagaaaaattagccaagtgcagtggtatgcacctgtagtcccagctgccattgcactccagcctgggcaacagagtaagaccatatttgaaaacaaacaaacaaacaaaaaaagatactctgcatagaaattaatcacaatttctttaaatatgcaggtttttaaaattttttgattaaaattttccaaaggaaatagctccaacttttaaatatttgaaggggaaaacattttattttatttattttatagacaggctctcactctgtgccctaggctggagtgcagtggcatgatcatacagcatggtaatctgaaattcctgggctcaagccatcctcctgcctcagcttcctgagtagctatgactacaggtgcacactaccacacccaggtaattaaaaaaaaaaattatctggagacggtttttgctatgttgcccagctggtctggaactctgggccttaagcaatcctcccgcctccacttcccaaaatgctgggattacaagagtgagccatcacatcagccacattttcatttagacaatttaatttggaacaattggagcaatgcttctgaaggccaacacataataaacactcttccttaaatataatgtggattgatgatacactggtaggtatttatattttgaagtgccatgatgagttccgaatgtttagataagaaataaaaagggaggactagaggaagtgtaccctccagagaagccaaatttagtctgggaaatagaaatagggtcaatgtcaacagcagcaagatgacgacagaccaatggctgtttacaccagagtctttccaggttttctgacaagttttgtgttacttcatatcttccttatttaatcctggccattaactacaatacagtactaacattttaactcagctatacaaacccaaaacttcaataagtttatcagagacaatactgatatgttaaaaaaattactcacaaaacacatgcatacagaatatagtaatatcacatattttgcaactgtgtccacaattaagacctcctgtactaagtagaatgtcactgcatatagggtattgaaatacagaagccatttcttgtgtagcacccaaggaaagtctttcacattcaaactgccttttacattaatggaagtgccaaaatgatttgcatttgtatattcgcaaatcatattgttttaatatttcaaagaacggatcacactcaccccttatcctatttgattctattaggtcttcaaaaaggaactttgggtggacacaacatacagaaatcctattaagcatatgatttcatgaaggtatgcatgtagagtgtttagaatatgacacatatttaaatgctccattaaaaaactattaatgttaggattagaatataaatctacagtaaaatggtattgatgacagaaacattttaatcttttgtcagtcaattattgatatttcaaagtattttataaattttggtacaacacatacacccaccacaataatgtgaatcctttcaaattcttgttttgcacatatagtacagtataaacttgataaatgttttttaaaattaatatagaaatggatgaatgagattcaattagcccaatgtcagatacagttgttgaaatacattaagtattcaacaagtggatacaaaaatatgtttgaactgccaattatagcaaggtctctgtgtcaaattaaaactaaaactaagatacttcgtatcttgttaaagactggcttaatttttgtcacatggtatacttccaagtgcttttacctgaagaagactaagcatttctccagcatgcctgtccataactagtatttatcctctatgcaatttgttaacatggtacctaagagttgacaaagaaaagcagatacctctttagctagataattcattaatccatgttattttatcattttgtggcccactgtagtgactctcacttatccatttatttgttcaataaatatttcctaagttcctattatgcactgtacaaggtggatactccacagtatgcttaacaggtatggcccctcctttctccaagcttagtttagaaaggcaaataatcaggaatgaaggtgtttatatggggctgaaagattagggaggagtaaaagggaaaaggagcaacacttcttgcacatcttctatgtgacaagcacaattccaggtactcccccatagttcctcttttcagggaattgttgctgacatgtgatgtctcccccaggcacccagctttaaaatttctctcttttgtactctgtccctttatttctcagaccagctgacacttagggaaaatagaaaagaacctacgtgaaatatcgggggtgaatttcgactgatagggaatgacctctccagccacccagtaactcaggtcaaacattttggagccatctctgactcttttcttccatttccactctatggtaaaaccatcattaaatcctgccagctttgcattcaaagtatgtgctaacattaaccagttttcccatttcctccactaccaccctagtccatcatcacatctggtcatacaaaggttactctactgcctctcttgtgcatctgtaagctattctctctatgacgaatgaaacagaatcatattcctatttttcagatacttttcaaatacaaatgattttctgttgaatttagaataaaataggaagttcatgttgtggtctgtcaagttctataaaatctggccttcaattaccgtgcccatctatctctcaatctctgctttgctcagtgtgttcaactactccaggctcccactggggttttcaagcacacctccacttcaggcctgtttcactcacatggagtattctcgctcagagctgcatgtttctttgttgtgtttgctcaaatgtcagcttctcagaagactgaatgtgttcaccctcgctgaaatagtaaccgcccttatccattctctatgtccttatcctgcttaaattttctttatagagcttgccattttctgaacatcaattacattatacataacactcctattgatttctttattatctgccttcccacctgaatatatccatacaaacagggcttccactatacaaggctctatcctcagcacctataacagtactaaccatgtagcaaaatccaagaacacattttttgaaataatggattatttcatttgattcttatatgaaattgctaatattattactattaccaaaaaaaacaggtaaaaaataatgaaacaatttttggaaagagataaaataatttaggaaacagggctcatgattgaggattagatgactagcagaggatttaaaaagtgaagaagtagaaataacagagacagatgttttgattttttttaatttctcaatttctttaattttaatattacaaatgaaatattttggggaacaatataccttaattccgtaaattaatattttaaaattaataatctgctttgttaatttccaataaaaattaaaacctatacatgaagatcatttacaaaagatgagaaatgacacagaaaatatagagtgaacactacttaactactcctccacttttctgtttccatgtcagacacatgcctggtttctgacccttgtcagaccaggaacaaattataatttgaaagtagggcataaagcgctggagttgagacttgtaaggatgtaagagcttacaacaaaagaacataggaaagtgtggtgaaggctaaagagaattagaatgcctttccccatttggtgaatgaatagatttttgtgttttgttttagcatatcttcaggcctgaatggaatgctttgtgtagtaaacacagtaaagctcaaatcgagtttactgcctccatatggttccaaccacatacgtacaatggtagattcatggggttggggggggggggcgtttgtcaggggaggacaagtcattttcctagaaaaggcaattgtgtttctagaattttattaagcaagagttcaaaagcaagccagagcaaaaaatcgtactcagaacatcagtttgttggtgcctttccaaaacagcaatttgataaaagtgcatctgcaagtcttttatctgcaaagttaatttcattattgcactatactgtacttaaaaaaaagatccacacatttattaaaattgtaataaatgaatcacttaggctttgatctcctacaccagttttactgagctcccctaaagggagatcaattaagcatacatttttccaccttttaaaataatactctcagacagagcatttgaatttcattttattaaaatgtaggcacagtaaacattataaaaaataaaattcccacaattcacgctattttaaaaaatatcagcaactgtctcatttcattcttgataggaaaaataaaattttagtttgatgatggggttcaggatataatatccccaaatataacagtttggcatgctgaaaactgcagaagcaggaaggtcactctcatcctcttctgcctttcactcctgaagcacatcacaaaacataggaaagattttctgaccttctcctgaagcaggtcataagatattcaggtgaaagataccctccctatattgggaggaaaggaacatccttgtctctgaagaagggtcacacagaagaatctaaacaaacaccctgataagtttccctaatttattacaattaaatcataccaaatttgtccattcatacttttgtacaactgtccactcttcatcaaacctagcacaaaatacacaggtttaactattttttcaggtcttcacttccttacaaaggcctccatgtcaagtaaaacgtatatgaaataccttgtatgcttttctcttgtttattagctattttgttataggaacttcaaccatgaacccagaatgggtgagggaaaggtatttttcccctcctataaagatatttcctaagtgttctctgacacaatacactaaaaactactttatgacacaaccagaagcactaataaaatgttgtgtttctaggaaagtgctctcttcatcaaatgacatgctttcgtagaaaacagaatcttattcaatattgtgagagttttgatttatttgctatagtgtaccattgcttctgtgttccaaaacacaaaacgattcatataataatgaatttgttaaaatgactttccgtaagaaacacacatttattttccagtgcatataaagagcttagttatgagtctgaaagtatcctctatgtacctaggaaggaagttcccccatcaggacaggcaagggaaaaaattctctgtaaatataaccgaatgaaaacaaaaggagacacatcatcagaaatattacatcatacatgcaagatgacaaaatacaatttttgaagtgttattttctttgctacttaaaaatggaatgacggaaattatatggtggctgtgttcttgtcctggctatgaaactaatagggtgactttttcaaactgttttctttctctgttcatctctaataagaagtggctgcagtagatactctttaagatttcttctaactctaaaattctatggattaagtaatttaaacattttcaaaggtattttcatttcttcatatattcttcctgagcttatgacaaattaattctatgttcaagcatttatggacagactcttccaactgaaagaactggtgaatttaatgatcttgaaaaaggaggagaaataggaggaaacacttaacttattactatccaagaatatcctaaaattctactcatttgagcatcttctatgcagccctcataaggtaacaaaaacaaataagcatagaaagtcttggaggaactactgattcctaaataataatgatttatcaaagtaaaattattgttatcaaccagtggaccagttaggggcaccaataaagtaatgagagatttctaactgaaatacattcacttatttaccctgtagcataataaaaacgaacgtaaggaatatacaacattgagagcattgtttcaggtcattttcacatacgattctaattactaaatattccaggatgagaagaaatgactagagataaattatggtgcctattaaaccttttattgaaacctcctttccaaaaattaatatcacatttaatcatcaaaatatcctatctaaaaatttgatttatttagttgtagtctacttccacatggaatttggagtaactgtgtaagacatgaaagaaattctaattgaaaaaaggcagactgggcaaaagataatcagataaactagatgcactacatgtatgtagcttatttgcctctgactcctggtacatatgacaatatatcctgcttgtacacacaatagtaacatatttctgccacaaggaaggacaaagaaggaagcaaaggagagggggaggaaggaaaagttgactaattgcattttaaactgttaccaaacaagaagtgagttacagaaatgaatcaccactactctgaagtttcagcttgtgaataaagttgccctggctgatactgattattttctacttaccattttaactgtcatctttttagcacattaaggctctcttttcatagacctgcagaaaaccggttttactaatccctttcctcccagaatgccttcgctctttatcctggatgtaccctcacttcctgttttttgttattgttgttgttgtttgcttgtgtggtggtgggggaaaaaaaaaaaaacttagaagacattgaaccatatatccaggtttccggaggtgaactaacaaccccaagtttggggtctagccaaccctttcacagatgctggacagatactaagcaaactactgctcacacacctgccatgaataaaattttaaattcatgacaaagggcaacctgaataaacagattctgggtgagaaaataaagaaaatgtgcagagcctaaaacagttatagcagccaatacataaagtatttgctttcagtaagtgccatttctgtttttggttacttctcattcccttatttctcccttttgacaatattttgtttggataagtcatcagcctagctgaaattttattacacagaaaaaaatgaataattaaaaagttatgaccatttcagaaaactaggctttatggaagtaactttaaagtacgtggttttataaataagcatttgtaggaggctgagacaggagaatcgcttgaacctgggaggcagaggatgcagtgagccgagatcatgtcactacagtcctgcctggacgacacaccaagactccgtctcaaaaataaataaataaacaaataaacaaacatttgctcaaaagggactcgggggtatgattctggtattttccctctcacctataaatgttatgcaaatgtattatttttcaaggaggggaatgcccagtactgggagaccacttctccatctagaggagaattttcttgtgccaaggttactgctaagtttgaaatagaaagaaaagtgtgcttagtaagcactgaaatagatcaaaggaatgaaaaaagtcctaagaaatattaattttagactatagtaaaacttaatgaatgaaccttaccgcataagatggaacatactggatagtcactataatatgcatgcctatatctacatacatatctactacatatagatacacacctgtatctagctattttttaaaatagtcacatttttcttgtgatttctttgtttctgcaactcttgatttcctctgattactcttttaactggatctataacctacatctttctctggatattcctctggtaactctccctcttttattcctcatcttctttattccaagttgacaattagtttacctttaccctgattactcagttataatgcctattcttacttcccaagaaaaaaatctacacatttttaaactcatttttgaattgacatataataattgcaaatacttatgagatatatactgatatttctatatgttttatgtacaatgatgagctcaatgtgatcagcatatccatcagttcaaaccttatcatttctttgtgctgggaacattcagtattacacacagaaaagctatccttcaaaaatgaaaaagaaataaaatatttaacagataagcaagaaataaggggattcatcaccatgagaatggccttgcaagaaatgtttaagaaagtctcacatatggaagtgaaaagacaataattaccaacatgaaaacatgcaagactataaaactcactggtagtgtcaatacacaaaggagaaagaaaaaggaataaaatcttatcactatagagaatcacccaattgcaaaaataaaccataagagaggaagtaaagaacaaaggaaatacaaaataaccataaaacaatcagtaaaattacaggaataaatctccacctatcagtagtaaccttcaatctaaatggatttaattcccccttgaaaagatacagactggctgagtggattaaaacaaaaatgacccaaatatatgttgcctacaagaaacccatcttatctgcaaatacacacatagactgaaagtgaagagaagacaaaagatatttcaggcaaataaaaaccaaaagcaagcaggggcagtcatacttacatcagacaaaacagactttaggtcaaaagctgtaaaaagagacaaatctacattttttcttggatttctcggtatgatagaagctagcaatcttcaaaacgtgtataaatctattgccagtcattgacatttcttataagaacctgtgtagttgtctcacgtgggtccgcagctatttatttccaatttcctttccatttaagacctacctatgcagccataaaaaatgatgagttcatgtcctttgtagggacatggatgaagctggaaaccatcattctcagtaaactatcgcaaggacaaaaaaccaaacacagcatgttctcactcataggtgggaattgaacaatgagaacacatggacacaggaaggggaacatcacataccggggactgttgtggggtgggggaaggggggagggatagcattaggatatatacctaatgctaaatgacaagttaatgggtgcagcacaccaacgtggcacatgtatgtatatgtaacaaacctgcacgttgtgcacatgtaccctaaaacttaaagtataataataaaatttaaaaaaaaagacctaccatttgagcaactatagtcttataataaccttctgttactctctatttttctaagtacaccacatactcaaaaggtaagctccttgccccttaatatagttacaaggtttacaaagcttagtttccagcctgtttaaccacttttcaacatcttgcctctgtgcactacaaattctaagttatttgtagttcttcaaatgagtaagtgtctttttgcttgctctaccctcttctccctatgttcccttagctctaattcctattcatattcaagtttcgccttagctgtcttatcctctaggaagcctcctctacctcccaaatctgagttgcttgtgccctatcattactgttcatcactctgtatcgtggctgaccttctaaatgtctatattcacctataatctatgaacaccaatagagcagtgacctgcctatctgatgacaaacataaccccagtgcctaagctcaatgactttacgtattacttaaaagtcataaatgttaaacatttttctctagtgcataaattacaacattagatactataatgagctataactcttcgtctctttttatttcaaaattctattttgtaacaaattactttgtttccatatgcaattggacatgtttttcagataattatcagaagattaatgagcattttctgaaccatttctgaaatacagaaagggtattcaaaaaaaattattgtccaaagaaaaattgatacaatacttatttggaagtcctgaaatctaagagggttaaaaatatgtgtgcctatgacaatttctgaattatttacaaaattttggtgatacaatatagaaactatttacatactttccttatgagttacttatgaaaacaatgttaacataagttactcgaagtgttaggggtttaggaaaattgtgcataataagcacataaccattatacacatcaaaacgtacttttaccttttgtgtgtgtgtgttttatatattatttttctatttttaaatgaagcagatttgagaaattattgattggatagtttttgataaaggataaaagagttagacaggttaaatacacatttttatgggatgcacttttacatgaatgtttctttcttaaactgagtaaatcctgagataaaatattatcaccaaagatatttagctaaattgtggacaaatacatagagtaacagtctgtagacaacagcaaataattatctggaatattcccttcatttcaaaagttttcatcttaggtatattgtttgaatattttattatcaaaaagccaaaatatgatgaaaaagtcataaagtgataaaatcctaagaaaggaaataacagtggaaagaaaaattaatcttgcacagaatagaaggaaaataaataaacgagaagcacacaaataatcaaataaagaaaataatagtagaaaacaataaacctgttttgtatgctgagatttgcctacagtcttcctataaaattctggaaactatatctagaggttgctctttgattgttgctggcaatgtatcatttggttgggaaatacattcacacataaataaaagagatcagttataaagaaaaatacaaatgtcaaatcaattaaacccaagcagtgctccaaatcaaacaaagaagagagtcagagagtagctcaaatgctattatactatctaaaaagaaggggtttacttttgatcctttgtgtatatgactccatagaacctgcctgagctattctgaagctgtgagtggcgatggtgaaggcagatgagaaagcatgacgtgtagagacaaataaagcttgggttcaaattttctccttgctatttagatttttccaggaatttgttttcctaaatacaaaatgaaaataattaaatttggtttgtgtttttgagaattaagtgagataataatcacaaagttgatcactgcagggtatggcatacaatcattacacatcaattcctttcctctcttgcccattactatctatacagggcatcttgaaaacgtatttattaattgtatttcttataatacatcattttaattgtgtataaaatatactcaaagatactaaaagcatcaatataataatttcctaacataacattttagctctttgtaaatatatataaatataaatttataatttacaaattaatagccacaaatgttttcttggaatgtttttataaaacttgtagtcatatacttctattttttatagactgcttttaatttcgtgataatattaaggttatttggtaggacaaatcacatttttttttagttttaggcaattttttcttaaactggaaaaatctgagacatacagtaaatgaaacaaaaatctgagctgtagagtcaatgaaaacaaagtataactaatttgtggaaaggcaaaaattagaacccagcaatgtactattctactaaatatctttagtttccacataaatcatgagttggcatataacatggatagtctgaataaactcttgttacttaactccaatattgccctaatttcaaggagctgatccagaagaggaagatctgagttgggacttcagaccaatggcaagattcaagcctttcatctccatgctttctgcatttctctatagatattcagttgtgaaacacctggagtttatgtgtagttggctcacaccagctgcatttttgaagaaggggtaaaataagcattttgggttagatatgaaaaattttatgcaacaaatgcatatttggaaactgcaaaatgagcatgcaaatcaatttatatgcatcgatgaatgaatatagacgggctattttcaaagtataggcattctagtgtagcataatatatcgggacaaaaggaatgggaaggaggcaaattgctcagcttagtcatccatttgcaatggaaaattgcattgtcaagttccattatgcctgcacaaatttagacaaattaaagagtctactaagtaattattgataacatacatgtgtatgaagtagagcaggaaagttgtgagtcatttggaacttctcagatgtttctaggattttcattagcgaaaggaggcattgaaagaatgataatataccttactatgaaaccaatttgagacacaacactggcctattcagccatatctcttctatggtgacagagatggataacaaccggaaaaagtgtaaataaaacattaacacaaatcactctgctgaggagaaacgttacatctggttctggaccctgcatcttgttaggatcccttcattcattacttcattaccaggagaattattcaatctgacacacgagaccaagttaaaaaaaaaatccttagaattatacaaactttaaatcctatatttctctcttttacagtgtgtgttcagaatatattctgcaaggttactgtggtattctcttctgacaatataaacattctactacgtttaagacagaatgttcaaccaaggataacataaatccctggaaagtcatataatgggtctcatcttctgaaatggactattggtttgacatttcaaacatctcatagataatccctcaagatggagagtcaccaacttcctttgataatctgctcttgcacttataaatatttatccttcaacaatttaaatatgttttttctttaccctcttcactgaaaacagcaaaacacctggtctttacaggttatgtgcctttttatacataaataagtatataaattctattttgcatatatgtgtatgtatttgacatttatttatactcgctaaacgtatttttaacaaacttccataccagttcacaaaacacacctcattcatgttatattgtgagtcattatacacagctctaccataatttatttaatcaaatccatgttaataaacatttggatttgactccatttacttgttttcactattacagacaacatgcaatgagtaccagtgctaatatatttgtgaggcttgttcaggtatttctgtttaaaaccaaagttcctagagatgaaactgttaaaggaaatacacatttacattttcatagttactgttaaactgcctctcaaaagaactataataatacacactccatccaaagatgcacaagagcataagagtgtctacgttgccacacctttcggccaaaactgggtatgatggtcttttctgtgctttttttttttttggtcttgctttgccacccaggctagaggacagtggcacaatcacagttcactgcaacctctaactcccagcctcaagcaatctacctcagcctcaaaaatagcaggaactacaggtgtatgccacaacatctggctaatttttaaaaatgtttttgtatcgcgctttttgcctgggctggtctcaaactcctggcctcaaacaattctctcacttcagcctcccaaagtgctgagattacaggaatgagccaccctgcccagcctgatggcgctttttaatattttcaacaagctaaacaataaatcatatacttcattttaattcacgtctttacttattattgaggtcaagcttctttttatacatttactagctatttgatattctcttttaagaaattgcctacttgttttgtttgaccattaccgacaatattctcttcttaatatcttgcagtgagacccactaacgtttattgaactcctacagtgggccagactctggtagctcttacgtatataaaaggtgtaagtgctcccctggggacttagaatcaagtgaagaaatcagatgggatgataaattactataataaaatgtgttcagcataagaataagggtctacacaaagccagcattgtccctgctggagaaccaggggtgagcaggaagagggtatcagggatgatttcacagagaaggagaccttacagatgggttttaaatgatgggtgaaatttcactcagtagagattcaatggaaggcactaggtccagagagagtaacactagaaagaaccccaagacatgtgaacacaattattattcagaatataaataatgactggcttagatcacaaagtttctgttgaaagaaaatggtaagaaatgagtctggataaggagaccaatttatatacaagtgcttgcctgccattcttgagaatctgtattttatctttcagccaaaggagcagtactatttataaaggatcactccagtagtagagacaaatggctttgaaaggggacaaaaggagcaatgcctgagattgggaaagtggtaagtagactatagcagcaatcctgatgagggagtatgagagcctaaaatagcataatatcaatagaatcaagagaacttggtcacagaaagcatgtgattaatcctttcatctttctacaactagtcacactggatattcatctctgtggcagcatttattgcattgtaatgaaatcatgcatgttgtctaccagcccaccccactaaaatgtgacgctttccaactcttagacctgtagttgaccaaaacgttgtttcaccaaaaaataaactttcaggtttcctcactttccttgtgttcacattttatgctgcaacaaactcagtatttattaatctaaagtctttttttaaaaaaacttagcctctataacattctaatgccttagtgcaaactgttttattttgatatggaagaatccagtgattacagtaatttgaaatgatggtgacttaattaagagtgtgaagcaatccattaactataatttgtaaaaggagccatatgtttttcactcttttaggtataccattggacttgcattttcaaaaagtaaacctgctaatttttgcttcaactgaggatatcattaacaatatcaccagtagcacacatgtgtaccttattacagatcttcatatactataattaatagtgagttttattcgtatttggatgcctgaattgtttagacttgtatttaggtttcaagccctttatttgtgctgtcaaacgtttagtcctcaagggcttgagagcacagaggtgaacactgcctaagacctaacatctcacctcctcctgtgtgatggcttcttaatatgtggttcaggaattatgaatggagaaaaacaacagaggggtcaaagatgaggctagatttctggtttgtgtaactggctttcctgggaaaccaaaaacatgacagaatacccagaaatgcatgtttttcattttgtgagtactataattttttttctctggtttttgttttctttgttttgtttttaacccaaaactatttttctgccctctaatctcatcctcctccaggaacaattcataccagtactaccaaagaccctttcacccaaagctgtatttcacagaggaagaacaattacataggatataaacggactgagatgtaagagacaccactcgaatattctgtggttatgcagcagggcaagaacatcacacctggtggaggtagagtcagtactgggaggataccctggagatggcaaagcaaacaagaggaagtgcaaggtgagtctgcaatacaggcagcggctgtaactcgagctcaaccagctcaacaacgtttaaggaaacatgaaactggggcaatccactgtgtaaagaggacaagggcagctggctcagggcaaacataagcatgtgggtggagagcctgcccagagtgtattccagggacaccaatgtgcaacaacagcaagtcaagtcactgggggaagtaattcatgggccaagtgttctgtaacagttggtgacatattttatgcaaatgtatctgtgaattataacttcagacactcttgaaatagagttgttttttttttttggcagaaattaggttttgtagggggaggggagagtatttgttttgggctttttccaactcaggacttgggagatttgcacgttaaaaggctttcagaaaagtccaattatttacataactacagaactgaaaatatatttcaaatgttacttagtccaggctgctgaccagaaaaagaggaaccttaagcaatttaaaactagcagttgtctatttaagctactaaggatctctagtgatacagattcacccaccacttctgctgacctgttctcacatttatactagaattacaagtgaatgctgttttctctttccttcggcctaaaccagcacaattttgttcaaatccatttccattgtttagtcctctgtggaccagactaccactgccagttttccttagtccaaattcttttttctgtttgtcagctcatatttttctgtcctacttttcctgcttacaaatgcaatgctatcaagatttttccctttatacaattctggactgcctgatctacagacactagtgagagacattttttaagccactagataacaaaaacctatcaagaattttatgaagttcttgtccatgcaatttccaaggcatgatgggaaattagcaagtcagacaaaggcaacagggaaggtgagggggtcactgaaagtgcagtgatgctgctgctgggatgaacagaccaggatgactgtaacacatttttggaactagcctttggaagagcattagccagctgaagtgatagtgggtaaaataaacagagcgggggctattagaggaaggaggctgaatgtcagaccagttgcaaagaacgaggattggaacatttttagctcagtgaagacagcactctttctcttaggcagataaagataattgaagaggatgctaaccatatggattttatttccactgaagacataaaaaaattaatttatgtcagcagagaaaggatattcattaaacttaagggagaaattttctgctcaggaaaagttattaaacagttaaatggaattttgaaaaagagaaaaaatatgacattgcattagcttatacagacttctttgaaacacaggagagattatcctatgtgaaagggtgtggaggatatacagttagttattattttataaataaaaaagaaggaattacaagtgaagagtctggcctcaggatttacgcagctatgattcaaatgtcaggtttgtgaatttctagtgcgtgaattggggaaaattttaaaaatctttctgggccttaattttctcacctatcaaatgagaaaaaagtcacctactttttagggttgtagagtagaccaaatgaattaatagcacaaagagctgaaaatagtgcctgacacactgtgagagccatttaagattttgctattgttgttgatgttgtcagttggcaggaaaaattccaatgatacactgccagaaatgacagctagagacaaagaatgattatattttctgtaggttaaatgtagacaattacgtatttattcttgtcttttccttcctatttccctttttggcttaagcccagagccagaagtcaagcaatgtatgttcctgtcctgtcttctactaaccagatgtgtgattttttaaattttaaaccaacagttctcaatgtcctcattgtttcaaattctgttaactcttctctgtgtctgtctgtctctctctctcaatttactttaatcacaaatactctttttctctcccatcatcttttctcctatctcctgttcctctcttctggtcttctgtctcattttctaaattatcaaacagctcaagcttcccagcttccctgaggcttgagcatctttccatcctccacctcctatgggcagaagacactcagaattgtgtatttggctccagttcaaattgttattgtctctgtttaggatacaaataaggattttgtccaggatggataatgtcttgggtcgaggagaaggaaggtgcccatcattcttctttattgccaagaacctctgggaacatgaacagctcccagctaacagcaggagaggagcaccattcccagaagatttattctaactcctgaagctctacctatgtctgtacttttatgaaggaaatcaatatatagagtcatagaataacaatggataaacttcaagtgaaaaaaaaatatttaaatatcatttgaagtcaaaaaatacattgtgatagaagaaagacatattttaatccaaccatttttaacttaaataaagggtgaacaggacagaggaaaagaaaatgaatgtctaatatattataaaatatatgtaatgatattaactgaaaaatggagcacgtttttaaacttacaagttaccatttgaaaaaaactactttaaatttcatatggaaccaaaacagagcccgtacagccaagaaaatcccaagcaaaaagaacaaagctggaggcatcaagctacctgacttcaaactatactacaaagctacagtaaacaaaacagcatggtactggtaccaaaacagatatatagaccaatggaacagaacagagacctcagaaataatgccacacatctacaaccatctgatctttgacaaacctgacaaaaacaagcaatggggaaaggattccctatttaataaaccataaagatccttgaagaaaacctagacaatatcattcaggacacagacatgggcaaagatttcatgactaaaacaccaaaagcaatggcaacaaaagccaaaattgacatatggggtctaattaaactaaagaggttctgcacagcaaaacaaactaccatcagagtgacaggcaacctgcagaatgggagaaaatttttgaaatctatccatctgacaaagggctaatatccagaatctataaggaacttaaacaaacttacaagaacaaaacaaccccatcaagaagtgagtgaaggatatgaacagacacttttcaaaagaagacatatatgtagccaacaaatatgtgaaaaatagctcatcatcactggtcattagagaaatgcaaatcaaaaccacaatgagataccatgtcatagcagttagaatgacgatcattaaaaagtcaggaaacaacagatgctggagaggatgtggagaaaaagaaacgcttttacacctttggtgggagtttaaattagttcagccattgtagaagacagtgtggtgatttctcaaggatctagaaacagaggtaccatttgacccagcaatctcattactgggtatatacccaaaggattataaatcattctactataaagacacatgcacatatatgtttattgcagcactatgcacaattgcaaagacttgaaaccaacccaaatgcccatcaatgatagactggataaagaaaatgtggcacatatataccatggaatactatgcagtcataaaaaaggatgagttcatgtcctttgcagggacatggatgaagctggaaaccattgttctcagcaaaataacacaggaacagaaaaccaagccctgcatgatctcactaataattgggagttaaataataagaacacatggacacagggaggggaacagcacacactggggcctgtcagggggtgggggtctaggggagggatatcattaggagaaatacctaatatagatgacggattgataggtgcagcaaaccaccatggcacgtgtatacctatataacaaacctacgtgctctgcccgtgtatcccggaacttaaagtataatttaaaaaaataaataaatatcaaaagcaaatatgtgtataggttccctaacttttctgataaaagaggtttctgggattctttttttttttttcttttaagagatagggtcttgctcggttgctcaggctggagtgcagtggcacaataatagcccactgcctcctagaactcctgggatcaagcaatcttcacacctcagcctcctgactagctgggactacaatacacgtatggccaccacatctggcttttttttttttttttttttttttttttttttttttagaaatgaggtctcgcttttttgtcccgcctggtctggtactcttggactcaagtgactctatttgtactcccaaagcactgggattaccttatttcctagaaagttggcagaactttttaaatagacattcataaatgtatactcttacacatttcactgtgcttttgagtagtgaaatacaatatgtaacttcctatatttagaatgttttcaattcagtaaattaaacatttaacatttgtagcatcacgtataattttaaataaataattacattatttgctggaaaataaatcaatttttcaccaaagttaaagagcttaagctgtatagtggtttcttccatacaacaactatagtcatatgctgccatgccagctatttccctaaggagagcccaggcatgcttaattatagaggaacaccattacttagaagaaaaaacatgagtctttaatttccttgtctccgctggacggggctgtggattctgctgaatctagcaatgtctgagtaacacttaagcctagctgtttccatatacgggccaggtgttgcgaggtcccaaacaacagtacctcctaagctctcatcagttgtgtttccatcatggattagaacccacacagaattcattatgtctataattaaatgaagaaagcccttctgatgtcaggatattagtgaagcaactgttcgtcttggcagctccgcttttaacttttggattgccagatccctcctgggaaccaacctaagaaagcactatttgatgtagcagttgttcctgcagtgtggtgtcagtgcatttctaattacagtccagacagttttgagcgtgagtaactagacaagaggccaggtcagcactttggcttgccaggtcagacttattttcctcccacttctttccaataatagtttctcatatatacctgaaatagtacagggcattcatctttccaactctaagaaccactcctaagttcaatttcaagctatgtgttgggaagccaaacacgcttagccaaaaagaggcactatcttctcattacgacatttcaattaagtgcccactgtaccatcatctagattttcagcagaaccatactctaactcagcaactctcattatttatgtgactgagctagttctttatatttgtgctgactcaccacagaggttgatattttcaataattttatcatccaaactctgaaagagatgaaaactttgtgttgcttgttttccaaaataataagtttttcatcaaaaggacaaaaatttgttgtaatattatttagttgcaatattttggggctttactgctggttatgatagagtagaatcaacccatcaagtagaatatgaaaagaaggttaacaaaggaagcaaataaacaagcgttatgaaaacaaagagtgatgaattctgacaagctattccattttctttattatcatgacagtaggaagcagcactaaatgtaagagtctgccacaaccctcaaatctgaatgctttattataagtcagccatttaaaatagtaccaacctgaaaactagtgaacaaacagcccagcatccctttgataagcgaaatatacaagttgtgtcatacaatggacagggctgcctgctaaggtattgggcatacttggacccaaatcccagctctgccatttacgagctactgaacttttagcaagtgatctcttctaactcacagttttctcactgataaaatcgatattttataaaattatcaagtaggactatggtaagactatataagataaggtagacaaagtacactgcataatgcctttcactcgaaaaacactaaatagtaattttaataaaaactactgtgatttttaacagaatgattttaaattattctcaacttcaagaggtgcttatgaccttacctttaaggagaggcatctagtccattttctgaaataacttaatgtataatattttgggggaaaatcatgtatatttgcagatttagaaaatactatgagagttatggttgaactacctggtaatgccttttccaatatccaattactcattcaagtatttactgaactcttacaaaatactcatcattcaattacttaacaattccagcagttgagttgttctaattggaaaacttacattgcctgattgtgttggtaggatttgtgctccgtggatgcaagtgtaaaataagaacctatgttttatttctaaacattataaagaacataaaagtggaaaatgattcaaattcaaacactgtatacagtgtttaaaacagagtactttctctgcttacttttaaaattattcataaataggtctgctctctggaatactccttggatatatgttacaaatatttgacttttatactcaacatttttcaatatagatttccattaaggattactttgtaactaagcttttttgtatattcagtgcattggtattcactgaacagcatttctgttttaatttgaaaggtttttttttttaagttgagggagagtttacatacagtaaagcatatacattttacgtatatagttcagtgaatctttacaaatgtaaccaccacccatatcatgcccaatgctccattgttttgtcctcttctagtcaagaccactaaaaggtacctttatcccaacctctatcatcatagattagttgtatctgttttaaacttcatataaacagaattatatcgtatgcactcatataattgctgccttaaagcacttattttatttgtttaaattttacccaagcggaataagggaaacaatgtcctctttacttagcttgtcataaaatccatattttaaagcataataataagagaactctaccaaatctgatgcatacttctgggcataaatgatctaaaatacatttaaaatgaccccaaagtagatgtaaagaaatatgattcacatttttataatactattagcattcacaacgtcctacagcaatctacctgctaccatttaatatctcccacaaatttttaagctttgaaagagtgtgtatctattatctactcgcaaacaatctgtgaagtaggctggcattagttcacaatatattagtagtctgattaggtggtttcccaattcgcaaccttagaaaatgaaacagaacattgatggtgttattttacttttaacatatattaagatgtaaagtcccacctggaatttagttcttcagattccaaaccatgttctgtttacacacaaaatacaaataatcatgtggcaagaaaggaatctgagagagcatggtactcattccagtattcaagtagaactacatggaatccatgctcaggagaaaaaacaaaaagccttgcaattttctgaacagctctaaagcaactggccaaaattttgttttccaaagctaattagaacattttaagatttacgtattcagcaaaggccgtgtaaatttacctattcctatacttatgaataatgaataaaagaaaaggaactgggccacaaaattatagagaagtacacaacaaaaaaagtataagatttttgcatactgttttttaataaaccaaaaaactttaaaaaatataaaaataatttattctgaattacatcaaatagcttatatactttttgagagcacagtttgcacagcaacttctaataggtttattaaccctgtaataaaatgaaacctgaatatctattgtaaggcctaattttcagtacatatttataggagttaattctgcaaccagtgtagctgaggaaggagtatagaatgtggtcaacgactattttcaggtactaatgtgtctcagagccctggttttcataatgtagctaagaatgacagaaatattatacagtgccagttctttctatagtcaatcaggataactatacttttagtaatcaatttaattcacatttaatgatatccaaaactgaacatatcagtgacatgtatacatatatatatatatacacaattttatgctgaaaaatataacctacttatgataactaaaataacagcttgcttgaacttttaaagccaaatatattacctatcttatctgcagcatatgtgtaaataactttaatgtataagagagtctcaaagacaagttataaattcaataaatcttttttatactaaaactattaaaacttttcctatttgatagacaatgtactataaacttcaaagtaaatggtatcttcaataagctattaatatagtaaaaatcactgcttaaatataaaattgggatggaatacaggtattagtttatgtggaaagtgaaagcatagtttctacatatacttttgtgttaagtgcttgctaaatcacaaaattctcagaatgtgattttttaacatattttgagtaacagctagacatgggtaacattagaacacagctgcatgcaacagaaacagaggctcgttgtctttataaactgaaactttaggcaggtaatggatcattattatactaaaattccttttagacaagaagaagttctatacatttaaattttgcttgaaagtacccctaaagaaaatagtgtcggtggaaatagtcagtgaggtaatagtaacaaaagtaacacgtggacacttacaaaatgcttactatgtgccaggcactaatctaagagattcacatgaagtcacctgcttcattttcttaagagcactaagaagtaagcagtattctcatcccaatttcacagataacacaattgaggaatagaaagtttgagtttgccacttgaaaccaggcagtctggcccaagagtctgtataatttaacctctgcactacaactgcatctcagaataggaaaacaaaatctcaaaataatatatttgactttatttgtggcattttggaatagtaactcagtttttattattacctcatagtcaaaataaactttttaataaacagatgcctttcactgtcatactttaagagtttcccagaatgcttcctctagatcaaaactattgatgagtttctgtgactcagagccttctcaatacaggtgatccaccttttcctacaatggcagacttcaaacaaaactctggcaaaatctctgaatcatttttaaccactatctacttatataataactacttaaatgaaaacaatcttacaaagattacaagcacctacaaaatattttcctttattgtagtagttacaatgttgattcaaacaacaaatatattttgtcactagaacatgtacttgggggtatactataaagtatggcactgtacttggggtatgctataaagtgtggcactgccactgggttccaaagacccataaattcaatgggtgtatctgcaggaaaccacagtacaatccacataaagggttcaggtaatgcttttcataggtagaaccaaagtgttctgaacaatcaatggccttacatttcaacacctaaccaaacccatgatgactttaacttccttcaagaaagaattgtatttttcccctagtttaatctacagcttactgtgggtgcttaacaaatgatgttgactgacaaacagaaaatgtttcctctttctccctggccccctttcaatctgttctctacactgtagctagagtgacattttggaaatataaatgtgataatgccatcttcctccctaccatccacactacactctttgcattactattttatcacttttacagtaaagacaaaaatacttgacatggtccagaaggttgtgcactgcctgaccccactcctctcaagtagggagttagagctccatgcttaaggcattctctcagtggcacatgctgtgccatctcctgcatcagaattctgttcctctgggctttacctgattaatacttttcctctgccttaatttggttaattctttctcactttttcagatttcagtttaataatcactttttattacgtcagctgacactattttaagttttcatagtatcatgcacccatccttcaaaatacataccacagttttaagcttcatttttttaaagtcaatatgccttctcactagaatatgaggtctatgaaagtaataattatttctgcactaccattttattgcttaagcctagtactctggtacacaaaacaatcagtacttgctgaataaagaaattaataaacaaatgaatgaatgaacaaatgaatgaatgagtgaatgtggttgcctatctggtcacattcacaaagtaatggaaagcaggagctttcttaagtcacatgtatcatactgacatgttcagtgacattaaacaatcaggaagcataagccatacgtgtttatggccatttaaatagagaacatgcaaaaaaaagtgaaaacagtccaatgtgggattttaatatacatgactctaaaatgcacgagacctggggatctggaaatcatgagaattataacttaatttcttattgattatccttgttattcttgtttttaaactggatagctatgaaattcactaattctttcaagttgctagggatctatgagtgctcttaagtagaaataatgttcaaggtcatttagatgagaccataacaacggtccaggcacttagatgaaatgaatataaaaaagctatgtaccctgtaagcattcatcactcaggaaaggtgacatttttgcttagttgagttctgaggctgacgctcagggtcaaagaacataagtgatgcataaattagttttgttctatcagccatttttacgtttttttttcccttgaatataacacctgaacctgaaaataatctcaacccgaatgaactggaaatcttatttgccagacgtcaagaaaaagggcttgggaacaaataaaagtgtttatgctcttacccaggttctgccactaacctggtcatcacacataacctttcctggattctctaacaatacataaataaataaaacttgctaggctcaaacacaaagccaggatgaaattgagctcattcaataaaaatattctggaaattcataggtgcataagttgtttcaaggcactcttggctggaggttgggggagagataatatttttattatcttattatagtcttactttttagtagttcttattgtattttaaacatgaaggcagttaaatggtgttaaaattttaaaagtattatagtttggaccagagataaactgaatttgtttaatatttacttgtctgtttttttccctaaattttctcttaatgaagtgaacttatttattttaaaattagtttttatgaagaacatggcagacaatgtacatactggctacaggcagagctttgttgatatttcatctgaatagaaatcatctatccctagccattaatacatgatctgtattgggagaatcatccattctcaattaattattcaatagtcacttgacacacatgaaatagggaaaataagcaaaatggagccaatccttctaggaagactgactctgcctttatcactccatctcccaattctgtgatactcaaaagaatccaatcttttgttttccttctacgtttcgtggtgatcttttgcactccattttcagttcaaattttcaaagtgactcaatgcttcagaagaatcctaatggatttgctattctgagttgaattatcctatgtaccaggcactacactgttcaattatgcatcttggtaattccaaattctttatcttatagaaagagctatccatttgcaaaataaaatgcatttcagatacatctaattctgcttctctttaacaaattactttttccactcttaactgttcctgattatgcatgatctctgaatccctacattaaaaatgcatagaaaaataaaaattttcatttaaaacaccctcccacacagtacaagctgtcattgtgtcatatttgtttcctaatttaaggaaggaagctatatttcatgggtccttcattaaattgccttctctgtattttaaagtggcattaggatacttaagacaattttcccataaaataatgttcattttaaaatttgtttctattaatcagtgcaaaagtatgcaacttcaaattacagtatggaaattatcatatctacctagcatattattcatgattcacaagtagatttgctagaagaaaaaaactatcttttttattttgtaaaacataactgtaaagcctgctctcataaccatagaaatgtactgttaaagctgaagtgctgtataggccatggaatacacagttttctataattacctaagccaaaatataatgaaaaacaaaaacccacatgaagacagagcgcaacaaaatagccctttctttcttcccctcctcctaatcctgtgaaggctacagaagtctcctaaagaccagttttttttcttcctaactaactctccttgctgtttaaacaattacaaatcttatcaagtcttcatttctcttaaagtcaagtgagagagaactgccaactctaataagatttacaaaggctagttccccttagcactgtcagcaaaaatcaaagacattatacaataaaacgcagccacacagagcttttgtccctatagctttcgaaatcagatttaataattcaccttttttcacccatttcagccacaaatgccatttatccatgtgttgattgccttgctttgacccataagctatctactttaaatcctgacatctcctacttagccactgattcgtctttttcacaccactcactcactttctgttagaggctttgctgtatttatacaacagtattttccttggtcattgtcatgtaacagcaccggcaaaacacactgaagaccgaattttatttctaaagaggagaaaagagaacttaggtatgacttttgtagtttaatgccacactgttttaagccccaagaaccacagaaattacaacttggcctccactacccagataaatgtcattagccgaatatccttagaaaatctcttgcaatcccttacatgcatccctgtttattagtctgcagaagcttcccaatccagcaacatctaaatttctctactactttatttctctttataaggcatttgttaattaagaaatcttatttaatctctaacatttttaaacgtcagctgacctcacacttcaagaaaccgcataaatgacaaaattttacttaaatttcacaaatgttggacttggatataacagtggaaaccaacattattccaaaaagcctcctgctaatgaagaaacgcttcacatcctctctttccctttttccacaacgaaaagcaggtttttaccgctctatctgcaaaaggcagagcactgcccgtgaaccctgtctttctcgtcctttaccacgagtgaccagaaccacgtggggattctcaaccacggccgtggtatacctctcctgtgcttcatttctcatcaaacacatgcccaatcttctagatgcttgtttgcatcttaagggcaaagtctgtgtgttacagatttagaagtggtagagacaagtacagtggtcatataggtgggccgcggcccaatatagggcccaacctgccaaagaacccgaggaataagaagaggccattgtatttgccacttggaagggagtagtgttggtagaaaggtctccagaaggaactcaaacttggatatgggggctgccaatccttaggaggatgtcaagggagaagctgtggaggtggtaaggtagagagtcccccagaaacaaggtccttccctcgaagcgaactgccacacgtttgccaagattaggaagaccccatgcaccagcccggtcccctcctccccgagccccgcccaggccccggcccccgtgggtcgggcgtcgggccttaccttggctgcagtccttgccgcggaagccggttcgcgagcagtcgcacacggcctggtcgtccaccacggagcacacacctccgttgaggcacaccccgccctcgccctcctcgcccgcctcgcacgggcttcccccgccgctgttgggcggctcatcgtccagcttcacctcgccgctgtccacgggcaggacctgcgaggagttgaccctcacgtcacgaatccaccccttgaagggctcccgctccctcaccgaggccagggtgagcttgagcgccgcggcgcgcagttccgggggcagccccccgacgaaaaggccgctgaacaccgtcatgtccctgcgcttggacttgacctccacccacttggcctccacctggtcgatgaagagcgtggtgttgcggaactggcggcggatgcgcacgctgtgccaggcgccgtcgttaaccggcgtgtcggccaggagcgtcgcaggctcagcgcagaagatggagaagctgagctgcaggcggccgccgcgcgtcagaatcagctccaggaagtcgcagaagccctcgtcgtcgaagtagagcacgaggccgcgggcgctgcgagtcttgagctggaagctcatctcgctctcgcagcaggcgttccacttggggaagcgcgtccattggccctcggcgcccggaaactccagcccgctgcccagctccgcccagcagcccaggagcagcagcgagaggcacagaagaaaacagcccccgcgctggagcagcgccgtccccatgctcggggctggggtgcggcgggggggtgccggggccgacagggtcaaaatggtcctggacaccgtgacgaagaaataagggtcccgagagacagaaaggtaaggggaaaggcgggagtgagagggatgtgccctcctttatctagttctttttttcttcttcttcttccaataaccccgccctctctccctgtagtcctcttccaactggaaaacgttgaccccagtggtacagggtagccacagaacttccagaccaaagggaggatgcactttggagacaacgttctggaaaaggcttcaacaaaagatcaagggaaagcactgacccatttgagtctgattaactaatttaagagtatctgcagtgtcaacagatacttaactcctcaaatcccattatctgccaggttccaccagtggtaccaggccaaaaggaagcagtgagagtcagtaaaaagaaaacacttttctcaagaaagtacaggaagccagcagtgagccagtatccttggatgcttgtgaatgcctcaagtctgtctccttcagatgtggtgtcttacagcagaacggagaaagggatgcttgcctctttagggcaccatttcttaacccgaggatagcttcaaaggcctgcttcttctgtcatagcatgggcttcagcaccgctgcagccaaagcctaattccttgtgcgtggtctcacaagttggattttacttctcttttcagccacggcaacagtaggactcaaacccagcagttgcgaaatagccagaagctgttagatgtggaaatcgcaacagctcctcttcttttctctctgcctctgcagggccaagctaagatgccagcacatcaattggttgtgtgttggtgatgcattttggttttatcttgtcttttttaaggactcagacatctgcagagaattaaagtcaaaattaaggtctaaagtcaatatagtattatataaatcattattcagctcataacacaagtgtagacctggtcctattagtaaggcaaagagttaaccttcttgtatggagcttttgttatcctcactacaagtaagtcctaacattttctaatagttaatatgacacttttacagtcagccatgacacccttgtagtttattataactgttagttggtaacccgaagttttaaagagaaatttgattatggttatctttttcttttcgcaagatagtttaatttttaaaatatgtgaggggagaacaaatgcttttaaggatttctacctatgttgtgtgcttgttctgtggacagtaaaaatacaacctattcaaatctcagttaagagattttacaattggcaaattagattaaactgttggcaggaagctgccagcttagacttgtatagcattcctgccattttatttttcttagaaggaatattgatggtttcttgatagtctcttgcaaaatttcacacaagtatagttctcctttatattaatgaataatctgttgtaaaagaaaaccactaattggagccagatttatgtttttggcattgtctcaattgccctaatattaacttctctaaaggtgcataaagtatttaatattttgcctaaaagtgtagatctaactcctcctgaagtctgtatcttgctgtcagccctcacaatttgtgtggtcagaagagctgttggcatgtatgtcatctcagctgcagtggctccaggatgctagaatttaaaaccgtacctttgaatcactcactatactattaaatcacttctctttattcaactctaatctgacaggttcttgaaatggtacagaaatcataatcactgatttttttcctaagtcattttttaaccaaaaaattactcttaccttttgaaaaaaattacaaatgtataatctgttcatgtcaaggaagtgcattatttttctcactatttcttatattccccacctcttgcaaacacacacactgcaatatatatacaccatacacacatgcacacacacaccccaaatttattgtctggatgtagaagctcactacccaattaacactttttttcccttacaagctgaaactagcagtaatttatggcaccgcattgtgctgctgcttctccatggggggagctgagagcatttctcttcagtacagagcaatccccacaggtgtcagctgagagccaccaagctagggtatcccacttcaagttcctcccagatgaaattgatgactggttctctctctttcaacacacacacacacacacacacacacacacacacacagtgtgggtgtgcgcacatacacactgcccactagcaaaaggaaataaaaatctcagttgcttatttattatggctgatacattccacaccatcagcaatcaccagtcatatcttgtcttctcctatatcaaacccgaggaaagaggctcgtcaaatcatctgaaatagcatattattcagtatactttcatattttaagtggactcaggaatctgctaaattttcagtcatttgcaaaataaatctggaatatcatgatcaagagtagtgctttgaaccctttctcaagctcatgtgttagaaaacctttttttttttcttgtgtgtgtaactctgttggagccaattattgtattaattaatgttacattgatcacataaccttttttctcccgtccctcctgccctcctccactaatgcacaccttgacaattttaagggatggtggaagagagaaaaaccgtagagcaatatatatgtacatatagatatatatacattcttatcacagggaggttaactggttttcccagttcttggaggaagctcattgtatgtgagcgagtatctgtatttatatggagaaaagaggattctctctaggtgccagaaagacctggccagttcacaaattagaggatgaaataaagggatctgaaaaacatccttactgcagccaaaagaagaagcgctctaattcaaaagcagactaacagcatcattaatcttttctttcatttctagaatcaaattcatcccaagtcactaggaggatcaatacagtacgctcatcggctgcagttgcatattttaatgtttctgatatcacacacacatacacacctacacctttccatgcacccttcaatatatatatatatcttcataaagaacatgaaatctctgagagaaattttagaagtgcttattatttcacccctggcttttgcaaagtctctcaataccaatgcacagccaaaattctctctggctttcccgcccagtctctaagctccatctctaataccagtgcagtttcttggagctcggggtctactgcacaaattaacgatgggcacagtgtggggctgatgaggtagggaaggaaatatatggagagatattttattgctttgatatctagcctgtctcttattttctttcttttgctaatacatcactgcattcagcctttaagttactaccccagttccaccatctcttcttgccatctatttaaaaggcttcatgcaaaacaaccaagatctacactcctccaccctcccaccacccatctttccctgtgtatttgtggcagatcctggctcagttacaatggggaaagatatccttcttcagcttgcctcgccccatcccctccccccaacccaaattgagcttctttacctgcccggttattcccctcagctcgagccagagcctgaagcatgcatcggtcaaagcgaatttcctgaggtctatggataaggcgactgctgctgccttttcagaggcgtcaggcttgagcgtctatctccaggagtgcgggaggggagaacaggcaacggaggggagcaggaggaggaggaggaggagaaggaggaggagggggaggagagggaaagagctgggaaggaaaaggcggtggtggagcctgagaaggctgggttacgtgacgccgggtgctgtccttctgaaagagaagggcggagctgagctctccgcagtaccatggagagcggcgggcccgtcctttggctggggaatgggtgggctcggcccgtggtcgcagcccctccaggtctggatgctgcggagcgaggtgcttttacctttgcatcgtccccttgcagggggagcctgatcctgggggcggggaccttccgcaagcgcttctaacttgtcaccaccctctcttccccatcggaaagaaagaaagagagagagagagagagagagagag

SEQ ID NO: 89 - DNA, 1114033 bp, Homo sapiens; identical to SEQ ID NO: 88
